United States Patent 11,001,844 (CRISPR/CAS-RELATED METHODS AND COMPOSITIONS FOR TREATING HERPES SIMPLEX VIRUS) - sequence listing, part 2

SEQ ID NO: 29244 - RNA, 24 nt, Artificial Sequence
  Synthetic
ucucgucucuccccagcgccggac

SEQ ID NO: 29245 - RNA, 18 nt, Artificial Sequence
  Synthetic
uccgcgcucgcagacacc

SEQ ID NO: 29246 - RNA, 19 nt, Artificial Sequence
  Synthetic
guccgcgcucgcagacacc

SEQ ID NO: 29247 - RNA, 20 nt, Artificial Sequence
  Synthetic
cguccgcgcucgcagacacc

SEQ ID NO: 29248 - RNA, 21 nt, Artificial Sequence
  Synthetic
gcguccgcgcucgcagacacc

SEQ ID NO: 29249 - RNA, 22 nt, Artificial Sequence
  Synthetic
cgcguccgcgcucgcagacacc

SEQ ID NO: 29250 - RNA, 23 nt, Artificial Sequence
  Synthetic
ccgcguccgcgcucgcagacacc

SEQ ID NO: 29251 - RNA, 24 nt, Artificial Sequence
  Synthetic
gccgcguccgcgcucgcagacacc

SEQ ID NO: 29252 - RNA, 18 nt, Artificial Sequence
  Synthetic
ccucuuggcccccacccc

SEQ ID NO: 29253 - RNA, 19 nt, Artificial Sequence
  Synthetic
cccucuuggcccccacccc

SEQ ID NO: 29254 - RNA, 20 nt, Artificial Sequence
  Synthetic
gcccucuuggcccccacccc

SEQ ID NO: 29255 - RNA, 21 nt, Artificial Sequence
  Synthetic
cgcccucuuggcccccacccc

SEQ ID NO: 29256 - RNA, 22 nt, Artificial Sequence
  Synthetic
ccgcccucuuggcccccacccc

SEQ ID NO: 29257 - RNA, 23 nt, Artificial Sequence
  Synthetic
gccgcccucuuggcccccacccc

SEQ ID NO: 29258 - RNA, 24 nt, Artificial Sequence
  Synthetic
cgccgcccucuuggcccccacccc

SEQ ID NO: 29259 - RNA, 18 nt, Artificial Sequence
  Synthetic
cucuuggcccccaccccc

SEQ ID NO: 29260 - RNA, 19 nt, Artificial Sequence
  Synthetic
ccucuuggcccccaccccc

SEQ ID NO: 29261 - RNA, 20 nt, Artificial Sequence
  Synthetic
cccucuuggcccccaccccc

SEQ ID NO: 29262 - RNA, 21 nt, Artificial Sequence
  Synthetic
gcccucuuggcccccaccccc

SEQ ID NO: 29263 - RNA, 22 nt, Artificial Sequence
  Synthetic
cgcccucuuggcccccaccccc

SEQ ID NO: 29264 - RNA, 23 nt, Artificial Sequence
  Synthetic
ccgcccucuuggcccccaccccc

SEQ ID NO: 29265 - RNA, 24 nt, Artificial Sequence
  Synthetic
gccgcccucuuggcccccaccccc

SEQ ID NO: 29266 - RNA, 18 nt, Artificial Sequence
  Synthetic
guggcagaccuccccccc

SEQ ID NO: 29267 - RNA, 19 nt, Artificial Sequence
  Synthetic
uguggcagaccuccccccc

SEQ ID NO: 29268 - RNA, 20 nt, Artificial Sequence
  Synthetic
cuguggcagaccuccccccc

SEQ ID NO: 29269 - RNA, 21 nt, Artificial Sequence
  Synthetic
acuguggcagaccuccccccc

SEQ ID NO: 29270 - RNA, 22 nt, Artificial Sequence
  Synthetic
gacuguggcagaccuccccccc

SEQ ID NO: 29271 - RNA, 23 nt, Artificial Sequence
  Synthetic
cgacuguggcagaccuccccccc

SEQ ID NO: 29272 - RNA, 24 nt, Artificial Sequence
  Synthetic
acgacuguggcagaccuccccccc

SEQ ID NO: 29273 - RNA, 18 nt, Artificial Sequence
  Synthetic
uguggcagaccucccccc

SEQ ID NO: 29274 - RNA, 19 nt, Artificial Sequence
  Synthetic
cuguggcagaccucccccc

SEQ ID NO: 29275 - RNA, 20 nt, Artificial Sequence
  Synthetic
acuguggcagaccucccccc

SEQ ID NO: 29276 - RNA, 21 nt, Artificial Sequence
  Synthetic
gacuguggcagaccucccccc

SEQ ID NO: 29277 - RNA, 22 nt, Artificial Sequence
  Synthetic
cgacuguggcagaccucccccc

SEQ ID NO: 29278 - RNA, 23 nt, Artificial Sequence
  Synthetic
acgacuguggcagaccucccccc

SEQ ID NO: 29279 - RNA, 24 nt, Artificial Sequence
  Synthetic
gacgacuguggcagaccucccccc

SEQ ID NO: 29280 - RNA, 18 nt, Artificial Sequence
  Synthetic
gacgggggcgcggcgccc

SEQ ID NO: 29281 - RNA, 19 nt, Artificial Sequence
  Synthetic
cgacgggggcgcggcgccc

SEQ ID NO: 29282 - RNA, 20 nt, Artificial Sequence
  Synthetic
ccgacgggggcgcggcgccc

SEQ ID NO: 29283 - RNA, 21 nt, Artificial Sequence
  Synthetic
gccgacgggggcgcggcgccc

SEQ ID NO: 29284 - RNA, 22 nt, Artificial Sequence
  Synthetic
cgccgacgggggcgcggcgccc

SEQ ID NO: 29285 - RNA, 23 nt, Artificial Sequence
  Synthetic
acgccgacgggggcgcggcgccc

SEQ ID NO: 29286 - RNA, 24 nt, Artificial Sequence
  Synthetic
gacgccgacgggggcgcggcgccc

SEQ ID NO: 29287 - RNA, 18 nt, Artificial Sequence
  Synthetic
ccuccccccccggggccc

SEQ ID NO: 29288 - RNA, 19 nt, Artificial Sequence
  Synthetic
accuccccccccggggccc

SEQ ID NO: 29289 - RNA, 20 nt, Artificial Sequence
  Synthetic
gaccuccccccccggggccc

SEQ ID NO: 29290 - RNA, 21 nt, Artificial Sequence
  Synthetic
agaccuccccccccggggccc

SEQ ID NO: 29291 - RNA, 22 nt, Artificial Sequence
  Synthetic
cagaccuccccccccggggccc

SEQ ID NO: 29292 - RNA, 23 nt, Artificial Sequence
  Synthetic
gcagaccuccccccccggggccc

SEQ ID NO: 29293 - RNA, 24 nt, Artificial Sequence
  Synthetic
ggcagaccuccccccccggggccc

SEQ ID NO: 29294 - RNA, 18 nt, Artificial Sequence
  Synthetic
gagagcggcccggggccc

SEQ ID NO: 29295 - RNA, 19 nt, Artificial Sequence
  Synthetic
ggagagcggcccggggccc

SEQ ID NO: 29296 - RNA, 20 nt, Artificial Sequence
  Synthetic
aggagagcggcccggggccc

SEQ ID NO: 29297 - RNA, 21 nt, Artificial Sequence
  Synthetic
aaggagagcggcccggggccc

SEQ ID NO: 29298 - RNA, 22 nt, Artificial Sequence
  Synthetic
aaaggagagcggcccggggccc

SEQ ID NO: 29299 - RNA, 23 nt, Artificial Sequence
  Synthetic
caaaggagagcggcccggggccc

SEQ ID NO: 29300 - RNA, 24 nt, Artificial Sequence
  Synthetic
acaaaggagagcggcccggggccc

SEQ ID NO: 29301 - RNA, 18 nt, Artificial Sequence
  Synthetic
gcugcuccgcggggcgcc

SEQ ID NO: 29302 - RNA, 19 nt, Artificial Sequence
  Synthetic
ugcugcuccgcggggcgcc

SEQ ID NO: 29303 - RNA, 20 nt, Artificial Sequence
  Synthetic
cugcugcuccgcggggcgcc

SEQ ID NO: 29304 - RNA, 21 nt, Artificial Sequence
  Synthetic
gcugcugcuccgcggggcgcc

SEQ ID NO: 29305 - RNA, 22 nt, Artificial Sequence
  Synthetic
ugcugcugcuccgcggggcgcc

SEQ ID NO: 29306 - RNA, 23 nt, Artificial Sequence
  Synthetic
cugcugcugcuccgcggggcgcc

SEQ ID NO: 29307 - RNA, 24 nt, Artificial Sequence
  Synthetic
gcugcugcugcuccgcggggcgcc

SEQ ID NO: 29308 - RNA, 18 nt, Artificial Sequence
  Synthetic
gaggcggaggacgaggcc

SEQ ID NO: 29309 - RNA, 19 nt, Artificial Sequence
  Synthetic
agaggcggaggacgaggcc

SEQ ID NO: 29310 - RNA, 20 nt, Artificial Sequence
  Synthetic
aagaggcggaggacgaggcc

SEQ ID NO: 29311 - RNA, 21 nt, Artificial Sequence
  Synthetic
gaagaggcggaggacgaggcc

SEQ ID NO: 29312 - RNA, 22 nt, Artificial Sequence
  Synthetic
ggaagaggcggaggacgaggcc

SEQ ID NO: 29313 - RNA, 23 nt, Artificial Sequence
  Synthetic
aggaagaggcggaggacgaggcc

SEQ ID NO: 29314 - RNA, 24 nt, Artificial Sequence
  Synthetic
gaggaagaggcggaggacgaggcc

SEQ ID NO: 29315 - RNA, 18 nt, Artificial Sequence
  Synthetic
guggcgcgaccggaggcc

SEQ ID NO: 29316 - RNA, 19 nt, Artificial Sequence
  Synthetic
gguggcgcgaccggaggcc

SEQ ID NO: 29317 - RNA, 20 nt, Artificial Sequence
  Synthetic
ggguggcgcgaccggaggcc

SEQ ID NO: 29318 - RNA, 21 nt, Artificial Sequence
  Synthetic
cggguggcgcgaccggaggcc

SEQ ID NO: 29319 - RNA, 22 nt, Artificial Sequence
  Synthetic
acggguggcgcgaccggaggcc

SEQ ID NO: 29320 - RNA, 23 nt, Artificial Sequence
  Synthetic
cacggguggcgcgaccggaggcc

SEQ ID NO: 29321 - RNA, 24 nt, Artificial Sequence
  Synthetic
ccacggguggcgcgaccggaggcc

SEQ ID NO: 29322 - RNA, 18 nt, Artificial Sequence
  Synthetic
agacaaaggagagcggcc

SEQ ID NO: 29323 - RNA, 19 nt, Artificial Sequence
  Synthetic
gagacaaaggagagcggcc

SEQ ID NO: 29324 - RNA, 20 nt, Artificial Sequence
  Synthetic
ggagacaaaggagagcggcc

SEQ ID NO: 29325 - RNA, 21 nt, Artificial Sequence
  Synthetic
aggagacaaaggagagcggcc

SEQ ID NO: 29326 - RNA, 22 nt, Artificial Sequence
  Synthetic
gaggagacaaaggagagcggcc

SEQ ID NO: 29327 - RNA, 23 nt, Artificial Sequence
  Synthetic
ggaggagacaaaggagagcggcc

SEQ ID NO: 29328 - RNA, 24 nt, Artificial Sequence
  Synthetic
aggaggagacaaaggagagcggcc

SEQ ID NO: 29329 - RNA, 18 nt, Artificial Sequence
  Synthetic
gcggcggcgaccgcggcc

SEQ ID NO: 29330 - RNA, 19 nt, Artificial Sequence
  Synthetic
ggcggcggcgaccgcggcc

SEQ ID NO: 29331 - RNA, 20 nt, Artificial Sequence
  Synthetic
aggcggcggcgaccgcggcc

SEQ ID NO: 29332 - RNA, 21 nt, Artificial Sequence
  Synthetic
gaggcggcggcgaccgcggcc

SEQ ID NO: 29333 - RNA, 22 nt, Artificial Sequence
  Synthetic
ggaggcggcggcgaccgcggcc

SEQ ID NO: 29334 - RNA, 23 nt, Artificial Sequence
  Synthetic
aggaggcggcggcgaccgcggcc

SEQ ID NO: 29335 - RNA, 24 nt, Artificial Sequence
  Synthetic
gaggaggcggcggcgaccgcggcc

SEQ ID NO: 29336 - RNA, 18 nt, Artificial Sequence
  Synthetic
cgucguccgugccgggcc

SEQ ID NO: 29337 - RNA, 19 nt, Artificial Sequence
  Synthetic
ucgucguccgugccgggcc

SEQ ID NO: 29338 - RNA, 20 nt, Artificial Sequence
  Synthetic
cucgucguccgugccgggcc

SEQ ID NO: 29339 - RNA, 21 nt, Artificial Sequence
  Synthetic
ccucgucguccgugccgggcc

SEQ ID NO: 29340 - RNA, 22 nt, Artificial Sequence
  Synthetic
uccucgucguccgugccgggcc

SEQ ID NO: 29341 - RNA, 23 nt, Artificial Sequence
  Synthetic
guccucgucguccgugccgggcc

SEQ ID NO: 29342 - RNA, 24 nt, Artificial Sequence
  Synthetic
cguccucgucguccgugccgggcc

SEQ ID NO: 29343 - RNA, 18 nt, Artificial Sequence
  Synthetic
ggcgccgggucgcgggcc

SEQ ID NO: 29344 - RNA, 19 nt, Artificial Sequence
  Synthetic
gggcgccgggucgcgggcc

SEQ ID NO: 29345 - RNA, 20 nt, Artificial Sequence
  Synthetic
cgggcgccgggucgcgggcc

SEQ ID NO: 29346 - RNA, 21 nt, Artificial Sequence
  Synthetic
ccgggcgccgggucgcgggcc

SEQ ID NO: 29347 - RNA, 22 nt, Artificial Sequence
  Synthetic
gccgggcgccgggucgcgggcc

SEQ ID NO: 29348 - RNA, 23 nt, Artificial Sequence
  Synthetic
ggccgggcgccgggucgcgggcc

SEQ ID NO: 29349 - RNA, 24 nt, Artificial Sequence
  Synthetic
aggccgggcgccgggucgcgggcc

SEQ ID NO: 29350 - RNA, 18 nt, Artificial Sequence
  Synthetic
cgcagcagcgcgggggcc

SEQ ID NO: 29351 - RNA, 19 nt, Artificial Sequence
  Synthetic
gcgcagcagcgcgggggcc

SEQ ID NO: 29352 - RNA, 20 nt, Artificial Sequence
  Synthetic
ggcgcagcagcgcgggggcc

SEQ ID NO: 29353 - RNA, 21 nt, Artificial Sequence
  Synthetic
cggcgcagcagcgcgggggcc

SEQ ID NO: 29354 - RNA, 22 nt, Artificial Sequence
  Synthetic
gcggcgcagcagcgcgggggcc

SEQ ID NO: 29355 - RNA, 23 nt, Artificial Sequence
  Synthetic
cgcggcgcagcagcgcgggggcc

SEQ ID NO: 29356 - RNA, 24 nt, Artificial Sequence
  Synthetic
ccgcggcgcagcagcgcgggggcc

SEQ ID NO: 29357 - RNA, 18 nt, Artificial Sequence
  Synthetic
accggggguguuggugcc

SEQ ID NO: 29358 - RNA, 19 nt, Artificial Sequence
  Synthetic
caccggggguguuggugcc

SEQ ID NO: 29359 - RNA, 20 nt, Artificial Sequence
  Synthetic
gcaccggggguguuggugcc

SEQ ID NO: 29360 - RNA, 21 nt, Artificial Sequence
  Synthetic
ggcaccggggguguuggugcc

SEQ ID NO: 29361 - RNA, 22 nt, Artificial Sequence
  Synthetic
cggcaccggggguguuggugcc

SEQ ID NO: 29362 - RNA, 23 nt, Artificial Sequence
  Synthetic
gcggcaccggggguguuggugcc

SEQ ID NO: 29363 - RNA, 24 nt, Artificial Sequence
  Synthetic
ggcggcaccggggguguuggugcc

SEQ ID NO: 29364 - RNA, 18 nt, Artificial Sequence
  Synthetic
cgccgcugcugcugcucc

SEQ ID NO: 29365 - RNA, 19 nt, Artificial Sequence
  Synthetic
ccgccgcugcugcugcucc

SEQ ID NO: 29366 - RNA, 20 nt, Artificial Sequence
  Synthetic
gccgccgcugcugcugcucc

SEQ ID NO: 29367 - RNA, 21 nt, Artificial Sequence
  Synthetic
cgccgccgcugcugcugcucc

SEQ ID NO: 29368 - RNA, 22 nt, Artificial Sequence
  Synthetic
gcgccgccgcugcugcugcucc

SEQ ID NO: 29369 - RNA, 23 nt, Artificial Sequence
  Synthetic
ggcgccgccgcugcugcugcucc

SEQ ID NO: 29370 - RNA, 24 nt, Artificial Sequence
  Synthetic
gggcgccgccgcugcugcugcucc

SEQ ID NO: 29371 - RNA, 18 nt, Artificial Sequence
  Synthetic
acguuccccgucuggucc

SEQ ID NO: 29372 - RNA, 19 nt, Artificial Sequence
  Synthetic
cacguuccccgucuggucc

SEQ ID NO: 29373 - RNA, 20 nt, Artificial Sequence
  Synthetic
ccacguuccccgucuggucc

SEQ ID NO: 29374 - RNA, 21 nt, Artificial Sequence
  Synthetic
gccacguuccccgucuggucc

SEQ ID NO: 29375 - RNA, 22 nt, Artificial Sequence
  Synthetic
cgccacguuccccgucuggucc

SEQ ID NO: 29376 - RNA, 23 nt, Artificial Sequence
  Synthetic
ccgccacguuccccgucuggucc

SEQ ID NO: 29377 - RNA, 24 nt, Artificial Sequence
  Synthetic
uccgccacguuccccgucuggucc

SEQ ID NO: 29378 - RNA, 18 nt, Artificial Sequence
  Synthetic
ccgacccgcgccucuucc

SEQ ID NO: 29379 - RNA, 19 nt, Artificial Sequence
  Synthetic
uccgacccgcgccucuucc

SEQ ID NO: 29380 - RNA, 20 nt, Artificial Sequence
  Synthetic
guccgacccgcgccucuucc

SEQ ID NO: 29381 - RNA, 21 nt, Artificial Sequence
  Synthetic
aguccgacccgcgccucuucc

SEQ ID NO: 29382 - RNA, 22 nt, Artificial Sequence
  Synthetic
gaguccgacccgcgccucuucc

SEQ ID NO: 29383 - RNA, 23 nt, Artificial Sequence
  Synthetic
cgaguccgacccgcgccucuucc

SEQ ID NO: 29384 - RNA, 24 nt, Artificial Sequence
  Synthetic
ccgaguccgacccgcgccucuucc

SEQ ID NO: 29385 - RNA, 18 nt, Artificial Sequence
  Synthetic
cccccgcggcgcagcagc

SEQ ID NO: 29386 - RNA, 19 nt, Artificial Sequence
  Synthetic
gcccccgcggcgcagcagc

SEQ ID NO: 29387 - RNA, 20 nt, Artificial Sequence
  Synthetic
ggcccccgcggcgcagcagc

SEQ ID NO: 29388 - RNA, 21 nt, Artificial Sequence
  Synthetic
cggcccccgcggcgcagcagc

SEQ ID NO: 29389 - RNA, 22 nt, Artificial Sequence
  Synthetic
ucggcccccgcggcgcagcagc

SEQ ID NO: 29390 - RNA, 23 nt, Artificial Sequence
  Synthetic
cucggcccccgcggcgcagcagc

SEQ ID NO: 29391 - RNA, 24 nt, Artificial Sequence
  Synthetic
ccucggcccccgcggcgcagcagc

SEQ ID NO: 29392 - RNA, 18 nt, Artificial Sequence
  Synthetic
ggggggcgaggggcgagc

SEQ ID NO: 29393 - RNA, 19 nt, Artificial Sequence
  Synthetic
uggggggcgaggggcgagc

SEQ ID NO: 29394 - RNA, 20 nt, Artificial Sequence
  Synthetic
cuggggggcgaggggcgagc

SEQ ID NO: 29395 - RNA, 21 nt, Artificial Sequence
  Synthetic
ccuggggggcgaggggcgagc

SEQ ID NO: 29396 - RNA, 22 nt, Artificial Sequence
  Synthetic
cccuggggggcgaggggcgagc

SEQ ID NO: 29397 - RNA, 23 nt, Artificial Sequence
  Synthetic
ccccuggggggcgaggggcgagc

SEQ ID NO: 29398 - RNA, 24 nt, Artificial Sequence
  Synthetic
cccccuggggggcgaggggcgagc

SEQ ID NO: 29399 - RNA, 18 nt, Artificial Sequence
  Synthetic
cccccagcgacagggagc

SEQ ID NO: 29400 - RNA, 19 nt, Artificial Sequence
  Synthetic
ccccccagcgacagggagc

SEQ ID NO: 29401 - RNA, 20 nt, Artificial Sequence
  Synthetic
uccccccagcgacagggagc

SEQ ID NO: 29402 - RNA, 21 nt, Artificial Sequence
  Synthetic
guccccccagcgacagggagc

SEQ ID NO: 29403 - RNA, 22 nt, Artificial Sequence
  Synthetic
uguccccccagcgacagggagc

SEQ ID NO: 29404 - RNA, 23 nt, Artificial Sequence
  Synthetic
guguccccccagcgacagggagc

SEQ ID NO: 29405 - RNA, 24 nt, Artificial Sequence
  Synthetic
uguguccccccagcgacagggagc

SEQ ID NO: 29406 - RNA, 18 nt, Artificial Sequence
  Synthetic
ggugcggcggcuccacgc

SEQ ID NO: 29407 - RNA, 19 nt, Artificial Sequence
  Synthetic
gggugcggcggcuccacgc

SEQ ID NO: 29408 - RNA, 20 nt, Artificial Sequence
  Synthetic
agggugcggcggcuccacgc

SEQ ID NO: 29409 - RNA, 21 nt, Artificial Sequence
  Synthetic
cagggugcggcggcuccacgc

SEQ ID NO: 29410 - RNA, 22 nt, Artificial Sequence
  Synthetic
gcagggugcggcggcuccacgc

SEQ ID NO: 29411 - RNA, 23 nt, Artificial Sequence
  Synthetic
agcagggugcggcggcuccacgc

SEQ ID NO: 29412 - RNA, 24 nt, Artificial Sequence
  Synthetic
gagcagggugcggcggcuccacgc

SEQ ID NO: 29413 - RNA, 18 nt, Artificial Sequence
  Synthetic
gcgccagggccacgacgc

SEQ ID NO: 29414 - RNA, 19 nt, Artificial Sequence
  Synthetic
ggcgccagggccacgacgc

SEQ ID NO: 29415 - RNA, 20 nt, Artificial Sequence
  Synthetic
aggcgccagggccacgacgc

SEQ ID NO: 29416 - RNA, 21 nt, Artificial Sequence
  Synthetic
aaggcgccagggccacgacgc

SEQ ID NO: 29417 - RNA, 22 nt, Artificial Sequence
  Synthetic
uaaggcgccagggccacgacgc

SEQ ID NO: 29418 - RNA, 23 nt, Artificial Sequence
  Synthetic
guaaggcgccagggccacgacgc

SEQ ID NO: 29419 - RNA, 24 nt, Artificial Sequence
  Synthetic
cguaaggcgccagggccacgacgc

SEQ ID NO: 29420 - RNA, 18 nt, Artificial Sequence
  Synthetic
gcuguuccacuccgacgc

SEQ ID NO: 29421 - RNA, 19 nt, Artificial Sequence
  Synthetic
ggcuguuccacuccgacgc

SEQ ID NO: 29422 - RNA, 20 nt, Artificial Sequence
  Synthetic
aggcuguuccacuccgacgc

SEQ ID NO: 29423 - RNA, 21 nt, Artificial Sequence
  Synthetic
gaggcuguuccacuccgacgc

SEQ ID NO: 29424 - RNA, 22 nt, Artificial Sequence
  Synthetic
agaggcuguuccacuccgacgc

SEQ ID NO: 29425 - RNA, 23 nt, Artificial Sequence
  Synthetic
cagaggcuguuccacuccgacgc

SEQ ID NO: 29426 - RNA, 24 nt, Artificial Sequence
  Synthetic
ccagaggcuguuccacuccgacgc

SEQ ID NO: 29427 - RNA, 18 nt, Artificial Sequence
  Synthetic
ggggcggacuccggacgc

SEQ ID NO: 29428 - RNA, 19 nt, Artificial Sequence
  Synthetic
cggggcggacuccggacgc

SEQ ID NO: 29429 - RNA, 20 nt, Artificial Sequence
  Synthetic
gcggggcggacuccggacgc

SEQ ID NO: 29430 - RNA, 21 nt, Artificial Sequence
  Synthetic
cgcggggcggacuccggacgc

SEQ ID NO: 29431 - RNA, 22 nt, Artificial Sequence
  Synthetic
gcgcggggcggacuccggacgc

SEQ ID NO: 29432 - RNA, 23 nt, Artificial Sequence
  Synthetic
ggcgcggggcggacuccggacgc

SEQ ID NO: 29433 - RNA, 24 nt, Artificial Sequence
  Synthetic
cggcgcggggcggacuccggacgc

SEQ ID NO: 29434 - RNA, 18 nt, Artificial Sequence
  Synthetic
cgcggcgcccgcggacgc

SEQ ID NO: 29435 - RNA, 19 nt, Artificial Sequence
  Synthetic
gcgcggcgcccgcggacgc

SEQ ID NO: 29436 - RNA, 20 nt, Artificial Sequence
  Synthetic
ggcgcggcgcccgcggacgc

SEQ ID NO: 29437 - RNA, 21 nt, Artificial Sequence
  Synthetic
gggcgcggcgcccgcggacgc

SEQ ID NO: 29438 - RNA, 22 nt, Artificial Sequence
  Synthetic
ggggcgcggcgcccgcggacgc

SEQ ID NO: 29439 - RNA, 23 nt, Artificial Sequence
  Synthetic
gggggcgcggcgcccgcggacgc

SEQ ID NO: 29440 - RNA, 24 nt, Artificial Sequence
  Synthetic
cgggggcgcggcgcccgcggacgc

SEQ ID NO: 29441 - RNA, 18 nt, Artificial Sequence
  Synthetic
gcgcggggcgacggccgc

SEQ ID NO: 29442 - RNA, 19 nt, Artificial Sequence
  Synthetic
cgcgcggggcgacggccgc

SEQ ID NO: 29443 - RNA, 20 nt, Artificial Sequence
  Synthetic
acgcgcggggcgacggccgc

SEQ ID NO: 29444 - RNA, 21 nt, Artificial Sequence
  Synthetic
gacgcgcggggcgacggccgc

SEQ ID NO: 29445 - RNA, 22 nt, Artificial Sequence
  Synthetic
ggacgcgcggggcgacggccgc

SEQ ID NO: 29446 - RNA, 23 nt, Artificial Sequence
  Synthetic
cggacgcgcggggcgacggccgc

SEQ ID NO: 29447 - RNA, 24 nt, Artificial Sequence
  Synthetic
ccggacgcgcggggcgacggccgc

SEQ ID NO: 29448 - RNA, 18 nt, Artificial Sequence
  Synthetic
gcgccccccgccggccgc

SEQ ID NO: 29449 - RNA, 19 nt, Artificial Sequence
  Synthetic
cgcgccccccgccggccgc

SEQ ID NO: 29450 - RNA, 20 nt, Artificial Sequence
  Synthetic
gcgcgccccccgccggccgc

SEQ ID NO: 29451 - RNA, 21 nt, Artificial Sequence
  Synthetic
cgcgcgccccccgccggccgc

SEQ ID NO: 29452 - RNA, 22 nt, Artificial Sequence
  Synthetic
gcgcgcgccccccgccggccgc

SEQ ID NO: 29453 - RNA, 23 nt, Artificial Sequence
  Synthetic
ugcgcgcgccccccgccggccgc

SEQ ID NO: 29454 - RNA, 24 nt, Artificial Sequence
  Synthetic
cugcgcgcgccccccgccggccgc

SEQ ID NO: 29455 - RNA, 18 nt, Artificial Sequence
  Synthetic
ggggggcuccugggccgc

SEQ ID NO: 29456 - RNA, 19 nt, Artificial Sequence
  Synthetic
uggggggcuccugggccgc

SEQ ID NO: 29457 - RNA, 20 nt, Artificial Sequence
  Synthetic
auggggggcuccugggccgc

SEQ ID NO: 29458 - RNA, 21 nt, Artificial Sequence
  Synthetic
uauggggggcuccugggccgc

SEQ ID NO: 29459 - RNA, 22 nt, Artificial Sequence
  Synthetic
cuauggggggcuccugggccgc

SEQ ID NO: 29460 - RNA, 23 nt, Artificial Sequence
  Synthetic
acuauggggggcuccugggccgc

SEQ ID NO: 29461 - RNA, 24 nt, Artificial Sequence
  Synthetic
gacuauggggggcuccugggccgc

SEQ ID NO: 29462 - RNA, 18 nt, Artificial Sequence
  Synthetic
cggggguguuggugccgc

SEQ ID NO: 29463 - RNA, 19 nt, Artificial Sequence
  Synthetic
ccggggguguuggugccgc

SEQ ID NO: 29464 - RNA, 20 nt, Artificial Sequence
  Synthetic
accggggguguuggugccgc

SEQ ID NO: 29465 - RNA, 21 nt, Artificial Sequence
  Synthetic
caccggggguguuggugccgc

SEQ ID NO: 29466 - RNA, 22 nt, Artificial Sequence
  Synthetic
gcaccggggguguuggugccgc

SEQ ID NO: 29467 - RNA, 23 nt, Artificial Sequence
  Synthetic
ggcaccggggguguuggugccgc

SEQ ID NO: 29468 - RNA, 24 nt, Artificial Sequence
  Synthetic
cggcaccggggguguuggugccgc

SEQ ID NO: 29469 - RNA, 18 nt, Artificial Sequence
  Synthetic
cccgcggcgcagcagcgc

SEQ ID NO: 29470 - RNA, 19 nt, Artificial Sequence
  Synthetic
ccccgcggcgcagcagcgc

SEQ ID NO: 29471 - RNA, 20 nt, Artificial Sequence
  Synthetic
cccccgcggcgcagcagcgc

SEQ ID NO: 29472 - RNA, 21 nt, Artificial Sequence
  Synthetic
gcccccgcggcgcagcagcgc

SEQ ID NO: 29473 - RNA, 22 nt, Artificial Sequence
  Synthetic
ggcccccgcggcgcagcagcgc

SEQ ID NO: 29474 - RNA, 23 nt, Artificial Sequence
  Synthetic
cggcccccgcggcgcagcagcgc

SEQ ID NO: 29475 - RNA, 24 nt, Artificial Sequence
  Synthetic
ucggcccccgcggcgcagcagcgc

SEQ ID NO: 29476 - RNA, 18 nt, Artificial Sequence
  Synthetic
gcgaugggcagguagcgc

SEQ ID NO: 29477 - RNA, 19 nt, Artificial Sequence
  Synthetic
cgcgaugggcagguagcgc

SEQ ID NO: 29478 - RNA, 20 nt, Artificial Sequence
  Synthetic
ccgcgaugggcagguagcgc

SEQ ID NO: 29479 - RNA, 21 nt, Artificial Sequence
  Synthetic
cccgcgaugggcagguagcgc

SEQ ID NO: 29480 - RNA, 22 nt, Artificial Sequence
  Synthetic
ccccgcgaugggcagguagcgc

SEQ ID NO: 29481 - RNA, 23 nt, Artificial Sequence
  Synthetic
cccccgcgaugggcagguagcgc

SEQ ID NO: 29482 - RNA, 24 nt, Artificial Sequence
  Synthetic
acccccgcgaugggcagguagcgc

SEQ ID NO: 29483 - RNA, 18 nt, Artificial Sequence
  Synthetic
gcaccgccgcccccgcgc

SEQ ID NO: 29484 - RNA, 19 nt, Artificial Sequence
  Synthetic
cgcaccgccgcccccgcgc

SEQ ID NO: 29485 - RNA, 20 nt, Artificial Sequence
  Synthetic
ccgcaccgccgcccccgcgc

SEQ ID NO: 29486 - RNA, 21 nt, Artificial Sequence
  Synthetic
cccgcaccgccgcccccgcgc

SEQ ID NO: 29487 - RNA, 22 nt, Artificial Sequence
  Synthetic
ccccgcaccgccgcccccgcgc

SEQ ID NO: 29488 - RNA, 23 nt, Artificial Sequence
  Synthetic
cccccgcaccgccgcccccgcgc

SEQ ID NO: 29489 - RNA, 24 nt, Artificial Sequence
  Synthetic
gcccccgcaccgccgcccccgcgc

SEQ ID NO: 29490 - RNA, 18 nt, Artificial Sequence
  Synthetic
gcggggcgacggccgcgc

SEQ ID NO: 29491 - RNA, 19 nt, Artificial Sequence
  Synthetic
cgcggggcgacggccgcgc

SEQ ID NO: 29492 - RNA, 20 nt, Artificial Sequence
  Synthetic
gcgcggggcgacggccgcgc

SEQ ID NO: 29493 - RNA, 21 nt, Artificial Sequence
  Synthetic
cgcgcggggcgacggccgcgc

SEQ ID NO: 29494 - RNA, 22 nt, Artificial Sequence
  Synthetic
acgcgcggggcgacggccgcgc

SEQ ID NO: 29495 - RNA, 23 nt, Artificial Sequence
  Synthetic
gacgcgcggggcgacggccgcgc

SEQ ID NO: 29496 - RNA, 24 nt, Artificial Sequence
  Synthetic
ggacgcgcggggcgacggccgcgc

SEQ ID NO: 29497 - RNA, 18 nt, Artificial Sequence
  Synthetic
cuuguucacguaaggcgc

SEQ ID NO: 29498 - RNA, 19 nt, Artificial Sequence
  Synthetic
ucuuguucacguaaggcgc

SEQ ID NO: 29499 - RNA, 20 nt, Artificial Sequence
  Synthetic
gucuuguucacguaaggcgc

SEQ ID NO: 29500 - RNA, 21 nt, Artificial Sequence
  Synthetic
cgucuuguucacguaaggcgc

SEQ ID NO: 29501 - RNA, 22 nt, Artificial Sequence
  Synthetic
ccgucuuguucacguaaggcgc

SEQ ID NO: 29502 - RNA, 23 nt, Artificial Sequence
  Synthetic
accgucuuguucacguaaggcgc

SEQ ID NO: 29503 - RNA, 24 nt, Artificial Sequence
  Synthetic
gaccgucuuguucacguaaggcgc

SEQ ID NO: 29504 - RNA, 18 nt, Artificial Sequence
  Synthetic
ugcugcuccgcggggcgc

SEQ ID NO: 29505 - RNA, 19 nt, Artificial Sequence
  Synthetic
cugcugcuccgcggggcgc

SEQ ID NO: 29506 - RNA, 20 nt, Artificial Sequence
  Synthetic
gcugcugcuccgcggggcgc

SEQ ID NO: 29507 - RNA, 21 nt, Artificial Sequence
  Synthetic
ugcugcugcuccgcggggcgc

SEQ ID NO: 29508 - RNA, 22 nt, Artificial Sequence
  Synthetic
cugcugcugcuccgcggggcgc

SEQ ID NO: 29509 - RNA, 23 nt, Artificial Sequence
  Synthetic
gcugcugcugcuccgcggggcgc

SEQ ID NO: 29510 - RNA, 24 nt, Artificial Sequence
  Synthetic
cgcugcugcugcuccgcggggcgc

SEQ ID NO: 29511 - RNA, 18 nt, Artificial Sequence
  Synthetic
cgcgcggggcugucucgc

SEQ ID NO: 29512 - RNA, 19 nt, Artificial Sequence
  Synthetic
ccgcgcggggcugucucgc

SEQ ID NO: 29513 - RNA, 20 nt, Artificial Sequence
  Synthetic
gccgcgcggggcugucucgc

SEQ ID NO: 29514 - RNA, 21 nt, Artificial Sequence
  Synthetic
ggccgcgcggggcugucucgc

SEQ ID NO: 29515 - RNA, 22 nt, Artificial Sequence
  Synthetic
gggccgcgcggggcugucucgc

SEQ ID NO: 29516 - RNA, 23 nt, Artificial Sequence
  Synthetic
ugggccgcgcggggcugucucgc

SEQ ID NO: 29517 - RNA, 24 nt, Artificial Sequence
  Synthetic
cugggccgcgcggggcugucucgc

SEQ ID NO: 29518 - RNA, 18 nt, Artificial Sequence
  Synthetic
gggcggcgcggagacggc

SEQ ID NO: 29519 - RNA, 19 nt, Artificial Sequence
  Synthetic
ggggcggcgcggagacggc

SEQ ID NO: 29520 - RNA, 20 nt, Artificial Sequence
  Synthetic
cggggcggcgcggagacggc

SEQ ID NO: 29521 - RNA, 21 nt, Artificial Sequence
  Synthetic
gcggggcggcgcggagacggc

SEQ ID NO: 29522 - RNA, 22 nt, Artificial Sequence
  Synthetic
cgcggggcggcgcggagacggc

SEQ ID NO: 29523 - RNA, 23 nt, Artificial Sequence
  Synthetic
ccgcggggcggcgcggagacggc

SEQ ID NO: 29524 - RNA, 24 nt, Artificial Sequence
  Synthetic
cccgcggggcggcgcggagacggc

SEQ ID NO: 29525 - RNA, 18 nt, Artificial Sequence
  Synthetic
ggggcgucgccggccggc

SEQ ID NO: 29526 - RNA, 19 nt, Artificial Sequence
  Synthetic
gggggcgucgccggccggc

SEQ ID NO: 29527 - RNA, 20 nt, Artificial Sequence
  Synthetic
cgggggcgucgccggccggc

SEQ ID NO: 29528 - RNA, 21 nt, Artificial Sequence
  Synthetic
gcgggggcgucgccggccggc

SEQ ID NO: 29529 - RNA, 22 nt, Artificial Sequence
  Synthetic
cgcgggggcgucgccggccggc

SEQ ID NO: 29530 - RNA, 23 nt, Artificial Sequence
  Synthetic
ccgcgggggcgucgccggccggc

SEQ ID NO: 29531 - RNA, 24 nt, Artificial Sequence
  Synthetic
cccgcgggggcgucgccggccggc

SEQ ID NO: 29532 - RNA, 18 nt, Artificial Sequence
  Synthetic
gagacaaaggagagcggc

SEQ ID NO: 29533 - RNA, 19 nt, Artificial Sequence
  Synthetic
ggagacaaaggagagcggc

SEQ ID NO: 29534 - RNA, 20 nt, Artificial Sequence
  Synthetic
aggagacaaaggagagcggc

SEQ ID NO: 29535 - RNA, 21 nt, Artificial Sequence
  Synthetic
gaggagacaaaggagagcggc

SEQ ID NO: 29536 - RNA, 22 nt, Artificial Sequence
  Synthetic
ggaggagacaaaggagagcggc

SEQ ID NO: 29537 - RNA, 23 nt, Artificial Sequence
  Synthetic
aggaggagacaaaggagagcggc

SEQ ID NO: 29538 - RNA, 24 nt, Artificial Sequence
  Synthetic
gaggaggagacaaaggagagcggc

SEQ ID NO: 29539 - RNA, 18 nt, Artificial Sequence
  Synthetic
ggcggcggcgaccgcggc

SEQ ID NO: 29540 - RNA, 19 nt, Artificial Sequence
  Synthetic
aggcggcggcgaccgcggc

SEQ ID NO: 29541 - RNA, 20 nt, Artificial Sequence
  Synthetic
gaggcggcggcgaccgcggc

SEQ ID NO: 29542 - RNA, 21 nt, Artificial Sequence
  Synthetic
ggaggcggcggcgaccgcggc

SEQ ID NO: 29543 - RNA, 22 nt, Artificial Sequence
  Synthetic
aggaggcggcggcgaccgcggc

SEQ ID NO: 29544 - RNA, 23 nt, Artificial Sequence
  Synthetic
gaggaggcggcggcgaccgcggc

SEQ ID NO: 29545 - RNA, 24 nt, Artificial Sequence
  Synthetic
ggaggaggcggcggcgaccgcggc

SEQ ID NO: 29546 - RNA, 18 nt, Artificial Sequence
  Synthetic
cgccgcccccuccgcggc

SEQ ID NO: 29547 - RNA, 19 nt, Artificial Sequence
  Synthetic
ccgccgcccccuccgcggc

SEQ ID NO: 29548 - RNA, 20 nt, Artificial Sequence
  Synthetic
gccgccgcccccuccgcggc

SEQ ID NO: 29549 - RNA, 21 nt, Artificial Sequence
  Synthetic
ggccgccgcccccuccgcggc

SEQ ID NO: 29550 - RNA, 22 nt, Artificial Sequence
  Synthetic
gggccgccgcccccuccgcggc

SEQ ID NO: 29551 - RNA, 23 nt, Artificial Sequence
  Synthetic
cgggccgccgcccccuccgcggc

SEQ ID NO: 29552 - RNA, 24 nt, Artificial Sequence
  Synthetic
gcgggccgccgcccccuccgcggc

SEQ ID NO: 29553 - RNA, 18 nt, Artificial Sequence
  Synthetic
cacgggggcggcggcggc

SEQ ID NO: 29554 - RNA, 19 nt, Artificial Sequence
  Synthetic
ccacgggggcggcggcggc

SEQ ID NO: 29555 - RNA, 20 nt, Artificial Sequence
  Synthetic
accacgggggcggcggcggc

SEQ ID NO: 29556 - RNA, 21 nt, Artificial Sequence
  Synthetic
caccacgggggcggcggcggc

SEQ ID NO: 29557 - RNA, 22 nt, Artificial Sequence
  Synthetic
acaccacgggggcggcggcggc

SEQ ID NO: 29558 - RNA, 23 nt, Artificial Sequence
  Synthetic
gacaccacgggggcggcggcggc

SEQ ID NO: 29559 - RNA, 24 nt, Artificial Sequence
  Synthetic
agacaccacgggggcggcggcggc

SEQ ID NO: 29560 - RNA, 18 nt, Artificial Sequence
  Synthetic
accggcacggcgggcggc

SEQ ID NO: 29561 - RNA, 19 nt, Artificial Sequence
  Synthetic
caccggcacggcgggcggc

SEQ ID NO: 29562 - RNA, 20 nt, Artificial Sequence
  Synthetic
ccaccggcacggcgggcggc

SEQ ID NO: 29563 - RNA, 21 nt, Artificial Sequence
  Synthetic
uccaccggcacggcgggcggc

SEQ ID NO: 29564 - RNA, 22 nt, Artificial Sequence
  Synthetic
guccaccggcacggcgggcggc

SEQ ID NO: 29565 - RNA, 23 nt, Artificial Sequence
  Synthetic
cguccaccggcacggcgggcggc

SEQ ID NO: 29566 - RNA, 24 nt, Artificial Sequence
  Synthetic
gcguccaccggcacggcgggcggc

SEQ ID NO: 29567 - RNA, 18 nt, Artificial Sequence
  Synthetic
cggggcccgcggggcggc

SEQ ID NO: 29568 - RNA, 19 nt, Artificial Sequence
  Synthetic
ccggggcccgcggggcggc

SEQ ID NO: 29569 - RNA, 20 nt, Artificial Sequence
  Synthetic
cccggggcccgcggggcggc

SEQ ID NO: 29570 - RNA, 21 nt, Artificial Sequence
  Synthetic
gcccggggcccgcggggcggc

SEQ ID NO: 29571 - RNA, 22 nt, Artificial Sequence
  Synthetic
ggcccggggcccgcggggcggc

SEQ ID NO: 29572 - RNA, 23 nt, Artificial Sequence
  Synthetic
cggcccggggcccgcggggcggc

SEQ ID NO: 29573 - RNA, 24 nt, Artificial Sequence
  Synthetic
gcggcccggggcccgcggggcggc

SEQ ID NO: 29574 - RNA, 18 nt, Artificial Sequence
  Synthetic
gggggugggcgacagggc

SEQ ID NO: 29575 - RNA, 19 nt, Artificial Sequence
  Synthetic
ggggggugggcgacagggc

SEQ ID NO: 29576 - RNA, 20 nt, Artificial Sequence
  Synthetic
gggggggugggcgacagggc

SEQ ID NO: 29577 - RNA, 21 nt, Artificial Sequence
  Synthetic
cgggggggugggcgacagggc

SEQ ID NO: 29578 - RNA, 22 nt, Artificial Sequence
  Synthetic
acgggggggugggcgacagggc

SEQ ID NO: 29579 - RNA, 23 nt, Artificial Sequence
  Synthetic
cacgggggggugggcgacagggc

SEQ ID NO: 29580 - RNA, 24 nt, Artificial Sequence
  Synthetic
ccacgggggggugggcgacagggc

SEQ ID NO: 29581 - RNA, 18 nt, Artificial Sequence
  Synthetic
gggucgcgggccccgggc

SEQ ID NO: 29582 - RNA, 19 nt, Artificial Sequence
  Synthetic
cgggucgcgggccccgggc

SEQ ID NO: 29583 - RNA, 20 nt, Artificial Sequence
  Synthetic
ccgggucgcgggccccgggc

SEQ ID NO: 29584 - RNA, 21 nt, Artificial Sequence
  Synthetic
gccgggucgcgggccccgggc

SEQ ID NO: 29585 - RNA, 22 nt, Artificial Sequence
  Synthetic
cgccgggucgcgggccccgggc

SEQ ID NO: 29586 - RNA, 23 nt, Artificial Sequence
  Synthetic
gcgccgggucgcgggccccgggc

SEQ ID NO: 29587 - RNA, 24 nt, Artificial Sequence
  Synthetic
ggcgccgggucgcgggccccgggc

SEQ ID NO: 29588 - RNA, 18 nt, Artificial Sequence
  Synthetic
ggucgggucgcggcgggc

SEQ ID NO: 29589 - RNA, 19 nt, Artificial Sequence
  Synthetic
cggucgggucgcggcgggc

SEQ ID NO: 29590 - RNA, 20 nt, Artificial Sequence
  Synthetic
ccggucgggucgcggcgggc

SEQ ID NO: 29591 - RNA, 21 nt, Artificial Sequence
  Synthetic
gccggucgggucgcggcgggc

SEQ ID NO: 29592 - RNA, 22 nt, Artificial Sequence
  Synthetic
cgccggucgggucgcggcgggc

SEQ ID NO: 29593 - RNA, 23 nt, Artificial Sequence
  Synthetic
gcgccggucgggucgcggcgggc

SEQ ID NO: 29594 - RNA, 24 nt, Artificial Sequence
  Synthetic
ggcgccggucgggucgcggcgggc

SEQ ID NO: 29595 - RNA, 18 nt, Artificial Sequence
  Synthetic
gaccuccccccccggggc

SEQ ID NO: 29596 - RNA, 19 nt, Artificial Sequence
  Synthetic
agaccuccccccccggggc

SEQ ID NO: 29597 - RNA, 20 nt, Artificial Sequence
  Synthetic
cagaccuccccccccggggc

SEQ ID NO: 29598 - RNA, 21 nt, Artificial Sequence
  Synthetic
gcagaccuccccccccggggc

SEQ ID NO: 29599 - RNA, 22 nt, Artificial Sequence
  Synthetic
ggcagaccuccccccccggggc

SEQ ID NO: 29600 - RNA, 23 nt, Artificial Sequence
  Synthetic
uggcagaccuccccccccggggc

SEQ ID NO: 29601 - RNA, 24 nt, Artificial Sequence
  Synthetic
guggcagaccuccccccccggggc

SEQ ID NO: 29602 - RNA, 18 nt, Artificial Sequence
  Synthetic
ccccacccccuggggggc

SEQ ID NO: 29603 - RNA, 19 nt, Artificial Sequence
  Synthetic
cccccacccccuggggggc

SEQ ID NO: 29604 - RNA, 20 nt, Artificial Sequence
  Synthetic
gcccccacccccuggggggc

SEQ ID NO: 29605 - RNA, 21 nt, Artificial Sequence
  Synthetic
ggcccccacccccuggggggc

SEQ ID NO: 29606 - RNA, 22 nt, Artificial Sequence
  Synthetic
uggcccccacccccuggggggc

SEQ ID NO: 29607 - RNA, 23 nt, Artificial Sequence
  Synthetic
uuggcccccacccccuggggggc

SEQ ID NO: 29608 - RNA, 24 nt, Artificial Sequence
  Synthetic
cuuggcccccacccccuggggggc

SEQ ID NO: 29609 - RNA, 18 nt, Artificial Sequence
  Synthetic
acgcaguugcgcgcgugc

SEQ ID NO: 29610 - RNA, 19 nt, Artificial Sequence
  Synthetic
cacgcaguugcgcgcgugc

SEQ ID NO: 29611 - RNA, 20 nt, Artificial Sequence
  Synthetic
ucacgcaguugcgcgcgugc

SEQ ID NO: 29612 - RNA, 21 nt, Artificial Sequence
  Synthetic
cucacgcaguugcgcgcgugc

SEQ ID NO: 29613 - RNA, 22 nt, Artificial Sequence
  Synthetic
ccucacgcaguugcgcgcgugc

SEQ ID NO: 29614 - RNA, 23 nt, Artificial Sequence
  Synthetic
gccucacgcaguugcgcgcgugc

SEQ ID NO: 29615 - RNA, 24 nt, Artificial Sequence
  Synthetic
ggccucacgcaguugcgcgcgugc

SEQ ID NO: 29616 - RNA, 18 nt, Artificial Sequence
  Synthetic
uugcccaccggggucauc

SEQ ID NO: 29617 - RNA, 19 nt, Artificial Sequence
  Synthetic
guugcccaccggggucauc

SEQ ID NO: 29618 - RNA, 20 nt, Artificial Sequence
  Synthetic
uguugcccaccggggucauc

SEQ ID NO: 29619 - RNA, 21 nt, Artificial Sequence
  Synthetic
auguugcccaccggggucauc

SEQ ID NO: 29620 - RNA, 22 nt, Artificial Sequence
  Synthetic
cauguugcccaccggggucauc

SEQ ID NO: 29621 - RNA, 23 nt, Artificial Sequence
  Synthetic
gcauguugcccaccggggucauc

SEQ ID NO: 29622 - RNA, 24 nt, Artificial Sequence
  Synthetic
agcauguugcccaccggggucauc

SEQ ID NO: 29623 - RNA, 18 nt, Artificial Sequence
  Synthetic
gaugacuauggggggcuc

SEQ ID NO: 29624 - RNA, 19 nt, Artificial Sequence
  Synthetic
ugaugacuauggggggcuc

SEQ ID NO: 29625 - RNA, 20 nt, Artificial Sequence
  Synthetic
cugaugacuauggggggcuc

SEQ ID NO: 29626 - RNA, 21 nt, Artificial Sequence
  Synthetic
gcugaugacuauggggggcuc

SEQ ID NO: 29627 - RNA, 22 nt, Artificial Sequence
  Synthetic
cgcugaugacuauggggggcuc

SEQ ID NO: 29628 - RNA, 23 nt, Artificial Sequence
  Synthetic
ucgcugaugacuauggggggcuc

SEQ ID NO: 29629 - RNA, 24 nt, Artificial Sequence
  Synthetic
gucgcugaugacuauggggggcuc

SEQ ID NO: 29630 - RNA, 18 nt, Artificial Sequence
  Synthetic
cgcgggcgcgcccugcuc

SEQ ID NO: 29631 - RNA, 19 nt, Artificial Sequence
  Synthetic
gcgcgggcgcgcccugcuc

SEQ ID NO: 29632 - RNA, 20 nt, Artificial Sequence
  Synthetic
ggcgcgggcgcgcccugcuc

SEQ ID NO: 29633 - RNA, 21 nt, Artificial Sequence
  Synthetic
cggcgcgggcgcgcccugcuc

SEQ ID NO: 29634 - RNA, 22 nt, Artificial Sequence
  Synthetic
ccggcgcgggcgcgcccugcuc

SEQ ID NO: 29635 - RNA, 23 nt, Artificial Sequence
  Synthetic
gccggcgcgggcgcgcccugcuc

SEQ ID NO: 29636 - RNA, 24 nt, Artificial Sequence
  Synthetic
ggccggcgcgggcgcgcccugcuc

SEQ ID NO: 29637 - RNA, 18 nt, Artificial Sequence
  Synthetic
gcaguugcgcgcgugcuc

SEQ ID NO: 29638 - RNA, 19 nt, Artificial Sequence
  Synthetic
cgcaguugcgcgcgugcuc

SEQ ID NO: 29639 - RNA, 20 nt, Artificial Sequence
  Synthetic
acgcaguugcgcgcgugcuc

SEQ ID NO: 29640 - RNA, 21 nt, Artificial Sequence
  Synthetic
cacgcaguugcgcgcgugcuc

SEQ ID NO: 29641 - RNA, 22 nt, Artificial Sequence
  Synthetic
ucacgcaguugcgcgcgugcuc

SEQ ID NO: 29642 - RNA, 23 nt, Artificial Sequence
  Synthetic
cucacgcaguugcgcgcgugcuc

SEQ ID NO: 29643 - RNA, 24 nt, Artificial Sequence
  Synthetic
ccucacgcaguugcgcgcgugcuc

SEQ ID NO: 29644 - RNA, 18 nt, Artificial Sequence
  Synthetic
gccgcgcggggcugucuc

SEQ ID NO: 29645 - RNA, 19 nt, Artificial Sequence
  Synthetic
ggccgcgcggggcugucuc

SEQ ID NO: 29646 - RNA, 20 nt, Artificial Sequence
  Synthetic
gggccgcgcggggcugucuc

SEQ ID NO: 29647 - RNA, 21 nt, Artificial Sequence
  Synthetic
ugggccgcgcggggcugucuc

SEQ ID NO: 29648 - RNA, 22 nt, Artificial Sequence
  Synthetic
cugggccgcgcggggcugucuc

SEQ ID NO: 29649 - RNA, 23 nt, Artificial Sequence
  Synthetic
ccugggccgcgcggggcugucuc

SEQ ID NO: 29650 - RNA, 24 nt, Artificial Sequence
  Synthetic
uccugggccgcgcggggcugucuc

SEQ ID NO: 29651 - RNA, 18 nt, Artificial Sequence
  Synthetic
gucgcccgaguccgaguc

SEQ ID NO: 29652 - RNA, 19 nt, Artificial Sequence
  Synthetic
ggucgcccgaguccgaguc

SEQ ID NO: 29653 - RNA, 20 nt, Artificial Sequence
  Synthetic
cggucgcccgaguccgaguc

SEQ ID NO: 29654 - RNA, 21 nt, Artificial Sequence
  Synthetic
gcggucgcccgaguccgaguc

SEQ ID NO: 29655 - RNA, 22 nt, Artificial Sequence
  Synthetic
cgcggucgcccgaguccgaguc

SEQ ID NO: 29656 - RNA, 23 nt, Artificial Sequence
  Synthetic
ccgcggucgcccgaguccgaguc

SEQ ID NO: 29657 - RNA, 24 nt, Artificial Sequence
  Synthetic
gccgcggucgcccgaguccgaguc

SEQ ID NO: 29658 - RNA, 18 nt, Artificial Sequence
  Synthetic
ggggggcgucggguaguc

SEQ ID NO: 29659 - RNA, 19 nt, Artificial Sequence
  Synthetic
cggggggcgucggguaguc

SEQ ID NO: 29660 - RNA, 20 nt, Artificial Sequence
  Synthetic
gcggggggcgucggguaguc

SEQ ID NO: 29661 - RNA, 21 nt, Artificial Sequence
  Synthetic
cgcggggggcgucggguaguc

SEQ ID NO: 29662 - RNA, 22 nt, Artificial Sequence
  Synthetic
acgcggggggcgucggguaguc

SEQ ID NO: 29663 - RNA, 23 nt, Artificial Sequence
  Synthetic
gacgcggggggcgucggguaguc

SEQ ID NO: 29664 - RNA, 24 nt, Artificial Sequence
  Synthetic
cgacgcggggggcgucggguaguc

SEQ ID NO: 29665 - RNA, 18 nt, Artificial Sequence
  Synthetic
gaggccgggcgccggguc

SEQ ID NO: 29666 - RNA, 19 nt, Artificial Sequence
  Synthetic
ugaggccgggcgccggguc

SEQ ID NO: 29667 - RNA, 20 nt, Artificial Sequence
  Synthetic
gugaggccgggcgccggguc

SEQ ID NO: 29668 - RNA, 21 nt, Artificial Sequence
  Synthetic
cgugaggccgggcgccggguc

SEQ ID NO: 29669 - RNA, 22 nt, Artificial Sequence
  Synthetic
gcgugaggccgggcgccggguc

SEQ ID NO: 29670 - RNA, 23 nt, Artificial Sequence
  Synthetic
cgcgugaggccgggcgccggguc

SEQ ID NO: 29671 - RNA, 24 nt, Artificial Sequence
  Synthetic
gcgcgugaggccgggcgccggguc

SEQ ID NO: 29672 - RNA, 18 nt, Artificial Sequence
  Synthetic
ucggccuccacgcggguc

SEQ ID NO: 29673 - RNA, 19 nt, Artificial Sequence
  Synthetic
cucggccuccacgcggguc

SEQ ID NO: 29674 - RNA, 20 nt, Artificial Sequence
  Synthetic
ccucggccuccacgcggguc

SEQ ID NO: 29675 - RNA, 21 nt, Artificial Sequence
  Synthetic
gccucggccuccacgcggguc

SEQ ID NO: 29676 - RNA, 22 nt, Artificial Sequence
  Synthetic
cgccucggccuccacgcggguc

SEQ ID NO: 29677 - RNA, 23 nt, Artificial Sequence
  Synthetic
ccgccucggccuccacgcggguc

SEQ ID NO: 29678 - RNA, 24 nt, Artificial Sequence
  Synthetic
gccgccucggccuccacgcggguc

SEQ ID NO: 29679 - RNA, 18 nt, Artificial Sequence
  Synthetic
guggcccgucuccauguc

SEQ ID NO: 29680 - RNA, 19 nt, Artificial Sequence
  Synthetic
uguggcccgucuccauguc

SEQ ID NO: 29681 - RNA, 20 nt, Artificial Sequence
  Synthetic
auguggcccgucuccauguc

SEQ ID NO: 29682 - RNA, 21 nt, Artificial Sequence
  Synthetic
uauguggcccgucuccauguc

SEQ ID NO: 29683 - RNA, 22 nt, Artificial Sequence
  Synthetic
cuauguggcccgucuccauguc

SEQ ID NO: 29684 - RNA, 23 nt, Artificial Sequence
  Synthetic
ccuauguggcccgucuccauguc

SEQ ID NO: 29685 - RNA, 24 nt, Artificial Sequence
  Synthetic
cccuauguggcccgucuccauguc

SEQ ID NO: 29686 - RNA, 18 nt, Artificial Sequence
  Synthetic
uccgacccgcgccucuuc

SEQ ID NO: 29687 - RNA, 19 nt, Artificial Sequence
  Synthetic
guccgacccgcgccucuuc

SEQ ID NO: 29688 - RNA, 20 nt, Artificial Sequence
  Synthetic
aguccgacccgcgccucuuc

SEQ ID NO: 29689 - RNA, 21 nt, Artificial Sequence
  Synthetic
gaguccgacccgcgccucuuc

SEQ ID NO: 29690 - RNA, 22 nt, Artificial Sequence
  Synthetic
cgaguccgacccgcgccucuuc

SEQ ID NO: 29691 - RNA, 23 nt, Artificial Sequence
  Synthetic
ccgaguccgacccgcgccucuuc

SEQ ID NO: 29692 - RNA, 24 nt, Artificial Sequence
  Synthetic
cccgaguccgacccgcgccucuuc

SEQ ID NO: 29693 - RNA, 18 nt, Artificial Sequence
  Synthetic
cgcgccggggcgcucuuc

SEQ ID NO: 29694 - RNA, 19 nt, Artificial Sequence
  Synthetic
ccgcgccggggcgcucuuc

SEQ ID NO: 29695 - RNA, 20 nt, Artificial Sequence
  Synthetic
cccgcgccggggcgcucuuc

SEQ ID NO: 29696 - RNA, 21 nt, Artificial Sequence
  Synthetic
ccccgcgccggggcgcucuuc

SEQ ID NO: 29697 - RNA, 22 nt, Artificial Sequence
  Synthetic
cccccgcgccggggcgcucuuc

SEQ ID NO: 29698 - RNA, 23 nt, Artificial Sequence
  Synthetic
gcccccgcgccggggcgcucuuc

SEQ ID NO: 29699 - RNA, 24 nt, Artificial Sequence
  Synthetic
cgcccccgcgccggggcgcucuuc

SEQ ID NO: 29700 - RNA, 18 nt, Artificial Sequence
  Synthetic
gaggaggaggagacaaag

SEQ ID NO: 29701 - RNA, 19 nt, Artificial Sequence
  Synthetic
ggaggaggaggagacaaag

SEQ ID NO: 29702 - RNA, 20 nt, Artificial Sequence
  Synthetic
cggaggaggaggagacaaag

SEQ ID NO: 29703 - RNA, 21 nt, Artificial Sequence
  Synthetic
gcggaggaggaggagacaaag

SEQ ID NO: 29704 - RNA, 22 nt, Artificial Sequence
  Synthetic
ugcggaggaggaggagacaaag

SEQ ID NO: 29705 - RNA, 23 nt, Artificial Sequence
  Synthetic
gugcggaggaggaggagacaaag

SEQ ID NO: 29706 - RNA, 24 nt, Artificial Sequence
  Synthetic
ugugcggaggaggaggagacaaag

SEQ ID NO: 29707 - RNA, 18 nt, Artificial Sequence
  Synthetic
caccagccccgcccgcag

SEQ ID NO: 29708 - RNA, 19 nt, Artificial Sequence
  Synthetic
ccaccagccccgcccgcag

SEQ ID NO: 29709 - RNA, 20 nt, Artificial Sequence
  Synthetic
cccaccagccccgcccgcag

SEQ ID NO: 29710 - RNA, 21 nt, Artificial Sequence
  Synthetic
ucccaccagccccgcccgcag

SEQ ID NO: 29711 - RNA, 22 nt, Artificial Sequence
  Synthetic
cucccaccagccccgcccgcag

SEQ ID NO: 29712 - RNA, 23 nt, Artificial Sequence
  Synthetic
gcucccaccagccccgcccgcag

SEQ ID NO: 29713 - RNA, 24 nt, Artificial Sequence
  Synthetic
cgcucccaccagccccgcccgcag

SEQ ID NO: 29714 - RNA, 18 nt, Artificial Sequence
  Synthetic
gccccccgccggccgcag

SEQ ID NO: 29715 - RNA, 19 nt, Artificial Sequence
  Synthetic
cgccccccgccggccgcag

SEQ ID NO: 29716 - RNA, 20 nt, Artificial Sequence
  Synthetic
gcgccccccgccggccgcag

SEQ ID NO: 29717 - RNA, 21 nt, Artificial Sequence
  Synthetic
cgcgccccccgccggccgcag

SEQ ID NO: 29718 - RNA, 22 nt, Artificial Sequence
  Synthetic
gcgcgccccccgccggccgcag

SEQ ID NO: 29719 - RNA, 23 nt, Artificial Sequence
  Synthetic
cgcgcgccccccgccggccgcag

SEQ ID NO: 29720 - RNA, 24 nt, Artificial Sequence
  Synthetic
gcgcgcgccccccgccggccgcag

SEQ ID NO: 29721 - RNA, 18 nt, Artificial Sequence
  Synthetic
ccgcccgcagaggaagag

SEQ ID NO: 29722 - RNA, 19 nt, Artificial Sequence
  Synthetic
cccgcccgcagaggaagag

SEQ ID NO: 29723 - RNA, 20 nt, Artificial Sequence
  Synthetic
ccccgcccgcagaggaagag

SEQ ID NO: 29724 - RNA, 21 nt, Artificial Sequence
  Synthetic
gccccgcccgcagaggaagag

SEQ ID NO: 29725 - RNA, 22 nt, Artificial Sequence
  Synthetic
agccccgcccgcagaggaagag

SEQ ID NO: 29726 - RNA, 23 nt, Artificial Sequence
  Synthetic
cagccccgcccgcagaggaagag

SEQ ID NO: 29727 - RNA, 24 nt, Artificial Sequence
  Synthetic
ccagccccgcccgcagaggaagag

SEQ ID NO: 29728 - RNA, 18 nt, Artificial Sequence
  Synthetic
ggggcggcggaggaagag

SEQ ID NO: 29729 - RNA, 19 nt, Artificial Sequence
  Synthetic
cggggcggcggaggaagag

SEQ ID NO: 29730 - RNA, 20 nt, Artificial Sequence
  Synthetic
gcggggcggcggaggaagag

SEQ ID NO: 29731 - RNA, 21 nt, Artificial Sequence
  Synthetic
cgcggggcggcggaggaagag

SEQ ID NO: 29732 - RNA, 22 nt, Artificial Sequence
  Synthetic
gcgcggggcggcggaggaagag

SEQ ID NO: 29733 - RNA, 23 nt, Artificial Sequence
  Synthetic
agcgcggggcggcggaggaagag

SEQ ID NO: 29734 - RNA, 24 nt, Artificial Sequence
  Synthetic
gagcgcggggcggcggaggaagag

SEQ ID NO: 29735 - RNA, 18 nt, Artificial Sequence
  Synthetic
gaggcggaggaggaggag

SEQ ID NO: 29736 - RNA, 19 nt, Artificial Sequence
  Synthetic
agaggcggaggaggaggag

SEQ ID NO: 29737 - RNA, 20 nt, Artificial Sequence
  Synthetic
aagaggcggaggaggaggag

SEQ ID NO: 29738 - RNA, 21 nt, Artificial Sequence
  Synthetic
gaagaggcggaggaggaggag

SEQ ID NO: 29739 - RNA, 22 nt, Artificial Sequence
  Synthetic
ggaagaggcggaggaggaggag

SEQ ID NO: 29740 - RNA, 23 nt, Artificial Sequence
  Synthetic
aggaagaggcggaggaggaggag

SEQ ID NO: 29741 - RNA, 24 nt, Artificial Sequence
  Synthetic
gaggaagaggcggaggaggaggag

SEQ ID NO: 29742 - RNA, 19 nt, Artificial Sequence
  Synthetic
ggaggcggaggaggaggag

SEQ ID NO: 29743 - RNA, 20 nt, Artificial Sequence
  Synthetic
aggaggcggaggaggaggag

SEQ ID NO: 29744 - RNA, 21 nt, Artificial Sequence
  Synthetic
gaggaggcggaggaggaggag

SEQ ID NO: 29745 - RNA, 22 nt, Artificial Sequence
  Synthetic
ggaggaggcggaggaggaggag

SEQ ID NO: 29746 - RNA, 23 nt, Artificial Sequence
  Synthetic
aggaggaggcggaggaggaggag

SEQ ID NO: 29747 - RNA, 24 nt, Artificial Sequence
  Synthetic
gaggaggaggcggaggaggaggag

SEQ ID NO: 29748 - RNA, 18 nt, Artificial Sequence
  Synthetic
gaggaagaggcggaggag

SEQ ID NO: 29749 - RNA, 19 nt, Artificial Sequence
  Synthetic
agaggaagaggcggaggag

SEQ ID NO: 29750 - RNA, 20 nt, Artificial Sequence
  Synthetic
cagaggaagaggcggaggag

SEQ ID NO: 29751 - RNA, 21 nt, Artificial Sequence
  Synthetic
gcagaggaagaggcggaggag

SEQ ID NO: 29752 - RNA, 22 nt, Artificial Sequence
  Synthetic
cgcagaggaagaggcggaggag

SEQ ID NO: 29753 - RNA, 23 nt, Artificial Sequence
  Synthetic
ccgcagaggaagaggcggaggag

SEQ ID NO: 29754 - RNA, 24 nt, Artificial Sequence
  Synthetic
cccgcagaggaagaggcggaggag

SEQ ID NO: 29755 - RNA, 18 nt, Artificial Sequence
  Synthetic
gaggaggaggcggaggag

SEQ ID NO: 29756 - RNA, 19 nt, Artificial Sequence
  Synthetic
ggaggaggaggcggaggag

SEQ ID NO: 29757 - RNA, 20 nt, Artificial Sequence
  Synthetic
aggaggaggaggcggaggag

SEQ ID NO: 29758 - RNA, 21 nt, Artificial Sequence
  Synthetic
gaggaggaggaggcggaggag

SEQ ID NO: 29759 - RNA, 22 nt, Artificial Sequence
  Synthetic
ggaggaggaggaggcggaggag

SEQ ID NO: 29760 - RNA, 23 nt, Artificial Sequence
  Synthetic
cggaggaggaggaggcggaggag

SEQ ID NO: 29761 - RNA, 24 nt, Artificial Sequence
  Synthetic
gcggaggaggaggaggcggaggag

SEQ ID NO: 29762 - RNA, 18 nt, Artificial Sequence
  Synthetic
gacaccugugcggaggag

SEQ ID NO: 29763 - RNA, 19 nt, Artificial Sequence
  Synthetic
ggacaccugugcggaggag

SEQ ID NO: 29764 - RNA, 20 nt, Artificial Sequence
  Synthetic
aggacaccugugcggaggag

SEQ ID NO: 29765 - RNA, 21 nt, Artificial Sequence
  Synthetic
gaggacaccugugcggaggag

SEQ ID NO: 29766 - RNA, 22 nt, Artificial Sequence
  Synthetic
cgaggacaccugugcggaggag

SEQ ID NO: 29767 - RNA, 23 nt, Artificial Sequence
  Synthetic
ccgaggacaccugugcggaggag

SEQ ID NO: 29768 - RNA, 24 nt, Artificial Sequence
  Synthetic
cccgaggacaccugugcggaggag

SEQ ID NO: 29769 - RNA, 18 nt, Artificial Sequence
  Synthetic
gcagaggaagaggcggag

SEQ ID NO: 29770 - RNA, 19 nt, Artificial Sequence
  Synthetic
cgcagaggaagaggcggag

SEQ ID NO: 29771 - RNA, 20 nt, Artificial Sequence
  Synthetic
ccgcagaggaagaggcggag

SEQ ID NO: 29772 - RNA, 21 nt, Artificial Sequence
  Synthetic
cccgcagaggaagaggcggag

SEQ ID NO: 29773 - RNA, 22 nt, Artificial Sequence
  Synthetic
gcccgcagaggaagaggcggag

SEQ ID NO: 29774 - RNA, 23 nt, Artificial Sequence
  Synthetic
cgcccgcagaggaagaggcggag

SEQ ID NO: 29775 - RNA, 24 nt, Artificial Sequence
  Synthetic
ccgcccgcagaggaagaggcggag

SEQ ID NO: 29776 - RNA, 18 nt, Artificial Sequence
  Synthetic
gaggaggaggaggcggag

SEQ ID NO: 29777 - RNA, 19 nt, Artificial Sequence
  Synthetic
ggaggaggaggaggcggag

SEQ ID NO: 29778 - RNA, 20 nt, Artificial Sequence
  Synthetic
cggaggaggaggaggcggag

SEQ ID NO: 29779 - RNA, 21 nt, Artificial Sequence
  Synthetic
gcggaggaggaggaggcggag

SEQ ID NO: 29780 - RNA, 22 nt, Artificial Sequence
  Synthetic
ggcggaggaggaggaggcggag

SEQ ID NO: 29781 - RNA, 23 nt, Artificial Sequence
  Synthetic
aggcggaggaggaggaggcggag

SEQ ID NO: 29782 - RNA, 24 nt, Artificial Sequence
  Synthetic
gaggcggaggaggaggaggcggag

SEQ ID NO: 29783 - RNA, 18 nt, Artificial Sequence
  Synthetic
gaggacaccugugcggag

SEQ ID NO: 29784 - RNA, 19 nt, Artificial Sequence
  Synthetic
cgaggacaccugugcggag

SEQ ID NO: 29785 - RNA, 20 nt, Artificial Sequence
  Synthetic
ccgaggacaccugugcggag

SEQ ID NO: 29786 - RNA, 21 nt, Artificial Sequence
  Synthetic
cccgaggacaccugugcggag

SEQ ID NO: 29787 - RNA, 22 nt, Artificial Sequence
  Synthetic
gcccgaggacaccugugcggag

SEQ ID NO: 29788 - RNA, 23 nt, Artificial Sequence
  Synthetic
ggcccgaggacaccugugcggag

SEQ ID NO: 29789 - RNA, 24 nt, Artificial Sequence
  Synthetic
gggcccgaggacaccugugcggag

SEQ ID NO: 29790 - RNA, 18 nt, Artificial Sequence
  Synthetic
gcggggggcgucggguag

SEQ ID NO: 29791 - RNA, 19 nt, Artificial Sequence
  Synthetic
cgcggggggcgucggguag

SEQ ID NO: 29792 - RNA, 20 nt, Artificial Sequence
  Synthetic
acgcggggggcgucggguag

SEQ ID NO: 29793 - RNA, 21 nt, Artificial Sequence
  Synthetic
gacgcggggggcgucggguag

SEQ ID NO: 29794 - RNA, 22 nt, Artificial Sequence
  Synthetic
cgacgcggggggcgucggguag

SEQ ID NO: 29795 - RNA, 23 nt, Artificial Sequence
  Synthetic
ccgacgcggggggcgucggguag

SEQ ID NO: 29796 - RNA, 24 nt, Artificial Sequence
  Synthetic
uccgacgcggggggcgucggguag

SEQ ID NO: 29797 - RNA, 18 nt, Artificial Sequence
  Synthetic
cguccgugccgggccacg

SEQ ID NO: 29798 - RNA, 19 nt, Artificial Sequence
  Synthetic
ucguccgugccgggccacg

SEQ ID NO: 29799 - RNA, 20 nt, Artificial Sequence
  Synthetic
gucguccgugccgggccacg

SEQ ID NO: 29800 - RNA, 21 nt, Artificial Sequence
  Synthetic
cgucguccgugccgggccacg

SEQ ID NO: 29801 - RNA, 22 nt, Artificial Sequence
  Synthetic
ucgucguccgugccgggccacg

SEQ ID NO: 29802 - RNA, 23 nt, Artificial Sequence
  Synthetic
cucgucguccgugccgggccacg

SEQ ID NO: 29803 - RNA, 24 nt, Artificial Sequence
  Synthetic
ccucgucguccgugccgggccacg

SEQ ID NO: 29804 - RNA, 18 nt, Artificial Sequence
  Synthetic
gggugcggcggcuccacg

SEQ ID NO: 29805 - RNA, 19 nt, Artificial Sequence
  Synthetic
agggugcggcggcuccacg

SEQ ID NO: 29806 - RNA, 20 nt, Artificial Sequence
  Synthetic
cagggugcggcggcuccacg

SEQ ID NO: 29807 - RNA, 21 nt, Artificial Sequence
  Synthetic
gcagggugcggcggcuccacg

SEQ ID NO: 29808 - RNA, 22 nt, Artificial Sequence
  Synthetic
agcagggugcggcggcuccacg

SEQ ID NO: 29809 - RNA, 23 nt, Artificial Sequence
  Synthetic
gagcagggugcggcggcuccacg

SEQ ID NO: 29810 - RNA, 24 nt, Artificial Sequence
  Synthetic
ggagcagggugcggcggcuccacg

SEQ ID NO: 29811 - RNA, 18 nt, Artificial Sequence
  Synthetic
ugcgcguccaccggcacg

SEQ ID NO: 29812 - RNA, 19 nt, Artificial Sequence
  Synthetic
gugcgcguccaccggcacg

SEQ ID NO: 29813 - RNA, 20 nt, Artificial Sequence
  Synthetic
ggugcgcguccaccggcacg

SEQ ID NO: 29814 - RNA, 21 nt, Artificial Sequence
  Synthetic
cggugcgcguccaccggcacg

SEQ ID NO: 29815 - RNA, 22 nt, Artificial Sequence
  Synthetic
gcggugcgcguccaccggcacg

SEQ ID NO: 29816 - RNA, 23 nt, Artificial Sequence
  Synthetic
cgcggugcgcguccaccggcacg

SEQ ID NO: 29817 - RNA, 24 nt, Artificial Sequence
  Synthetic
gcgcggugcgcguccaccggcacg

SEQ ID NO: 29818 - RNA, 18 nt, Artificial Sequence
  Synthetic
cggggcggcgcggagacg

SEQ ID NO: 29819 - RNA, 19 nt, Artificial Sequence
  Synthetic
gcggggcggcgcggagacg

SEQ ID NO: 29820 - RNA, 20 nt, Artificial Sequence
  Synthetic
cgcggggcggcgcggagacg

SEQ ID NO: 29821 - RNA, 21 nt, Artificial Sequence
  Synthetic
ccgcggggcggcgcggagacg

SEQ ID NO: 29822 - RNA, 22 nt, Artificial Sequence
  Synthetic
cccgcggggcggcgcggagacg

SEQ ID NO: 29823 - RNA, 23 nt, Artificial Sequence
  Synthetic
gcccgcggggcggcgcggagacg

SEQ ID NO: 29824 - RNA, 24 nt, Artificial Sequence
  Synthetic
ggcccgcggggcggcgcggagacg

SEQ ID NO: 29825 - RNA, 18 nt, Artificial Sequence
  Synthetic
ggcuguuccacuccgacg

SEQ ID NO: 29826 - RNA, 19 nt, Artificial Sequence
  Synthetic
aggcuguuccacuccgacg

SEQ ID NO: 29827 - RNA, 20 nt, Artificial Sequence
  Synthetic
gaggcuguuccacuccgacg

SEQ ID NO: 29828 - RNA, 21 nt, Artificial Sequence
  Synthetic
agaggcuguuccacuccgacg

SEQ ID NO: 29829 - RNA, 22 nt, Artificial Sequence
  Synthetic
cagaggcuguuccacuccgacg

SEQ ID NO: 29830 - RNA, 23 nt, Artificial Sequence
  Synthetic
ccagaggcuguuccacuccgacg

SEQ ID NO: 29831 - RNA, 24 nt, Artificial Sequence
  Synthetic
uccagaggcuguuccacuccgacg

SEQ ID NO: 29832 - RNA, 18 nt, Artificial Sequence
  Synthetic
gcgcggcgcccgcggacg

SEQ ID NO: 29833 - RNA, 19 nt, Artificial Sequence
  Synthetic
ggcgcggcgcccgcggacg

SEQ ID NO: 29834 - RNA, 20 nt, Artificial Sequence
  Synthetic
gggcgcggcgcccgcggacg

SEQ ID NO: 29835 - RNA, 21 nt, Artificial Sequence
  Synthetic
ggggcgcggcgcccgcggacg

SEQ ID NO: 29836 - RNA, 22 nt, Artificial Sequence
  Synthetic
gggggcgcggcgcccgcggacg

SEQ ID NO: 29837 - RNA, 23 nt, Artificial Sequence
  Synthetic
cgggggcgcggcgcccgcggacg

SEQ ID NO: 29838 - RNA, 24 nt, Artificial Sequence
  Synthetic
acgggggcgcggcgcccgcggacg

SEQ ID NO: 29839 - RNA, 18 nt, Artificial Sequence
  Synthetic
cgaccgcggccugggacg

SEQ ID NO: 29840 - RNA, 19 nt, Artificial Sequence
  Synthetic
gcgaccgcggccugggacg

SEQ ID NO: 29841 - RNA, 20 nt, Artificial Sequence
  Synthetic
ggcgaccgcggccugggacg

SEQ ID NO: 29842 - RNA, 21 nt, Artificial Sequence
  Synthetic
cggcgaccgcggccugggacg

SEQ ID NO: 29843 - RNA, 22 nt, Artificial Sequence
  Synthetic
gcggcgaccgcggccugggacg

SEQ ID NO: 29844 - RNA, 23 nt, Artificial Sequence
  Synthetic
ggcggcgaccgcggccugggacg

SEQ ID NO: 29845 - RNA, 24 nt, Artificial Sequence
  Synthetic
cggcggcgaccgcggccugggacg

SEQ ID NO: 29846 - RNA, 18 nt, Artificial Sequence
  Synthetic
ucccaccagccccgcccg

SEQ ID NO: 29847 - RNA, 19 nt, Artificial Sequence
  Synthetic
cucccaccagccccgcccg

SEQ ID NO: 29848 - RNA, 20 nt, Artificial Sequence
  Synthetic
gcucccaccagccccgcccg

SEQ ID NO: 29849 - RNA, 21 nt, Artificial Sequence
  Synthetic
cgcucccaccagccccgcccg

SEQ ID NO: 29850 - RNA, 22 nt, Artificial Sequence
  Synthetic
acgcucccaccagccccgcccg

SEQ ID NO: 29851 - RNA, 23 nt, Artificial Sequence
  Synthetic
gacgcucccaccagccccgcccg

SEQ ID NO: 29852 - RNA, 24 nt, Artificial Sequence
  Synthetic
cgacgcucccaccagccccgcccg

SEQ ID NO: 29853 - RNA, 18 nt, Artificial Sequence
  Synthetic
agagcggcccggggcccg

SEQ ID NO: 29854 - RNA, 19 nt, Artificial Sequence
  Synthetic
gagagcggcccggggcccg

SEQ ID NO: 29855 - RNA, 20 nt, Artificial Sequence
  Synthetic
ggagagcggcccggggcccg

SEQ ID NO: 29856 - RNA, 21 nt, Artificial Sequence
  Synthetic
aggagagcggcccggggcccg

SEQ ID NO: 29857 - RNA, 22 nt, Artificial Sequence
  Synthetic
aaggagagcggcccggggcccg

SEQ ID NO: 29858 - RNA, 23 nt, Artificial Sequence
  Synthetic
aaaggagagcggcccggggcccg

SEQ ID NO: 29859 - RNA, 24 nt, Artificial Sequence
  Synthetic
caaaggagagcggcccggggcccg

SEQ ID NO: 29860 - RNA, 18 nt, Artificial Sequence
  Synthetic
gggacgacggagacgccg

SEQ ID NO: 29861 - RNA, 19 nt, Artificial Sequence
  Synthetic
ugggacgacggagacgccg

SEQ ID NO: 29862 - RNA, 20 nt, Artificial Sequence
  Synthetic
cugggacgacggagacgccg

SEQ ID NO: 29863 - RNA, 21 nt, Artificial Sequence
  Synthetic
ccugggacgacggagacgccg

SEQ ID NO: 29864 - RNA, 22 nt, Artificial Sequence
  Synthetic
gccugggacgacggagacgccg

SEQ ID NO: 29865 - RNA, 23 nt, Artificial Sequence
  Synthetic
ggccugggacgacggagacgccg

SEQ ID NO: 29866 - RNA, 24 nt, Artificial Sequence
  Synthetic
cggccugggacgacggagacgccg

SEQ ID NO: 29867 - RNA, 18 nt, Artificial Sequence
  Synthetic
aggcggaggacgaggccg

SEQ ID NO: 29868 - RNA, 19 nt, Artificial Sequence
  Synthetic
gaggcggaggacgaggccg

SEQ ID NO: 29869 - RNA, 20 nt, Artificial Sequence
  Synthetic
agaggcggaggacgaggccg

SEQ ID NO: 29870 - RNA, 21 nt, Artificial Sequence
  Synthetic
aagaggcggaggacgaggccg

SEQ ID NO: 29871 - RNA, 22 nt, Artificial Sequence
  Synthetic
gaagaggcggaggacgaggccg

SEQ ID NO: 29872 - RNA, 23 nt, Artificial Sequence
  Synthetic
ggaagaggcggaggacgaggccg

SEQ ID NO: 29873 - RNA, 24 nt, Artificial Sequence
  Synthetic
aggaagaggcggaggacgaggccg

SEQ ID NO: 29874 - RNA, 18 nt, Artificial Sequence
  Synthetic
uggcgcgaccggaggccg

SEQ ID NO: 29875 - RNA, 19 nt, Artificial Sequence
  Synthetic
guggcgcgaccggaggccg

SEQ ID NO: 29876 - RNA, 20 nt, Artificial Sequence
  Synthetic
gguggcgcgaccggaggccg

SEQ ID NO: 29877 - RNA, 21 nt, Artificial Sequence
  Synthetic
ggguggcgcgaccggaggccg

SEQ ID NO: 29878 - RNA, 22 nt, Artificial Sequence
  Synthetic
cggguggcgcgaccggaggccg

SEQ ID NO: 29879 - RNA, 23 nt, Artificial Sequence
  Synthetic
acggguggcgcgaccggaggccg

SEQ ID NO: 29880 - RNA, 24 nt, Artificial Sequence
  Synthetic
cacggguggcgcgaccggaggccg

SEQ ID NO: 29881 - RNA, 18 nt, Artificial Sequence
  Synthetic
cgcgccccccgccggccg

SEQ ID NO: 29882 - RNA, 19 nt, Artificial Sequence
  Synthetic
gcgcgccccccgccggccg

SEQ ID NO: 29883 - RNA, 20 nt, Artificial Sequence
  Synthetic
cgcgcgccccccgccggccg

SEQ ID NO: 29884 - RNA, 21 nt, Artificial Sequence
  Synthetic
gcgcgcgccccccgccggccg

SEQ ID NO: 29885 - RNA, 22 nt, Artificial Sequence
  Synthetic
ugcgcgcgccccccgccggccg

SEQ ID NO: 29886 - RNA, 23 nt, Artificial Sequence
  Synthetic
cugcgcgcgccccccgccggccg

SEQ ID NO: 29887 - RNA, 24 nt, Artificial Sequence
  Synthetic
ccugcgcgcgccccccgccggccg

SEQ ID NO: 29888 - RNA, 18 nt, Artificial Sequence
  Synthetic
gcagcagcgcgggggccg

SEQ ID NO: 29889 - RNA, 19 nt, Artificial Sequence
  Synthetic
cgcagcagcgcgggggccg

SEQ ID NO: 29890 - RNA, 20 nt, Artificial Sequence
  Synthetic
gcgcagcagcgcgggggccg

SEQ ID NO: 29891 - RNA, 21 nt, Artificial Sequence
  Synthetic
ggcgcagcagcgcgggggccg

SEQ ID NO: 29892 - RNA, 22 nt, Artificial Sequence
  Synthetic
cggcgcagcagcgcgggggccg

SEQ ID NO: 29893 - RNA, 23 nt, Artificial Sequence
  Synthetic
gcggcgcagcagcgcgggggccg

SEQ ID NO: 29894 - RNA, 24 nt, Artificial Sequence
  Synthetic
cgcggcgcagcagcgcgggggccg

SEQ ID NO: 29895 - RNA, 18 nt, Artificial Sequence
  Synthetic
ccggggguguuggugccg

SEQ ID NO: 29896 - RNA, 19 nt, Artificial Sequence
  Synthetic
accggggguguuggugccg

SEQ ID NO: 29897 - RNA, 20 nt, Artificial Sequence
  Synthetic
caccggggguguuggugccg

SEQ ID NO: 29898 - RNA, 21 nt, Artificial Sequence
  Synthetic
gcaccggggguguuggugccg

SEQ ID NO: 29899 - RNA, 22 nt, Artificial Sequence
  Synthetic
ggcaccggggguguuggugccg

SEQ ID NO: 29900 - RNA, 23 nt, Artificial Sequence
  Synthetic
cggcaccggggguguuggugccg

SEQ ID NO: 29901 - RNA, 24 nt, Artificial Sequence
  Synthetic
gcggcaccggggguguuggugccg

SEQ ID NO: 29902 - RNA, 18 nt, Artificial Sequence
  Synthetic
gccgcugcugcugcuccg

SEQ ID NO: 29903 - RNA, 19 nt, Artificial Sequence
  Synthetic
cgccgcugcugcugcuccg

SEQ ID NO: 29904 - RNA, 20 nt, Artificial Sequence
  Synthetic
ccgccgcugcugcugcuccg

SEQ ID NO: 29905 - RNA, 21 nt, Artificial Sequence
  Synthetic
gccgccgcugcugcugcuccg

SEQ ID NO: 29906 - RNA, 22 nt, Artificial Sequence
  Synthetic
cgccgccgcugcugcugcuccg

SEQ ID NO: 29907 - RNA, 23 nt, Artificial Sequence
  Synthetic
gcgccgccgcugcugcugcuccg

SEQ ID NO: 29908 - RNA, 24 nt, Artificial Sequence
  Synthetic
ggcgccgccgcugcugcugcuccg

SEQ ID NO: 29909 - RNA, 18 nt, Artificial Sequence
  Synthetic
ucucgucucuccccagcg

SEQ ID NO: 29910 - RNA, 19 nt, Artificial Sequence
  Synthetic
uucucgucucuccccagcg

SEQ ID NO: 29911 - RNA, 20 nt, Artificial Sequence
  Synthetic
uuucucgucucuccccagcg

SEQ ID NO: 29912 - RNA, 21 nt, Artificial Sequence
  Synthetic
guuucucgucucuccccagcg

SEQ ID NO: 29913 - RNA, 22 nt, Artificial Sequence
  Synthetic
gguuucucgucucuccccagcg

SEQ ID NO: 29914 - RNA, 23 nt, Artificial Sequence
  Synthetic
agguuucucgucucuccccagcg

SEQ ID NO: 29915 - RNA, 24 nt, Artificial Sequence
  Synthetic
gagguuucucgucucuccccagcg

SEQ ID NO: 29916 - RNA, 18 nt, Artificial Sequence
  Synthetic
ccccgcggcgcagcagcg

SEQ ID NO: 29917 - RNA, 19 nt, Artificial Sequence
  Synthetic
cccccgcggcgcagcagcg

SEQ ID NO: 29918 - RNA, 20 nt, Artificial Sequence
  Synthetic
gcccccgcggcgcagcagcg

SEQ ID NO: 29919 - RNA, 21 nt, Artificial Sequence
  Synthetic
ggcccccgcggcgcagcagcg

SEQ ID NO: 29920 - RNA, 22 nt, Artificial Sequence
  Synthetic
cggcccccgcggcgcagcagcg

SEQ ID NO: 29921 - RNA, 23 nt, Artificial Sequence
  Synthetic
ucggcccccgcggcgcagcagcg

SEQ ID NO: 29922 - RNA, 24 nt, Artificial Sequence
  Synthetic
cucggcccccgcggcgcagcagcg

SEQ ID NO: 29923 - RNA, 18 nt, Artificial Sequence
  Synthetic
gggggcgaggggcgagcg

SEQ ID NO: 29924 - RNA, 19 nt, Artificial Sequence
  Synthetic
ggggggcgaggggcgagcg

SEQ ID NO: 29925 - RNA, 20 nt, Artificial Sequence
  Synthetic
uggggggcgaggggcgagcg

SEQ ID NO: 29926 - RNA, 21 nt, Artificial Sequence
  Synthetic
cuggggggcgaggggcgagcg

SEQ ID NO: 29927 - RNA, 22 nt, Artificial Sequence
  Synthetic
ccuggggggcgaggggcgagcg

SEQ ID NO: 29928 - RNA, 23 nt, Artificial Sequence
  Synthetic
cccuggggggcgaggggcgagcg

SEQ ID NO: 29929 - RNA, 24 nt, Artificial Sequence
  Synthetic
ccccuggggggcgaggggcgagcg

SEQ ID NO: 29930 - RNA, 18 nt, Artificial Sequence
  Synthetic
ccccagcgacagggagcg

SEQ ID NO: 29931 - RNA, 19 nt, Artificial Sequence
  Synthetic
cccccagcgacagggagcg

SEQ ID NO: 29932 - RNA, 20 nt, Artificial Sequence
  Synthetic
ccccccagcgacagggagcg

SEQ ID NO: 29933 - RNA, 21 nt, Artificial Sequence
  Synthetic
uccccccagcgacagggagcg

SEQ ID NO: 29934 - RNA, 22 nt, Artificial Sequence
  Synthetic
guccccccagcgacagggagcg

SEQ ID NO: 29935 - RNA, 23 nt, Artificial Sequence
  Synthetic
uguccccccagcgacagggagcg

SEQ ID NO: 29936 - RNA, 24 nt, Artificial Sequence
  Synthetic
guguccccccagcgacagggagcg

SEQ ID NO: 29937 - RNA, 18 nt, Artificial Sequence
  Synthetic
cuguuccacuccgacgcg

SEQ ID NO: 29938 - RNA, 19 nt, Artificial Sequence
  Synthetic
gcuguuccacuccgacgcg

SEQ ID NO: 29939 - RNA, 20 nt, Artificial Sequence
  Synthetic
ggcuguuccacuccgacgcg

SEQ ID NO: 29940 - RNA, 21 nt, Artificial Sequence
  Synthetic
aggcuguuccacuccgacgcg

SEQ ID NO: 29941 - RNA, 22 nt, Artificial Sequence
  Synthetic
gaggcuguuccacuccgacgcg

SEQ ID NO: 29942 - RNA, 23 nt, Artificial Sequence
  Synthetic
agaggcuguuccacuccgacgcg

SEQ ID NO: 29943 - RNA, 24 nt, Artificial Sequence
  Synthetic
cagaggcuguuccacuccgacgcg

SEQ ID NO: 29944 - RNA, 18 nt, Artificial Sequence
  Synthetic
gggcggacuccggacgcg

SEQ ID NO: 29945 - RNA, 19 nt, Artificial Sequence
  Synthetic
ggggcggacuccggacgcg

SEQ ID NO: 29946 - RNA, 20 nt, Artificial Sequence
  Synthetic
cggggcggacuccggacgcg

SEQ ID NO: 29947 - RNA, 21 nt, Artificial Sequence
  Synthetic
gcggggcggacuccggacgcg

SEQ ID NO: 29948 - RNA, 22 nt, Artificial Sequence
  Synthetic
cgcggggcggacuccggacgcg

SEQ ID NO: 29949 - RNA, 23 nt, Artificial Sequence
  Synthetic
gcgcggggcggacuccggacgcg

SEQ ID NO: 29950 - RNA, 24 nt, Artificial Sequence
  Synthetic
ggcgcggggcggacuccggacgcg

SEQ ID NO: 29951 - RNA, 18 nt, Artificial Sequence
  Synthetic
acgcucgagacccccgcg

SEQ ID NO: 29952 - RNA, 19 nt, Artificial Sequence
  Synthetic
gacgcucgagacccccgcg

SEQ ID NO: 29953 - RNA, 20 nt, Artificial Sequence
  Synthetic
cgacgcucgagacccccgcg

SEQ ID NO: 29954 - RNA, 21 nt, Artificial Sequence
  Synthetic
acgacgcucgagacccccgcg

SEQ ID NO: 29955 - RNA, 22 nt, Artificial Sequence
  Synthetic
cacgacgcucgagacccccgcg

SEQ ID NO: 29956 - RNA, 23 nt, Artificial Sequence
  Synthetic
ccacgacgcucgagacccccgcg

SEQ ID NO: 29957 - RNA, 24 nt, Artificial Sequence
  Synthetic
gccacgacgcucgagacccccgcg

SEQ ID NO: 29958 - RNA, 18 nt, Artificial Sequence
  Synthetic
cgcaccgccgcccccgcg

SEQ ID NO: 29959 - RNA, 19 nt, Artificial Sequence
  Synthetic
ccgcaccgccgcccccgcg

SEQ ID NO: 29960 - RNA, 20 nt, Artificial Sequence
  Synthetic
cccgcaccgccgcccccgcg

SEQ ID NO: 29961 - RNA, 21 nt, Artificial Sequence
  Synthetic
ccccgcaccgccgcccccgcg

SEQ ID NO: 29962 - RNA, 22 nt, Artificial Sequence
  Synthetic
cccccgcaccgccgcccccgcg

SEQ ID NO: 29963 - RNA, 23 nt, Artificial Sequence
  Synthetic
gcccccgcaccgccgcccccgcg

SEQ ID NO: 29964 - RNA, 24 nt, Artificial Sequence
  Synthetic
cgcccccgcaccgccgcccccgcg

SEQ ID NO: 29965 - RNA, 18 nt, Artificial Sequence
  Synthetic
cgcggggcgacggccgcg

SEQ ID NO: 29966 - RNA, 19 nt, Artificial Sequence
  Synthetic
gcgcggggcgacggccgcg

SEQ ID NO: 29967 - RNA, 20 nt, Artificial Sequence
  Synthetic
cgcgcggggcgacggccgcg

SEQ ID NO: 29968 - RNA, 21 nt, Artificial Sequence
  Synthetic
acgcgcggggcgacggccgcg

SEQ ID NO: 29969 - RNA, 22 nt, Artificial Sequence
  Synthetic
gacgcgcggggcgacggccgcg

SEQ ID NO: 29970 - RNA, 23 nt, Artificial Sequence
  Synthetic
ggacgcgcggggcgacggccgcg

SEQ ID NO: 29971 - RNA, 24 nt, Artificial Sequence
  Synthetic
cggacgcgcggggcgacggccgcg

SEQ ID NO: 29972 - RNA, 18 nt, Artificial Sequence
  Synthetic
gggggcuccugggccgcg

SEQ ID NO: 29973 - RNA, 19 nt, Artificial Sequence
  Synthetic
ggggggcuccugggccgcg

SEQ ID NO: 29974 - RNA, 20 nt, Artificial Sequence
  Synthetic
uggggggcuccugggccgcg

SEQ ID NO: 29975 - RNA, 21 nt, Artificial Sequence
  Synthetic
auggggggcuccugggccgcg

SEQ ID NO: 29976 - RNA, 22 nt, Artificial Sequence
  Synthetic
uauggggggcuccugggccgcg

SEQ ID NO: 29977 - RNA, 23 nt, Artificial Sequence
  Synthetic
cuauggggggcuccugggccgcg

SEQ ID NO: 29978 - RNA, 24 nt, Artificial Sequence
  Synthetic
acuauggggggcuccugggccgcg

SEQ ID NO: 29979 - RNA, 18 nt, Artificial Sequence
  Synthetic
ggggguguuggugccgcg

SEQ ID NO: 29980 - RNA, 19 nt, Artificial Sequence
  Synthetic
cggggguguuggugccgcg

SEQ ID NO: 29981 - RNA, 20 nt, Artificial Sequence
  Synthetic
ccggggguguuggugccgcg

SEQ ID NO: 29982 - RNA, 21 nt, Artificial Sequence
  Synthetic
accggggguguuggugccgcg

SEQ ID NO: 29983 - RNA, 22 nt, Artificial Sequence
  Synthetic
caccggggguguuggugccgcg

SEQ ID NO: 29984 - RNA, 23 nt, Artificial Sequence
  Synthetic
gcaccggggguguuggugccgcg

SEQ ID NO: 29985 - RNA, 24 nt, Artificial Sequence
  Synthetic
ggcaccggggguguuggugccgcg

SEQ ID NO: 29986 - RNA, 18 nt, Artificial Sequence
  Synthetic
gcgcggggcugucucgcg

SEQ ID NO: 29987 - RNA, 19 nt, Artificial Sequence
  Synthetic
cgcgcggggcugucucgcg

SEQ ID NO: 29988 - RNA, 20 nt, Artificial Sequence
  Synthetic
ccgcgcggggcugucucgcg

SEQ ID NO: 29989 - RNA, 21 nt, Artificial Sequence
  Synthetic
gccgcgcggggcugucucgcg

SEQ ID NO: 29990 - RNA, 22 nt, Artificial Sequence
  Synthetic
ggccgcgcggggcugucucgcg

SEQ ID NO: 29991 - RNA, 23 nt, Artificial Sequence
  Synthetic
gggccgcgcggggcugucucgcg

SEQ ID NO: 29992 - RNA, 24 nt, Artificial Sequence
  Synthetic
ugggccgcgcggggcugucucgcg

SEQ ID NO: 29993 - RNA, 18 nt, Artificial Sequence
  Synthetic
ggcgccggucgggucgcg

SEQ ID NO: 29994 - RNA, 19 nt, Artificial Sequence
  Synthetic
gggcgccggucgggucgcg

SEQ ID NO: 29995 - RNA, 20 nt, Artificial Sequence
  Synthetic
ggggcgccggucgggucgcg

SEQ ID NO: 29996 - RNA, 21 nt, Artificial Sequence
  Synthetic
gggggcgccggucgggucgcg

SEQ ID NO: 29997 - RNA, 22 nt, Artificial Sequence
  Synthetic
agggggcgccggucgggucgcg

SEQ ID NO: 29998 - RNA, 23 nt, Artificial Sequence
  Synthetic
cagggggcgccggucgggucgcg

SEQ ID NO: 29999 - RNA, 24 nt, Artificial Sequence
  Synthetic
ccagggggcgccggucgggucgcg

SEQ ID NO: 30000 - RNA, 18 nt, Artificial Sequence
  Synthetic
cccgcagaggaagaggcg

SEQ ID NO: 30001 - RNA, 19 nt, Artificial Sequence
  Synthetic
gcccgcagaggaagaggcg

SEQ ID NO: 30002 - RNA, 20 nt, Artificial Sequence
  Synthetic
cgcccgcagaggaagaggcg

SEQ ID NO: 30003 - RNA, 21 nt, Artificial Sequence
  Synthetic
ccgcccgcagaggaagaggcg

SEQ ID NO: 30004 - RNA, 22 nt, Artificial Sequence
  Synthetic
cccgcccgcagaggaagaggcg

SEQ ID NO: 30005 - RNA, 23 nt, Artificial Sequence
  Synthetic
ccccgcccgcagaggaagaggcg

SEQ ID NO: 30006 - RNA, 24 nt, Artificial Sequence
  Synthetic
gccccgcccgcagaggaagaggcg

SEQ ID NO: 30007 - RNA, 18 nt, Artificial Sequence
  Synthetic
gcggcggaggaagaggcg

SEQ ID NO: 30008 - RNA, 19 nt, Artificial Sequence
  Synthetic
ggcggcggaggaagaggcg

SEQ ID NO: 30009 - RNA, 20 nt, Artificial Sequence
  Synthetic
gggcggcggaggaagaggcg

SEQ ID NO: 30010 - RNA, 21 nt, Artificial Sequence
  Synthetic
ggggcggcggaggaagaggcg

SEQ ID NO: 30011 - RNA, 22 nt, Artificial Sequence
  Synthetic
cggggcggcggaggaagaggcg

SEQ ID NO: 30012 - RNA, 23 nt, Artificial Sequence
  Synthetic
gcggggcggcggaggaagaggcg

SEQ ID NO: 30013 - RNA, 24 nt, Artificial Sequence
  Synthetic
cgcggggcggcggaggaagaggcg

SEQ ID NO: 30014 - RNA, 18 nt, Artificial Sequence
  Synthetic
gcggaggaggaggaggcg

SEQ ID NO: 30015 - RNA, 19 nt, Artificial Sequence
  Synthetic
ggcggaggaggaggaggcg

SEQ ID NO: 30016 - RNA, 20 nt, Artificial Sequence
  Synthetic
aggcggaggaggaggaggcg

SEQ ID NO: 30017 - RNA, 21 nt, Artificial Sequence
  Synthetic
gaggcggaggaggaggaggcg

SEQ ID NO: 30018 - RNA, 22 nt, Artificial Sequence
  Synthetic
agaggcggaggaggaggaggcg

SEQ ID NO: 30019 - RNA, 23 nt, Artificial Sequence
  Synthetic
aagaggcggaggaggaggaggcg

SEQ ID NO: 30020 - RNA, 24 nt, Artificial Sequence
  Synthetic
gaagaggcggaggaggaggaggcg

SEQ ID NO: 30021 - RNA, 22 nt, Artificial Sequence
  Synthetic
ggaggcggaggaggaggaggcg

SEQ ID NO: 30022 - RNA, 23 nt, Artificial Sequence
  Synthetic
aggaggcggaggaggaggaggcg

SEQ ID NO: 30023 - RNA, 24 nt, Artificial Sequence
  Synthetic
gaggaggcggaggaggaggaggcg

SEQ ID NO: 30024 - RNA, 18 nt, Artificial Sequence
  Synthetic
ggcggcgcggagacggcg

SEQ ID NO: 30025 - RNA, 19 nt, Artificial Sequence
  Synthetic
gggcggcgcggagacggcg

SEQ ID NO: 30026 - RNA, 20 nt, Artificial Sequence
  Synthetic
ggggcggcgcggagacggcg

SEQ ID NO: 30027 - RNA, 21 nt, Artificial Sequence
  Synthetic
cggggcggcgcggagacggcg

SEQ ID NO: 30028 - RNA, 22 nt, Artificial Sequence
  Synthetic
gcggggcggcgcggagacggcg

SEQ ID NO: 30029 - RNA, 23 nt, Artificial Sequence
  Synthetic
cgcggggcggcgcggagacggcg

SEQ ID NO: 30030 - RNA, 24 nt, Artificial Sequence
  Synthetic
ccgcggggcggcgcggagacggcg

SEQ ID NO: 30031 - RNA, 18 nt, Artificial Sequence
  Synthetic
gccgcccccuccgcggcg

SEQ ID NO: 30032 - RNA, 19 nt, Artificial Sequence
  Synthetic
cgccgcccccuccgcggcg

SEQ ID NO: 30033 - RNA, 20 nt, Artificial Sequence
  Synthetic
ccgccgcccccuccgcggcg

SEQ ID NO: 30034 - RNA, 21 nt, Artificial Sequence
  Synthetic
gccgccgcccccuccgcggcg

SEQ ID NO: 30035 - RNA, 22 nt, Artificial Sequence
  Synthetic
ggccgccgcccccuccgcggcg

SEQ ID NO: 30036 - RNA, 23 nt, Artificial Sequence
  Synthetic
gggccgccgcccccuccgcggcg

SEQ ID NO: 30037 - RNA, 24 nt, Artificial Sequence
  Synthetic
cgggccgccgcccccuccgcggcg

SEQ ID NO: 30038 - RNA, 18 nt, Artificial Sequence
  Synthetic
acgggggcggcggcggcg

SEQ ID NO: 30039 - RNA, 19 nt, Artificial Sequence
  Synthetic
cacgggggcggcggcggcg

SEQ ID NO: 30040 - RNA, 20 nt, Artificial Sequence
  Synthetic
ccacgggggcggcggcggcg

SEQ ID NO: 30041 - RNA, 21 nt, Artificial Sequence
  Synthetic
accacgggggcggcggcggcg

SEQ ID NO: 30042 - RNA, 22 nt, Artificial Sequence
  Synthetic
caccacgggggcggcggcggcg

SEQ ID NO: 30043 - RNA, 23 nt, Artificial Sequence
  Synthetic
acaccacgggggcggcggcggcg

SEQ ID NO: 30044 - RNA, 24 nt, Artificial Sequence
  Synthetic
gacaccacgggggcggcggcggcg

SEQ ID NO: 30045 - RNA, 18 nt, Artificial Sequence
  Synthetic
ggggcccgcggggcggcg

SEQ ID NO: 30046 - RNA, 19 nt, Artificial Sequence
  Synthetic
cggggcccgcggggcggcg

SEQ ID NO: 30047 - RNA, 20 nt, Artificial Sequence
  Synthetic
ccggggcccgcggggcggcg

SEQ ID NO: 30048 - RNA, 21 nt, Artificial Sequence
  Synthetic
cccggggcccgcggggcggcg

SEQ ID NO: 30049 - RNA, 22 nt, Artificial Sequence
  Synthetic
gcccggggcccgcggggcggcg

SEQ ID NO: 30050 - RNA, 23 nt, Artificial Sequence
  Synthetic
ggcccggggcccgcggggcggcg

SEQ ID NO: 30051 - RNA, 24 nt, Artificial Sequence
  Synthetic
cggcccggggcccgcggggcggcg

SEQ ID NO: 30052 - RNA, 18 nt, Artificial Sequence
  Synthetic
ggcgagcgcggggcggcg

SEQ ID NO: 30053 - RNA, 19 nt, Artificial Sequence
  Synthetic
gggcgagcgcggggcggcg

SEQ ID NO: 30054 - RNA, 20 nt, Artificial Sequence
  Synthetic
ggggcgagcgcggggcggcg

SEQ ID NO: 30055 - RNA, 21 nt, Artificial Sequence
  Synthetic
aggggcgagcgcggggcggcg

SEQ ID NO: 30056 - RNA, 22 nt, Artificial Sequence
  Synthetic
gaggggcgagcgcggggcggcg

SEQ ID NO: 30057 - RNA, 23 nt, Artificial Sequence
  Synthetic
cgaggggcgagcgcggggcggcg

SEQ ID NO: 30058 - RNA, 24 nt, Artificial Sequence
  Synthetic
gcgaggggcgagcgcggggcggcg

SEQ ID NO: 30059 - RNA, 18 nt, Artificial Sequence
  Synthetic
aggggcgagcgcggggcg

SEQ ID NO: 30060 - RNA, 19 nt, Artificial Sequence
  Synthetic
gaggggcgagcgcggggcg

SEQ ID NO: 30061 - RNA, 20 nt, Artificial Sequence
  Synthetic
cgaggggcgagcgcggggcg

SEQ ID NO: 30062 - RNA, 21 nt, Artificial Sequence
  Synthetic
gcgaggggcgagcgcggggcg

SEQ ID NO: 30063 - RNA, 22 nt, Artificial Sequence
  Synthetic
ggcgaggggcgagcgcggggcg

SEQ ID NO: 30064 - RNA, 23 nt, Artificial Sequence
  Synthetic
gggcgaggggcgagcgcggggcg

SEQ ID NO: 30065 - RNA, 24 nt, Artificial Sequence
  Synthetic
ggggcgaggggcgagcgcggggcg

SEQ ID NO: 30066 - RNA, 18 nt, Artificial Sequence
  Synthetic
cccacccccuggggggcg

SEQ ID NO: 30067 - RNA, 19 nt, Artificial Sequence
  Synthetic
ccccacccccuggggggcg

SEQ ID NO: 30068 - RNA, 20 nt, Artificial Sequence
  Synthetic
cccccacccccuggggggcg

SEQ ID NO: 30069 - RNA, 21 nt, Artificial Sequence
  Synthetic
gcccccacccccuggggggcg

SEQ ID NO: 30070 - RNA, 22 nt, Artificial Sequence
  Synthetic
ggcccccacccccuggggggcg

SEQ ID NO: 30071 - RNA, 23 nt, Artificial Sequence
  Synthetic
uggcccccacccccuggggggcg

SEQ ID NO: 30072 - RNA, 24 nt, Artificial Sequence
  Synthetic
uuggcccccacccccuggggggcg

SEQ ID NO: 30073 - RNA, 18 nt, Artificial Sequence
  Synthetic
cccgaggacaccugugcg

SEQ ID NO: 30074 - RNA, 19 nt, Artificial Sequence
  Synthetic
gcccgaggacaccugugcg

SEQ ID NO: 30075 - RNA, 20 nt, Artificial Sequence
  Synthetic
ggcccgaggacaccugugcg

SEQ ID NO: 30076 - RNA, 21 nt, Artificial Sequence
  Synthetic
gggcccgaggacaccugugcg

SEQ ID NO: 30077 - RNA, 22 nt, Artificial Sequence
  Synthetic
ggggcccgaggacaccugugcg

SEQ ID NO: 30078 - RNA, 23 nt, Artificial Sequence
  Synthetic
cggggcccgaggacaccugugcg

SEQ ID NO: 30079 - RNA, 24 nt, Artificial Sequence
  Synthetic
ccggggcccgaggacaccugugcg

SEQ ID NO: 30080 - RNA, 18 nt, Artificial Sequence
  Synthetic
caguugcgcgcgugcucg

SEQ ID NO: 30081 - RNA, 19 nt, Artificial Sequence
  Synthetic
gcaguugcgcgcgugcucg

SEQ ID NO: 30082 - RNA, 20 nt, Artificial Sequence
  Synthetic
cgcaguugcgcgcgugcucg

SEQ ID NO: 30083 - RNA, 21 nt, Artificial Sequence
  Synthetic
acgcaguugcgcgcgugcucg

SEQ ID NO: 30084 - RNA, 22 nt, Artificial Sequence
  Synthetic
cacgcaguugcgcgcgugcucg

SEQ ID NO: 30085 - RNA, 23 nt, Artificial Sequence
  Synthetic
ucacgcaguugcgcgcgugcucg

SEQ ID NO: 30086 - RNA, 24 nt, Artificial Sequence
  Synthetic
cucacgcaguugcgcgcgugcucg

SEQ ID NO: 30087 - RNA, 18 nt, Artificial Sequence
  Synthetic
ccgcgcggggcugucucg

SEQ ID NO: 30088 - RNA, 19 nt, Artificial Sequence
  Synthetic
gccgcgcggggcugucucg

SEQ ID NO: 30089 - RNA, 20 nt, Artificial Sequence
  Synthetic
ggccgcgcggggcugucucg

SEQ ID NO: 30090 - RNA, 21 nt, Artificial Sequence
  Synthetic
gggccgcgcggggcugucucg

SEQ ID NO: 30091 - RNA, 22 nt, Artificial Sequence
  Synthetic
ugggccgcgcggggcugucucg

SEQ ID NO: 30092 - RNA, 23 nt, Artificial Sequence
  Synthetic
cugggccgcgcggggcugucucg

SEQ ID NO: 30093 - RNA, 24 nt, Artificial Sequence
  Synthetic
ccugggccgcgcggggcugucucg

SEQ ID NO: 30094 - RNA, 18 nt, Artificial Sequence
  Synthetic
gggggcgucggguagucg

SEQ ID NO: 30095 - RNA, 19 nt, Artificial Sequence
  Synthetic
ggggggcgucggguagucg

SEQ ID NO: 30096 - RNA, 20 nt, Artificial Sequence
  Synthetic
cggggggcgucggguagucg

SEQ ID NO: 30097 - RNA, 21 nt, Artificial Sequence
  Synthetic
gcggggggcgucggguagucg

SEQ ID NO: 30098 - RNA, 22 nt, Artificial Sequence
  Synthetic
cgcggggggcgucggguagucg

SEQ ID NO: 30099 - RNA, 23 nt, Artificial Sequence
  Synthetic
acgcggggggcgucggguagucg

SEQ ID NO: 30100 - RNA, 24 nt, Artificial Sequence
  Synthetic
gacgcggggggcgucggguagucg

SEQ ID NO: 30101 - RNA, 18 nt, Artificial Sequence
  Synthetic
gcgccggggcgcucuucg

SEQ ID NO: 30102 - RNA, 19 nt, Artificial Sequence
  Synthetic
cgcgccggggcgcucuucg

SEQ ID NO: 30103 - RNA, 20 nt, Artificial Sequence
  Synthetic
ccgcgccggggcgcucuucg

SEQ ID NO: 30104 - RNA, 21 nt, Artificial Sequence
  Synthetic
cccgcgccggggcgcucuucg

SEQ ID NO: 30105 - RNA, 22 nt, Artificial Sequence
  Synthetic
ccccgcgccggggcgcucuucg

SEQ ID NO: 30106 - RNA, 23 nt, Artificial Sequence
  Synthetic
cccccgcgccggggcgcucuucg

SEQ ID NO: 30107 - RNA, 24 nt, Artificial Sequence
  Synthetic
gcccccgcgccggggcgcucuucg

SEQ ID NO: 30108 - RNA, 18 nt, Artificial Sequence
  Synthetic
cccgucuccauguccagg

SEQ ID NO: 30109 - RNA, 19 nt, Artificial Sequence
  Synthetic
gcccgucuccauguccagg

SEQ ID NO: 30110 - RNA, 20 nt, Artificial Sequence
  Synthetic
ggcccgucuccauguccagg

SEQ ID NO: 30111 - RNA, 21 nt, Artificial Sequence
  Synthetic
uggcccgucuccauguccagg

SEQ ID NO: 30112 - RNA, 22 nt, Artificial Sequence
  Synthetic
guggcccgucuccauguccagg

SEQ ID NO: 30113 - RNA, 23 nt, Artificial Sequence
  Synthetic
uguggcccgucuccauguccagg

SEQ ID NO: 30114 - RNA, 24 nt, Artificial Sequence
  Synthetic
auguggcccgucuccauguccagg

SEQ ID NO: 30115 - RNA, 18 nt, Artificial Sequence
  Synthetic
ccccccgccggccgcagg

SEQ ID NO: 30116 - RNA, 19 nt, Artificial Sequence
  Synthetic
gccccccgccggccgcagg

SEQ ID NO: 30117 - RNA, 20 nt, Artificial Sequence
  Synthetic
cgccccccgccggccgcagg

SEQ ID NO: 30118 - RNA, 21 nt, Artificial Sequence
  Synthetic
gcgccccccgccggccgcagg

SEQ ID NO: 30119 - RNA, 22 nt, Artificial Sequence
  Synthetic
cgcgccccccgccggccgcagg

SEQ ID NO: 30120 - RNA, 23 nt, Artificial Sequence
  Synthetic
gcgcgccccccgccggccgcagg

SEQ ID NO: 30121 - RNA, 24 nt, Artificial Sequence
  Synthetic
cgcgcgccccccgccggccgcagg

SEQ ID NO: 30122 - RNA, 18 nt, Artificial Sequence
  Synthetic
cgcccgcagaggaagagg

SEQ ID NO: 30123 - RNA, 19 nt, Artificial Sequence
  Synthetic
ccgcccgcagaggaagagg

SEQ ID NO: 30124 - RNA, 20 nt, Artificial Sequence
  Synthetic
cccgcccgcagaggaagagg

SEQ ID NO: 30125 - RNA, 21 nt, Artificial Sequence
  Synthetic
ccccgcccgcagaggaagagg

SEQ ID NO: 30126 - RNA, 22 nt, Artificial Sequence
  Synthetic
gccccgcccgcagaggaagagg

SEQ ID NO: 30127 - RNA, 23 nt, Artificial Sequence
  Synthetic
agccccgcccgcagaggaagagg

SEQ ID NO: 30128 - RNA, 24 nt, Artificial Sequence
  Synthetic
cagccccgcccgcagaggaagagg

SEQ ID NO: 30129 - RNA, 18 nt, Artificial Sequence
  Synthetic
gggcggcggaggaagagg

SEQ ID NO: 30130 - RNA, 19 nt, Artificial Sequence
  Synthetic
ggggcggcggaggaagagg

SEQ ID NO: 30131 - RNA, 20 nt, Artificial Sequence
  Synthetic
cggggcggcggaggaagagg

SEQ ID NO: 30132 - RNA, 21 nt, Artificial Sequence
  Synthetic
gcggggcggcggaggaagagg

SEQ ID NO: 30133 - RNA, 22 nt, Artificial Sequence
  Synthetic
cgcggggcggcggaggaagagg

SEQ ID NO: 30134 - RNA, 23 nt, Artificial Sequence
  Synthetic
gcgcggggcggcggaggaagagg

SEQ ID NO: 30135 - RNA, 24 nt, Artificial Sequence
  Synthetic
agcgcggggcggcggaggaagagg

SEQ ID NO: 30136 - RNA, 18 nt, Artificial Sequence
  Synthetic
cagccccgcccgcagagg

SEQ ID NO: 30137 - RNA, 19 nt, Artificial Sequence
  Synthetic
ccagccccgcccgcagagg

SEQ ID NO: 30138 - RNA, 20 nt, Artificial Sequence
  Synthetic
accagccccgcccgcagagg

SEQ ID NO: 30139 - RNA, 21 nt, Artificial Sequence
  Synthetic
caccagccccgcccgcagagg

SEQ ID NO: 30140 - RNA, 22 nt, Artificial Sequence
  Synthetic
ccaccagccccgcccgcagagg

SEQ ID NO: 30141 - RNA, 23 nt, Artificial Sequence
  Synthetic
cccaccagccccgcccgcagagg

SEQ ID NO: 30142 - RNA, 24 nt, Artificial Sequence
  Synthetic
ucccaccagccccgcccgcagagg

SEQ ID NO: 30143 - RNA, 18 nt, Artificial Sequence
  Synthetic
aggcggaggaggaggagg

SEQ ID NO: 30144 - RNA, 19 nt, Artificial Sequence
  Synthetic
gaggcggaggaggaggagg

SEQ ID NO: 30145 - RNA, 20 nt, Artificial Sequence
  Synthetic
agaggcggaggaggaggagg

SEQ ID NO: 30146 - RNA, 21 nt, Artificial Sequence
  Synthetic
aagaggcggaggaggaggagg

SEQ ID NO: 30147 - RNA, 22 nt, Artificial Sequence
  Synthetic
gaagaggcggaggaggaggagg

SEQ ID NO: 30148 - RNA, 23 nt, Artificial Sequence
  Synthetic
ggaagaggcggaggaggaggagg

SEQ ID NO: 30149 - RNA, 24 nt, Artificial Sequence
  Synthetic
aggaagaggcggaggaggaggagg

SEQ ID NO: 30150 - RNA, 20 nt, Artificial Sequence
  Synthetic
ggaggcggaggaggaggagg

SEQ ID NO: 30151 - RNA, 21 nt, Artificial Sequence
  Synthetic
aggaggcggaggaggaggagg

SEQ ID NO: 30152 - RNA, 22 nt, Artificial Sequence
  Synthetic
gaggaggcggaggaggaggagg

SEQ ID NO: 30153 - RNA, 23 nt, Artificial Sequence
  Synthetic
ggaggaggcggaggaggaggagg

SEQ ID NO: 30154 - RNA, 24 nt, Artificial Sequence
  Synthetic
aggaggaggcggaggaggaggagg

SEQ ID NO: 30155 - RNA, 18 nt, Artificial Sequence
  Synthetic
aggaagaggcggaggagg

SEQ ID NO: 30156 - RNA, 19 nt, Artificial Sequence
  Synthetic
gaggaagaggcggaggagg

SEQ ID NO: 30157 - RNA, 20 nt, Artificial Sequence
  Synthetic
agaggaagaggcggaggagg

SEQ ID NO: 30158 - RNA, 21 nt, Artificial Sequence
  Synthetic
cagaggaagaggcggaggagg

SEQ ID NO: 30159 - RNA, 22 nt, Artificial Sequence
  Synthetic
gcagaggaagaggcggaggagg

SEQ ID NO: 30160 - RNA, 23 nt, Artificial Sequence
  Synthetic
cgcagaggaagaggcggaggagg

SEQ ID NO: 30161 - RNA, 24 nt, Artificial Sequence
  Synthetic
ccgcagaggaagaggcggaggagg

SEQ ID NO: 30162 - RNA, 18 nt, Artificial Sequence
  Synthetic
aggaggaggcggaggagg

SEQ ID NO: 30163 - RNA, 19 nt, Artificial Sequence
  Synthetic
gaggaggaggcggaggagg

SEQ ID NO: 30164 - RNA, 20 nt, Artificial Sequence
  Synthetic
ggaggaggaggcggaggagg

SEQ ID NO: 30165 - RNA, 21 nt, Artificial Sequence
  Synthetic
aggaggaggaggcggaggagg

SEQ ID NO: 30166 - RNA, 22 nt, Artificial Sequence
  Synthetic
gaggaggaggaggcggaggagg

SEQ ID NO: 30167 - RNA, 23 nt, Artificial Sequence
  Synthetic
ggaggaggaggaggcggaggagg

SEQ ID NO: 30168 - RNA, 24 nt, Artificial Sequence
  Synthetic
cggaggaggaggaggcggaggagg

SEQ ID NO: 30169 - RNA, 18 nt, Artificial Sequence
  Synthetic
acaccugugcggaggagg

SEQ ID NO: 30170 - RNA, 19 nt, Artificial Sequence
  Synthetic
gacaccugugcggaggagg

SEQ ID NO: 30171 - RNA, 20 nt, Artificial Sequence
  Synthetic
ggacaccugugcggaggagg

SEQ ID NO: 30172 - RNA, 21 nt, Artificial Sequence
  Synthetic
aggacaccugugcggaggagg

SEQ ID NO: 30173 - RNA, 22 nt, Artificial Sequence
  Synthetic
gaggacaccugugcggaggagg

SEQ ID NO: 30174 - RNA, 23 nt, Artificial Sequence
  Synthetic
cgaggacaccugugcggaggagg

SEQ ID NO: 30175 - RNA, 24 nt, Artificial Sequence
  Synthetic
ccgaggacaccugugcggaggagg

SEQ ID NO: 30176 - RNA, 18 nt, Artificial Sequence
  Synthetic
cagaggaagaggcggagg

SEQ ID NO: 30177 - RNA, 19 nt, Artificial Sequence
  Synthetic
gcagaggaagaggcggagg

SEQ ID NO: 30178 - RNA, 20 nt, Artificial Sequence
  Synthetic
cgcagaggaagaggcggagg

SEQ ID NO: 30179 - RNA, 21 nt, Artificial Sequence
  Synthetic
ccgcagaggaagaggcggagg

SEQ ID NO: 30180 - RNA, 22 nt, Artificial Sequence
  Synthetic
cccgcagaggaagaggcggagg

SEQ ID NO: 30181 - RNA, 23 nt, Artificial Sequence
  Synthetic
gcccgcagaggaagaggcggagg

SEQ ID NO: 30182 - RNA, 24 nt, Artificial Sequence
  Synthetic
cgcccgcagaggaagaggcggagg

SEQ ID NO: 30183 - RNA, 18 nt, Artificial Sequence
  Synthetic
cggaggaagaggcggagg

SEQ ID NO: 30184 - RNA, 19 nt, Artificial Sequence
  Synthetic
gcggaggaagaggcggagg

SEQ ID NO: 30185 - RNA, 20 nt, Artificial Sequence
  Synthetic
ggcggaggaagaggcggagg

SEQ ID NO: 30186 - RNA, 21 nt, Artificial Sequence
  Synthetic
cggcggaggaagaggcggagg

SEQ ID NO: 30187 - RNA, 22 nt, Artificial Sequence
  Synthetic
gcggcggaggaagaggcggagg

SEQ ID NO: 30188 - RNA, 23 nt, Artificial Sequence
  Synthetic
ggcggcggaggaagaggcggagg

SEQ ID NO: 30189 - RNA, 24 nt, Artificial Sequence
  Synthetic
gggcggcggaggaagaggcggagg

SEQ ID NO: 30190 - RNA, 18 nt, Artificial Sequence
  Synthetic
aggaggaggaggcggagg

SEQ ID NO: 30191 - RNA, 19 nt, Artificial Sequence
  Synthetic
gaggaggaggaggcggagg

SEQ ID NO: 30192 - RNA, 20 nt, Artificial Sequence
  Synthetic
ggaggaggaggaggcggagg

SEQ ID NO: 30193 - RNA, 21 nt, Artificial Sequence
  Synthetic
cggaggaggaggaggcggagg

SEQ ID NO: 30194 - RNA, 22 nt, Artificial Sequence
  Synthetic
gcggaggaggaggaggcggagg

SEQ ID NO: 30195 - RNA, 23 nt, Artificial Sequence
  Synthetic
ggcggaggaggaggaggcggagg

SEQ ID NO: 30196 - RNA, 24 nt, Artificial Sequence
  Synthetic
aggcggaggaggaggaggcggagg

SEQ ID NO: 30197 - RNA, 18 nt, Artificial Sequence
  Synthetic
agcgcggggcggcggagg

SEQ ID NO: 30198 - RNA, 19 nt, Artificial Sequence
  Synthetic
gagcgcggggcggcggagg

SEQ ID NO: 30199 - RNA, 20 nt, Artificial Sequence
  Synthetic
cgagcgcggggcggcggagg

SEQ ID NO: 30200 - RNA, 21 nt, Artificial Sequence
  Synthetic
gcgagcgcggggcggcggagg

SEQ ID NO: 30201 - RNA, 22 nt, Artificial Sequence
  Synthetic
ggcgagcgcggggcggcggagg

SEQ ID NO: 30202 - RNA, 23 nt, Artificial Sequence
  Synthetic
gggcgagcgcggggcggcggagg

SEQ ID NO: 30203 - RNA, 24 nt, Artificial Sequence
  Synthetic
ggggcgagcgcggggcggcggagg

SEQ ID NO: 30204 - RNA, 18 nt, Artificial Sequence
  Synthetic
aggacaccugugcggagg

SEQ ID NO: 30205 - RNA, 19 nt, Artificial Sequence
  Synthetic
gaggacaccugugcggagg

SEQ ID NO: 30206 - RNA, 20 nt, Artificial Sequence
  Synthetic
cgaggacaccugugcggagg

SEQ ID NO: 30207 - RNA, 21 nt, Artificial Sequence
  Synthetic
ccgaggacaccugugcggagg

SEQ ID NO: 30208 - RNA, 22 nt, Artificial Sequence
  Synthetic
cccgaggacaccugugcggagg

SEQ ID NO: 30209 - RNA, 23 nt, Artificial Sequence
  Synthetic
gcccgaggacaccugugcggagg

SEQ ID NO: 30210 - RNA, 24 nt, Artificial Sequence
  Synthetic
ggcccgaggacaccugugcggagg

SEQ ID NO: 30211 - RNA, 18 nt, Artificial Sequence
  Synthetic
ggcagguagcgcgugagg

SEQ ID NO: 30212 - RNA, 19 nt, Artificial Sequence
  Synthetic
gggcagguagcgcgugagg

SEQ ID NO: 30213 - RNA, 20 nt, Artificial Sequence
  Synthetic
ugggcagguagcgcgugagg

SEQ ID NO: 30214 - RNA, 21 nt, Artificial Sequence
  Synthetic
augggcagguagcgcgugagg

SEQ ID NO: 30215 - RNA, 22 nt, Artificial Sequence
  Synthetic
gaugggcagguagcgcgugagg

SEQ ID NO: 30216 - RNA, 23 nt, Artificial Sequence
  Synthetic
cgaugggcagguagcgcgugagg

SEQ ID NO: 30217 - RNA, 24 nt, Artificial Sequence
  Synthetic
gcgaugggcagguagcgcgugagg

SEQ ID NO: 30218 - RNA, 18 nt, Artificial Sequence
  Synthetic
ggggcggcgcggagacgg

SEQ ID NO: 30219 - RNA, 19 nt, Artificial Sequence
  Synthetic
cggggcggcgcggagacgg

SEQ ID NO: 30220 - RNA, 20 nt, Artificial Sequence
  Synthetic
gcggggcggcgcggagacgg

SEQ ID NO: 30221 - RNA, 21 nt, Artificial Sequence
  Synthetic
cgcggggcggcgcggagacgg

SEQ ID NO: 30222 - RNA, 22 nt, Artificial Sequence
  Synthetic
ccgcggggcggcgcggagacgg

SEQ ID NO: 30223 - RNA, 23 nt, Artificial Sequence
  Synthetic
cccgcggggcggcgcggagacgg

SEQ ID NO: 30224 - RNA, 24 nt, Artificial Sequence
  Synthetic
gcccgcggggcggcgcggagacgg

SEQ ID NO: 30225 - RNA, 18 nt, Artificial Sequence
  Synthetic
gcacgacggccgcgacgg

SEQ ID NO: 30226 - RNA, 19 nt, Artificial Sequence
  Synthetic
ggcacgacggccgcgacgg

SEQ ID NO: 30227 - RNA, 20 nt, Artificial Sequence
  Synthetic
cggcacgacggccgcgacgg

SEQ ID NO: 30228 - RNA, 21 nt, Artificial Sequence
  Synthetic
ucggcacgacggccgcgacgg

SEQ ID NO: 30229 - RNA, 22 nt, Artificial Sequence
  Synthetic
cucggcacgacggccgcgacgg

SEQ ID NO: 30230 - RNA, 23 nt, Artificial Sequence
  Synthetic
ucucggcacgacggccgcgacgg

SEQ ID NO: 30231 - RNA, 24 nt, Artificial Sequence
  Synthetic
cucucggcacgacggccgcgacgg

SEQ ID NO: 30232 - RNA, 18 nt, Artificial Sequence
  Synthetic
ccgcagaggaagaggcgg

SEQ ID NO: 30233 - RNA, 19 nt, Artificial Sequence
  Synthetic
cccgcagaggaagaggcgg

SEQ ID NO: 30234 - RNA, 20 nt, Artificial Sequence
  Synthetic
gcccgcagaggaagaggcgg

SEQ ID NO: 30235 - RNA, 21 nt, Artificial Sequence
  Synthetic
cgcccgcagaggaagaggcgg

SEQ ID NO: 30236 - RNA, 22 nt, Artificial Sequence
  Synthetic
ccgcccgcagaggaagaggcgg

SEQ ID NO: 30237 - RNA, 23 nt, Artificial Sequence
  Synthetic
cccgcccgcagaggaagaggcgg

SEQ ID NO: 30238 - RNA, 24 nt, Artificial Sequence
  Synthetic
ccccgcccgcagaggaagaggcgg

SEQ ID NO: 30239 - RNA, 18 nt, Artificial Sequence
  Synthetic
cggaggaggaggaggcgg

SEQ ID NO: 30240 - RNA, 19 nt, Artificial Sequence
  Synthetic
gcggaggaggaggaggcgg

SEQ ID NO: 30241 - RNA, 20 nt, Artificial Sequence
  Synthetic
ggcggaggaggaggaggcgg

SEQ ID NO: 30242 - RNA, 21 nt, Artificial Sequence
  Synthetic
aggcggaggaggaggaggcgg

SEQ ID NO: 30243 - RNA, 22 nt, Artificial Sequence
  Synthetic
gaggcggaggaggaggaggcgg

SEQ ID NO: 30244 - RNA, 23 nt, Artificial Sequence
  Synthetic
agaggcggaggaggaggaggcgg

SEQ ID NO: 30245 - RNA, 24 nt, Artificial Sequence
  Synthetic
aagaggcggaggaggaggaggcgg

SEQ ID NO: 30246 - RNA, 23 nt, Artificial Sequence
  Synthetic
ggaggcggaggaggaggaggcgg

SEQ ID NO: 30247 - RNA, 24 nt, Artificial Sequence
  Synthetic
aggaggcggaggaggaggaggcgg

SEQ ID NO: 30248 - RNA, 18 nt, Artificial Sequence
  Synthetic
gcggcgcggagacggcgg

SEQ ID NO: 30249 - RNA, 19 nt, Artificial Sequence
  Synthetic
ggcggcgcggagacggcgg

SEQ ID NO: 30250 - RNA, 20 nt, Artificial Sequence
  Synthetic
gggcggcgcggagacggcgg

SEQ ID NO: 30251 - RNA, 21 nt, Artificial Sequence
  Synthetic
ggggcggcgcggagacggcgg

SEQ ID NO: 30252 - RNA, 22 nt, Artificial Sequence
  Synthetic
cggggcggcgcggagacggcgg

SEQ ID NO: 30253 - RNA, 23 nt, Artificial Sequence
  Synthetic
gcggggcggcgcggagacggcgg

SEQ ID NO: 30254 - RNA, 24 nt, Artificial Sequence
  Synthetic
cgcggggcggcgcggagacggcgg

SEQ ID NO: 30255 - RNA, 18 nt, Artificial Sequence
  Synthetic
gcgagcgcggggcggcgg

SEQ ID NO: 30256 - RNA, 19 nt, Artificial Sequence
  Synthetic
ggcgagcgcggggcggcgg

SEQ ID NO: 30257 - RNA, 20 nt, Artificial Sequence
  Synthetic
gggcgagcgcggggcggcgg

SEQ ID NO: 30258 - RNA, 21 nt, Artificial Sequence
  Synthetic
ggggcgagcgcggggcggcgg

SEQ ID NO: 30259 - RNA, 22 nt, Artificial Sequence
  Synthetic
aggggcgagcgcggggcggcgg

SEQ ID NO: 30260 - RNA, 23 nt, Artificial Sequence
  Synthetic
gaggggcgagcgcggggcggcgg

SEQ ID NO: 30261 - RNA, 24 nt, Artificial Sequence
  Synthetic
cgaggggcgagcgcggggcggcgg

SEQ ID NO: 30262 - RNA, 18 nt, Artificial Sequence
  Synthetic
ggggcgagcgcggggcgg

SEQ ID NO: 30263 - RNA, 19 nt, Artificial Sequence
  Synthetic
aggggcgagcgcggggcgg

SEQ ID NO: 30264 - RNA, 20 nt, Artificial Sequence
  Synthetic
gaggggcgagcgcggggcgg

SEQ ID NO: 30265 - RNA, 21 nt, Artificial Sequence
  Synthetic
cgaggggcgagcgcggggcgg

SEQ ID NO: 30266 - RNA, 22 nt, Artificial Sequence
  Synthetic
gcgaggggcgagcgcggggcgg

SEQ ID NO: 30267 - RNA, 23 nt, Artificial Sequence
  Synthetic
ggcgaggggcgagcgcggggcgg

SEQ ID NO: 30268 - RNA, 24 nt, Artificial Sequence
  Synthetic
gggcgaggggcgagcgcggggcgg

SEQ ID NO: 30269 - RNA, 18 nt, Artificial Sequence
  Synthetic
gcgcucuucggggggcgg

SEQ ID NO: 30270 - RNA, 19 nt, Artificial Sequence
  Synthetic
ggcgcucuucggggggcgg

SEQ ID NO: 30271 - RNA, 20 nt, Artificial Sequence
  Synthetic
gggcgcucuucggggggcgg

SEQ ID NO: 30272 - RNA, 21 nt, Artificial Sequence
  Synthetic
ggggcgcucuucggggggcgg

SEQ ID NO: 30273 - RNA, 22 nt, Artificial Sequence
  Synthetic
cggggcgcucuucggggggcgg

SEQ ID NO: 30274 - RNA, 23 nt, Artificial Sequence
  Synthetic
ccggggcgcucuucggggggcgg

SEQ ID NO: 30275 - RNA, 24 nt, Artificial Sequence
  Synthetic
gccggggcgcucuucggggggcgg

SEQ ID NO: 30276 - RNA, 18 nt, Artificial Sequence
  Synthetic
ccgaggacaccugugcgg

SEQ ID NO: 30277 - RNA, 19 nt, Artificial Sequence
  Synthetic
cccgaggacaccugugcgg

SEQ ID NO: 30278 - RNA, 20 nt, Artificial Sequence
  Synthetic
gcccgaggacaccugugcgg

SEQ ID NO: 30279 - RNA, 21 nt, Artificial Sequence
  Synthetic
ggcccgaggacaccugugcgg

SEQ ID NO: 30280 - RNA, 22 nt, Artificial Sequence
  Synthetic
gggcccgaggacaccugugcgg

SEQ ID NO: 30281 - RNA, 23 nt, Artificial Sequence
  Synthetic
ggggcccgaggacaccugugcgg

SEQ ID NO: 30282 - RNA, 24 nt, Artificial Sequence
  Synthetic
cggggcccgaggacaccugugcgg

SEQ ID NO: 30283 - RNA, 18 nt, Artificial Sequence
  Synthetic
cccccuggggggcgaggg

SEQ ID NO: 30284 - RNA, 19 nt, Artificial Sequence
  Synthetic
acccccuggggggcgaggg

SEQ ID NO: 30285 - RNA, 20 nt, Artificial Sequence
  Synthetic
cacccccuggggggcgaggg

SEQ ID NO: 30286 - RNA, 21 nt, Artificial Sequence
  Synthetic
ccacccccuggggggcgaggg

SEQ ID NO: 30287 - RNA, 22 nt, Artificial Sequence
  Synthetic
cccacccccuggggggcgaggg

SEQ ID NO: 30288 - RNA, 23 nt, Artificial Sequence
  Synthetic
ccccacccccuggggggcgaggg

SEQ ID NO: 30289 - RNA, 24 nt, Artificial Sequence
  Synthetic
cccccacccccuggggggcgaggg

SEQ ID NO: 30290 - RNA, 18 nt, Artificial Sequence
  Synthetic
gcgcccgcggacgccggg

SEQ ID NO: 30291 - RNA, 19 nt, Artificial Sequence
  Synthetic
ggcgcccgcggacgccggg

SEQ ID NO: 30292 - RNA, 20 nt, Artificial Sequence
  Synthetic
cggcgcccgcggacgccggg

SEQ ID NO: 30293 - RNA, 21 nt, Artificial Sequence
  Synthetic
gcggcgcccgcggacgccggg

SEQ ID NO: 30294 - RNA, 22 nt, Artificial Sequence
  Synthetic
cgcggcgcccgcggacgccggg

SEQ ID NO: 30295 - RNA, 23 nt, Artificial Sequence
  Synthetic
gcgcggcgcccgcggacgccggg

SEQ ID NO: 30296 - RNA, 24 nt, Artificial Sequence
  Synthetic
ggcgcggcgcccgcggacgccggg

SEQ ID NO: 30297 - RNA, 18 nt, Artificial Sequence
  Synthetic
gggcggcggcggcgcggg

SEQ ID NO: 30298 - RNA, 19 nt, Artificial Sequence
  Synthetic
ggggcggcggcggcgcggg

SEQ ID NO: 30299 - RNA, 20 nt, Artificial Sequence
  Synthetic
gggggcggcggcggcgcggg

SEQ ID NO: 30300 - RNA, 21 nt, Artificial Sequence
  Synthetic
cgggggcggcggcggcgcggg

SEQ ID NO: 30301 - RNA, 22 nt, Artificial Sequence
  Synthetic
acgggggcggcggcggcgcggg

SEQ ID NO: 30302 - RNA, 23 nt, Artificial Sequence
  Synthetic
cacgggggcggcggcggcgcggg

SEQ ID NO: 30303 - RNA, 24 nt, Artificial Sequence
  Synthetic
ccacgggggcggcggcggcgcggg

SEQ ID NO: 30304 - RNA, 18 nt, Artificial Sequence
  Synthetic
cggucgggucgcggcggg

SEQ ID NO: 30305 - RNA, 19 nt, Artificial Sequence
  Synthetic
ccggucgggucgcggcggg

SEQ ID NO: 30306 - RNA, 20 nt, Artificial Sequence
  Synthetic
gccggucgggucgcggcggg

SEQ ID NO: 30307 - RNA, 21 nt, Artificial Sequence
  Synthetic
cgccggucgggucgcggcggg

SEQ ID NO: 30308 - RNA, 22 nt, Artificial Sequence
  Synthetic
gcgccggucgggucgcggcggg

SEQ ID NO: 30309 - RNA, 23 nt, Artificial Sequence
  Synthetic
ggcgccggucgggucgcggcggg

SEQ ID NO: 30310 - RNA, 24 nt, Artificial Sequence
  Synthetic
gggcgccggucgggucgcggcggg

SEQ ID NO: 30311 - RNA, 18 nt, Artificial Sequence
  Synthetic
cgcucuucggggggcggg

SEQ ID NO: 30312 - RNA, 19 nt, Artificial Sequence
  Synthetic
gcgcucuucggggggcggg

SEQ ID NO: 30313 - RNA, 20 nt, Artificial Sequence
  Synthetic
ggcgcucuucggggggcggg

SEQ ID NO: 30314 - RNA, 21 nt, Artificial Sequence
  Synthetic
gggcgcucuucggggggcggg

SEQ ID NO: 30315 - RNA, 22 nt, Artificial Sequence
  Synthetic
ggggcgcucuucggggggcggg

SEQ ID NO: 30316 - RNA, 23 nt, Artificial Sequence
  Synthetic
cggggcgcucuucggggggcggg

SEQ ID NO: 30317 - RNA, 24 nt, Artificial Sequence
  Synthetic
ccggggcgcucuucggggggcggg

SEQ ID NO: 30318 - RNA, 18 nt, Artificial Sequence
  Synthetic
cccgcgccucuuccgggg

SEQ ID NO: 30319 - RNA, 19 nt, Artificial Sequence
  Synthetic
acccgcgccucuuccgggg

SEQ ID NO: 30320 - RNA, 20 nt, Artificial Sequence
  Synthetic
gacccgcgccucuuccgggg

SEQ ID NO: 30321 - RNA, 21 nt, Artificial Sequence
  Synthetic
cgacccgcgccucuuccgggg

SEQ ID NO: 30322 - RNA, 22 nt, Artificial Sequence
  Synthetic
ccgacccgcgccucuuccgggg

SEQ ID NO: 30323 - RNA, 23 nt, Artificial Sequence
  Synthetic
uccgacccgcgccucuuccgggg

SEQ ID NO: 30324 - RNA, 24 nt, Artificial Sequence
  Synthetic
guccgacccgcgccucuuccgggg

SEQ ID NO: 30325 - RNA, 18 nt, Artificial Sequence
  Synthetic
cccgccggccgcaggggg

SEQ ID NO: 30326 - RNA, 19 nt, Artificial Sequence
  Synthetic
ccccgccggccgcaggggg

SEQ ID NO: 30327 - RNA, 20 nt, Artificial Sequence
  Synthetic
cccccgccggccgcaggggg

SEQ ID NO: 30328 - RNA, 21 nt, Artificial Sequence
  Synthetic
ccccccgccggccgcaggggg

SEQ ID NO: 30329 - RNA, 22 nt, Artificial Sequence
  Synthetic
gccccccgccggccgcaggggg

SEQ ID NO: 30330 - RNA, 23 nt, Artificial Sequence
  Synthetic
cgccccccgccggccgcaggggg

SEQ ID NO: 30331 - RNA, 24 nt, Artificial Sequence
  Synthetic
gcgccccccgccggccgcaggggg

SEQ ID NO: 30332 - RNA, 18 nt, Artificial Sequence
  Synthetic
ggcgcagcagcgcggggg

SEQ ID NO: 30333 - RNA, 19 nt, Artificial Sequence
  Synthetic
cggcgcagcagcgcggggg

SEQ ID NO: 30334 - RNA, 20 nt, Artificial Sequence
  Synthetic
gcggcgcagcagcgcggggg

SEQ ID NO: 30335 - RNA, 21 nt, Artificial Sequence
  Synthetic
cgcggcgcagcagcgcggggg

SEQ ID NO: 30336 - RNA, 22 nt, Artificial Sequence
  Synthetic
ccgcggcgcagcagcgcggggg

SEQ ID NO: 30337 - RNA, 23 nt, Artificial Sequence
  Synthetic
cccgcggcgcagcagcgcggggg

SEQ ID NO: 30338 - RNA, 24 nt, Artificial Sequence
  Synthetic
ccccgcggcgcagcagcgcggggg

SEQ ID NO: 30339 - RNA, 18 nt, Artificial Sequence
  Synthetic
cggggcgcucuucggggg

SEQ ID NO: 30340 - RNA, 19 nt, Artificial Sequence
  Synthetic
ccggggcgcucuucggggg

SEQ ID NO: 30341 - RNA, 20 nt, Artificial Sequence
  Synthetic
gccggggcgcucuucggggg

SEQ ID NO: 30342 - RNA, 21 nt, Artificial Sequence
  Synthetic
cgccggggcgcucuucggggg

SEQ ID NO: 30343 - RNA, 22 nt, Artificial Sequence
  Synthetic
gcgccggggcgcucuucggggg

SEQ ID NO: 30344 - RNA, 23 nt, Artificial Sequence
  Synthetic
cgcgccggggcgcucuucggggg

SEQ ID NO: 30345 - RNA, 24 nt, Artificial Sequence
  Synthetic
ccgcgccggggcgcucuucggggg

SEQ ID NO: 30346 - RNA, 18 nt, Artificial Sequence
  Synthetic
gugccgggccacgggggg

SEQ ID NO: 30347 - RNA, 19 nt, Artificial Sequence
  Synthetic
cgugccgggccacgggggg

SEQ ID NO: 30348 - RNA, 20 nt, Artificial Sequence
  Synthetic
ccgugccgggccacgggggg

SEQ ID NO: 30349 - RNA, 21 nt, Artificial Sequence
  Synthetic
uccgugccgggccacgggggg

SEQ ID NO: 30350 - RNA, 22 nt, Artificial Sequence
  Synthetic
guccgugccgggccacgggggg

SEQ ID NO: 30351 - RNA, 23 nt, Artificial Sequence
  Synthetic
cguccgugccgggccacgggggg

SEQ ID NO: 30352 - RNA, 24 nt, Artificial Sequence
  Synthetic
ucguccgugccgggccacgggggg

SEQ ID NO: 30353 - RNA, 18 nt, Artificial Sequence
  Synthetic
gcccccacccccuggggg

SEQ ID NO: 30354 - RNA, 19 nt, Artificial Sequence
  Synthetic
ggcccccacccccuggggg

SEQ ID NO: 30355 - RNA, 20 nt, Artificial Sequence
  Synthetic
uggcccccacccccuggggg

SEQ ID NO: 30356 - RNA, 21 nt, Artificial Sequence
  Synthetic
uuggcccccacccccuggggg

SEQ ID NO: 30357 - RNA, 22 nt, Artificial Sequence
  Synthetic
cuuggcccccacccccuggggg

SEQ ID NO: 30358 - RNA, 23 nt, Artificial Sequence
  Synthetic
ucuuggcccccacccccuggggg

SEQ ID NO: 30359 - RNA, 24 nt, Artificial Sequence
  Synthetic
cucuuggcccccacccccuggggg

SEQ ID NO: 30360 - RNA, 18 nt, Artificial Sequence
  Synthetic
gagucgcugaugacuaug

SEQ ID NO: 30361 - RNA, 19 nt, Artificial Sequence
  Synthetic
agagucgcugaugacuaug

SEQ ID NO: 30362 - RNA, 20 nt, Artificial Sequence
  Synthetic
gagagucgcugaugacuaug

SEQ ID NO: 30363 - RNA, 21 nt, Artificial Sequence
  Synthetic
ggagagucgcugaugacuaug

SEQ ID NO: 30364 - RNA, 22 nt, Artificial Sequence
  Synthetic
gggagagucgcugaugacuaug

SEQ ID NO: 30365 - RNA, 23 nt, Artificial Sequence
  Synthetic
ggggagagucgcugaugacuaug

SEQ ID NO: 30366 - RNA, 24 nt, Artificial Sequence
  Synthetic
gggggagagucgcugaugacuaug

SEQ ID NO: 30367 - RNA, 18 nt, Artificial Sequence
  Synthetic
cuuggcccccacccccug

SEQ ID NO: 30368 - RNA, 19 nt, Artificial Sequence
  Synthetic
ucuuggcccccacccccug

SEQ ID NO: 30369 - RNA, 20 nt, Artificial Sequence
  Synthetic
cucuuggcccccacccccug

SEQ ID NO: 30370 - RNA, 21 nt, Artificial Sequence
  Synthetic
ccucuuggcccccacccccug

SEQ ID NO: 30371 - RNA, 22 nt, Artificial Sequence
  Synthetic
cccucuuggcccccacccccug

SEQ ID NO: 30372 - RNA, 23 nt, Artificial Sequence
  Synthetic
gcccucuuggcccccacccccug

SEQ ID NO: 30373 - RNA, 24 nt, Artificial Sequence
  Synthetic
cgcccucuuggcccccacccccug

SEQ ID NO: 30374 - RNA, 18 nt, Artificial Sequence
  Synthetic
ucguccucgucguccgug

SEQ ID NO: 30375 - RNA, 19 nt, Artificial Sequence
  Synthetic
aucguccucgucguccgug

SEQ ID NO: 30376 - RNA, 20 nt, Artificial Sequence
  Synthetic
caucguccucgucguccgug

SEQ ID NO: 30377 - RNA, 21 nt, Artificial Sequence
  Synthetic
ucaucguccucgucguccgug

SEQ ID NO: 30378 - RNA, 22 nt, Artificial Sequence
  Synthetic
gucaucguccucgucguccgug

SEQ ID NO: 30379 - RNA, 23 nt, Artificial Sequence
  Synthetic
ggucaucguccucgucguccgug

SEQ ID NO: 30380 - RNA, 24 nt, Artificial Sequence
  Synthetic
aggucaucguccucgucguccgug

SEQ ID NO: 30381 - RNA, 18 nt, Artificial Sequence
  Synthetic
cgcccccuccgcggcgug

SEQ ID NO: 30382 - RNA, 19 nt, Artificial Sequence
  Synthetic
ccgcccccuccgcggcgug

SEQ ID NO: 30383 - RNA, 20 nt, Artificial Sequence
  Synthetic
gccgcccccuccgcggcgug

SEQ ID NO: 30384 - RNA, 21 nt, Artificial Sequence
  Synthetic
cgccgcccccuccgcggcgug

SEQ ID NO: 30385 - RNA, 22 nt, Artificial Sequence
  Synthetic
ccgccgcccccuccgcggcgug

SEQ ID NO: 30386 - RNA, 23 nt, Artificial Sequence
  Synthetic
gccgccgcccccuccgcggcgug

SEQ ID NO: 30387 - RNA, 24 nt, Artificial Sequence
  Synthetic
ggccgccgcccccuccgcggcgug

SEQ ID NO: 30388 - RNA, 18 nt, Artificial Sequence
  Synthetic
uucacuaucgggauggug

SEQ ID NO: 30389 - RNA, 19 nt, Artificial Sequence
  Synthetic
guucacuaucgggauggug

SEQ ID NO: 30390 - RNA, 20 nt, Artificial Sequence
  Synthetic
cguucacuaucgggauggug

SEQ ID NO: 30391 - RNA, 21 nt, Artificial Sequence
  Synthetic
ucguucacuaucgggauggug

SEQ ID NO: 30392 - RNA, 22 nt, Artificial Sequence
  Synthetic
gucguucacuaucgggauggug

SEQ ID NO: 30393 - RNA, 23 nt, Artificial Sequence
  Synthetic
ggucguucacuaucgggauggug

SEQ ID NO: 30394 - RNA, 24 nt, Artificial Sequence
  Synthetic
gggucguucacuaucgggauggug

SEQ ID NO: 30395 - RNA, 18 nt, Artificial Sequence
  Synthetic
ggcccgaggacaccugug

SEQ ID NO: 30396 - RNA, 19 nt, Artificial Sequence
  Synthetic
gggcccgaggacaccugug

SEQ ID NO: 30397 - RNA, 20 nt, Artificial Sequence
  Synthetic
ggggcccgaggacaccugug

SEQ ID NO: 30398 - RNA, 21 nt, Artificial Sequence
  Synthetic
cggggcccgaggacaccugug

SEQ ID NO: 30399 - RNA, 22 nt, Artificial Sequence
  Synthetic
ccggggcccgaggacaccugug

SEQ ID NO: 30400 - RNA, 23 nt, Artificial Sequence
  Synthetic
cccggggcccgaggacaccugug

SEQ ID NO: 30401 - RNA, 24 nt, Artificial Sequence
  Synthetic
ccccggggcccgaggacaccugug

SEQ ID NO: 30402 - RNA, 18 nt, Artificial Sequence
  Synthetic
agagucgcugaugacuau

SEQ ID NO: 30403 - RNA, 19 nt, Artificial Sequence
  Synthetic
gagagucgcugaugacuau

SEQ ID NO: 30404 - RNA, 20 nt, Artificial Sequence
  Synthetic
ggagagucgcugaugacuau

SEQ ID NO: 30405 - RNA, 21 nt, Artificial Sequence
  Synthetic
gggagagucgcugaugacuau

SEQ ID NO: 30406 - RNA, 22 nt, Artificial Sequence
  Synthetic
ggggagagucgcugaugacuau

SEQ ID NO: 30407 - RNA, 23 nt, Artificial Sequence
  Synthetic
gggggagagucgcugaugacuau

SEQ ID NO: 30408 - RNA, 24 nt, Artificial Sequence
  Synthetic
cgggggagagucgcugaugacuau

SEQ ID NO: 30409 - RNA, 18 nt, Artificial Sequence
  Synthetic
ggcggcgcggggcggacu

SEQ ID NO: 30410 - RNA, 19 nt, Artificial Sequence
  Synthetic
cggcggcgcggggcggacu

SEQ ID NO: 30411 - RNA, 20 nt, Artificial Sequence
  Synthetic
gcggcggcgcggggcggacu

SEQ ID NO: 30412 - RNA, 21 nt, Artificial Sequence
  Synthetic
ggcggcggcgcggggcggacu

SEQ ID NO: 30413 - RNA, 22 nt, Artificial Sequence
  Synthetic
cggcggcggcgcggggcggacu

SEQ ID NO: 30414 - RNA, 23 nt, Artificial Sequence
  Synthetic
gcggcggcggcgcggggcggacu

SEQ ID NO: 30415 - RNA, 24 nt, Artificial Sequence
  Synthetic
ggcggcggcggcgcggggcggacu

SEQ ID NO: 30416 - RNA, 18 nt, Artificial Sequence
  Synthetic
ggagagucgcugaugacu

SEQ ID NO: 30417 - RNA, 19 nt, Artificial Sequence
  Synthetic
gggagagucgcugaugacu

SEQ ID NO: 30418 - RNA, 20 nt, Artificial Sequence
  Synthetic
ggggagagucgcugaugacu

SEQ ID NO: 30419 - RNA, 21 nt, Artificial Sequence
  Synthetic
gggggagagucgcugaugacu

SEQ ID NO: 30420 - RNA, 22 nt, Artificial Sequence
  Synthetic
cgggggagagucgcugaugacu

SEQ ID NO: 30421 - RNA, 23 nt, Artificial Sequence
  Synthetic
gcgggggagagucgcugaugacu

SEQ ID NO: 30422 - RNA, 24 nt, Artificial Sequence
  Synthetic
ggcgggggagagucgcugaugacu

SEQ ID NO: 30423 - RNA, 18 nt, Artificial Sequence
  Synthetic
ucuuggcccccacccccu

SEQ ID NO: 30424 - RNA, 19 nt, Artificial Sequence
  Synthetic
cucuuggcccccacccccu

SEQ ID NO: 30425 - RNA, 20 nt, Artificial Sequence
  Synthetic
ccucuuggcccccacccccu

SEQ ID NO: 30426 - RNA, 21 nt, Artificial Sequence
  Synthetic
cccucuuggcccccacccccu

SEQ ID NO: 30427 - RNA, 22 nt, Artificial Sequence
  Synthetic
gcccucuuggcccccacccccu

SEQ ID NO: 30428 - RNA, 23 nt, Artificial Sequence
  Synthetic
cgcccucuuggcccccacccccu

SEQ ID NO: 30429 - RNA, 24 nt, Artificial Sequence
  Synthetic
ccgcccucuuggcccccacccccu

SEQ ID NO: 30430 - RNA, 18 nt, Artificial Sequence
  Synthetic
ggucgcgggccccgggcu

SEQ ID NO: 30431 - RNA, 19 nt, Artificial Sequence
  Synthetic
gggucgcgggccccgggcu

SEQ ID NO: 30432 - RNA, 20 nt, Artificial Sequence
  Synthetic
cgggucgcgggccccgggcu

SEQ ID NO: 30433 - RNA, 21 nt, Artificial Sequence
  Synthetic
ccgggucgcgggccccgggcu

SEQ ID NO: 30434 - RNA, 22 nt, Artificial Sequence
  Synthetic
gccgggucgcgggccccgggcu

SEQ ID NO: 30435 - RNA, 23 nt, Artificial Sequence
  Synthetic
cgccgggucgcgggccccgggcu

SEQ ID NO: 30436 - RNA, 24 nt, Artificial Sequence
  Synthetic
gcgccgggucgcgggccccgggcu

SEQ ID NO: 30437 - RNA, 18 nt, Artificial Sequence
  Synthetic
gucgggucgcggcgggcu

SEQ ID NO: 30438 - RNA, 19 nt, Artificial Sequence
  Synthetic
ggucgggucgcggcgggcu

SEQ ID NO: 30439 - RNA, 20 nt, Artificial Sequence
  Synthetic
cggucgggucgcggcgggcu

SEQ ID NO: 30440 - RNA, 21 nt, Artificial Sequence
  Synthetic
ccggucgggucgcggcgggcu

SEQ ID NO: 30441 - RNA, 22 nt, Artificial Sequence
  Synthetic
gccggucgggucgcggcgggcu

SEQ ID NO: 30442 - RNA, 23 nt, Artificial Sequence
  Synthetic
cgccggucgggucgcggcgggcu

SEQ ID NO: 30443 - RNA, 24 nt, Artificial Sequence
  Synthetic
gcgccggucgggucgcggcgggcu

SEQ ID NO: 30444 - RNA, 18 nt, Artificial Sequence
  Synthetic
cgcaguugcgcgcgugcu

SEQ ID NO: 30445 - RNA, 19 nt, Artificial Sequence
  Synthetic
acgcaguugcgcgcgugcu

SEQ ID NO: 30446 - RNA, 20 nt, Artificial Sequence
  Synthetic
cacgcaguugcgcgcgugcu

SEQ ID NO: 30447 - RNA, 21 nt, Artificial Sequence
  Synthetic
ucacgcaguugcgcgcgugcu

SEQ ID NO: 30448 - RNA, 22 nt, Artificial Sequence
  Synthetic
cucacgcaguugcgcgcgugcu

SEQ ID NO: 30449 - RNA, 23 nt, Artificial Sequence
  Synthetic
ccucacgcaguugcgcgcgugcu

SEQ ID NO: 30450 - RNA, 24 nt, Artificial Sequence
  Synthetic
gccucacgcaguugcgcgcgugcu

SEQ ID NO: 30451 - RNA, 18 nt, Artificial Sequence
  Synthetic
cccgcgccggggcgcucu

SEQ ID NO: 30452 - RNA, 19 nt, Artificial Sequence
  Synthetic
ccccgcgccggggcgcucu

SEQ ID NO: 30453 - RNA, 20 nt, Artificial Sequence
  Synthetic
cccccgcgccggggcgcucu

SEQ ID NO: 30454 - RNA, 21 nt, Artificial Sequence
  Synthetic
gcccccgcgccggggcgcucu

SEQ ID NO: 30455 - RNA, 22 nt, Artificial Sequence
  Synthetic
cgcccccgcgccggggcgcucu

SEQ ID NO: 30456 - RNA, 23 nt, Artificial Sequence
  Synthetic
ccgcccccgcgccggggcgcucu

SEQ ID NO: 30457 - RNA, 24 nt, Artificial Sequence
  Synthetic
gccgcccccgcgccggggcgcucu

SEQ ID NO: 30458 - RNA, 18 nt, Artificial Sequence
  Synthetic
ggucgcccgaguccgagu

SEQ ID NO: 30459 - RNA, 19 nt, Artificial Sequence
  Synthetic
cggucgcccgaguccgagu

SEQ ID NO: 30460 - RNA, 20 nt, Artificial Sequence
  Synthetic
gcggucgcccgaguccgagu

SEQ ID NO: 30461 - RNA, 21 nt, Artificial Sequence
  Synthetic
cgcggucgcccgaguccgagu

SEQ ID NO: 30462 - RNA, 22 nt, Artificial Sequence
  Synthetic
ccgcggucgcccgaguccgagu

SEQ ID NO: 30463 - RNA, 23 nt, Artificial Sequence
  Synthetic
gccgcggucgcccgaguccgagu

SEQ ID NO: 30464 - RNA, 24 nt, Artificial Sequence
  Synthetic
ggccgcggucgcccgaguccgagu

SEQ ID NO: 30465 - RNA, 18 nt, Artificial Sequence
  Synthetic
cggggggcgucggguagu

SEQ ID NO: 30466 - RNA, 19 nt, Artificial Sequence
  Synthetic
gcggggggcgucggguagu

SEQ ID NO: 30467 - RNA, 20 nt, Artificial Sequence
  Synthetic
cgcggggggcgucggguagu

SEQ ID NO: 30468 - RNA, 21 nt, Artificial Sequence
  Synthetic
acgcggggggcgucggguagu

SEQ ID NO: 30469 - RNA, 22 nt, Artificial Sequence
  Synthetic
gacgcggggggcgucggguagu

SEQ ID NO: 30470 - RNA, 23 nt, Artificial Sequence
  Synthetic
cgacgcggggggcgucggguagu

SEQ ID NO: 30471 - RNA, 24 nt, Artificial Sequence
  Synthetic
ccgacgcggggggcgucggguagu

SEQ ID NO: 30472 - RNA, 18 nt, Artificial Sequence
  Synthetic
ccgcccccuccgcggcgu

SEQ ID NO: 30473 - RNA, 19 nt, Artificial Sequence
  Synthetic
gccgcccccuccgcggcgu

SEQ ID NO: 30474 - RNA, 20 nt, Artificial Sequence
  Synthetic
cgccgcccccuccgcggcgu

SEQ ID NO: 30475 - RNA, 21 nt, Artificial Sequence
  Synthetic
ccgccgcccccuccgcggcgu

SEQ ID NO: 30476 - RNA, 22 nt, Artificial Sequence
  Synthetic
gccgccgcccccuccgcggcgu

SEQ ID NO: 30477 - RNA, 23 nt, Artificial Sequence
  Synthetic
ggccgccgcccccuccgcggcgu

SEQ ID NO: 30478 - RNA, 24 nt, Artificial Sequence
  Synthetic
gggccgccgcccccuccgcggcgu

SEQ ID NO: 30479 - RNA, 18 nt, Artificial Sequence
  Synthetic
cugugcuugggugucggu

SEQ ID NO: 30480 - RNA, 19 nt, Artificial Sequence
  Synthetic
ucugugcuugggugucggu

SEQ ID NO: 30481 - RNA, 20 nt, Artificial Sequence
  Synthetic
cucugugcuugggugucggu

SEQ ID NO: 30482 - RNA, 21 nt, Artificial Sequence
  Synthetic
acucugugcuugggugucggu

SEQ ID NO: 30483 - RNA, 22 nt, Artificial Sequence
  Synthetic
gacucugugcuugggugucggu

SEQ ID NO: 30484 - RNA, 23 nt, Artificial Sequence
  Synthetic
agacucugugcuugggugucggu

SEQ ID NO: 30485 - RNA, 24 nt, Artificial Sequence
  Synthetic
cagacucugugcuugggugucggu

SEQ ID NO: 30486 - RNA, 18 nt, Artificial Sequence
  Synthetic
cucggccuccacgcgggu

SEQ ID NO: 30487 - RNA, 19 nt, Artificial Sequence
  Synthetic
ccucggccuccacgcgggu

SEQ ID NO: 30488 - RNA, 20 nt, Artificial Sequence
  Synthetic
gccucggccuccacgcgggu

SEQ ID NO: 30489 - RNA, 21 nt, Artificial Sequence
  Synthetic
cgccucggccuccacgcgggu

SEQ ID NO: 30490 - RNA, 22 nt, Artificial Sequence
  Synthetic
ccgccucggccuccacgcgggu

SEQ ID NO: 30491 - RNA, 23 nt, Artificial Sequence
  Synthetic
gccgccucggccuccacgcgggu

SEQ ID NO: 30492 - RNA, 24 nt, Artificial Sequence
  Synthetic
ggccgccucggccuccacgcgggu

SEQ ID NO: 30493 - RNA, 18 nt, Artificial Sequence
  Synthetic
gggcccgaggacaccugu

SEQ ID NO: 30494 - RNA, 19 nt, Artificial Sequence
  Synthetic
ggggcccgaggacaccugu

SEQ ID NO: 30495 - RNA, 20 nt, Artificial Sequence
  Synthetic
cggggcccgaggacaccugu

SEQ ID NO: 30496 - RNA, 21 nt, Artificial Sequence
  Synthetic
ccggggcccgaggacaccugu

SEQ ID NO: 30497 - RNA, 22 nt, Artificial Sequence
  Synthetic
cccggggcccgaggacaccugu

SEQ ID NO: 30498 - RNA, 23 nt, Artificial Sequence
  Synthetic
ccccggggcccgaggacaccugu

SEQ ID NO: 30499 - RNA, 24 nt, Artificial Sequence
  Synthetic
cccccggggcccgaggacaccugu

SEQ ID NO: 30500 - RNA, 18 nt, Artificial Sequence
  Synthetic
guccgacccgcgccucuu

SEQ ID NO: 30501 - RNA, 19 nt, Artificial Sequence
  Synthetic
aguccgacccgcgccucuu

SEQ ID NO: 30502 - RNA, 20 nt, Artificial Sequence
  Synthetic
gaguccgacccgcgccucuu

SEQ ID NO: 30503 - RNA, 21 nt, Artificial Sequence
  Synthetic
cgaguccgacccgcgccucuu

SEQ ID NO: 30504 - RNA, 22 nt, Artificial Sequence
  Synthetic
ccgaguccgacccgcgccucuu

SEQ ID NO: 30505 - RNA, 23 nt, Artificial Sequence
  Synthetic
cccgaguccgacccgcgccucuu

SEQ ID NO: 30506 - RNA, 24 nt, Artificial Sequence
  Synthetic
gcccgaguccgacccgcgccucuu

SEQ ID NO: 30507 - RNA, 18 nt, Artificial Sequence
  Synthetic
ccgcgccggggcgcucuu

SEQ ID NO: 30508 - RNA, 19 nt, Artificial Sequence
  Synthetic
cccgcgccggggcgcucuu

SEQ ID NO: 30509 - RNA, 20 nt, Artificial Sequence
  Synthetic
ccccgcgccggggcgcucuu

SEQ ID NO: 30510 - RNA, 21 nt, Artificial Sequence
  Synthetic
cccccgcgccggggcgcucuu

SEQ ID NO: 30511 - RNA, 22 nt, Artificial Sequence
  Synthetic
gcccccgcgccggggcgcucuu

SEQ ID NO: 30512 - RNA, 23 nt, Artificial Sequence
  Synthetic
cgcccccgcgccggggcgcucuu

SEQ ID NO: 30513 - RNA, 24 nt, Artificial Sequence
  Synthetic
ccgcccccgcgccggggcgcucuu

SEQ ID NO: 30514 - RNA, 18 nt, Artificial Sequence
  Synthetic
ccagggggugggggccaa

SEQ ID NO: 30515 - RNA, 19 nt, Artificial Sequence
  Synthetic
cccagggggugggggccaa

SEQ ID NO: 30516 - RNA, 20 nt, Artificial Sequence
  Synthetic
ccccagggggugggggccaa

SEQ ID NO: 30517 - RNA, 21 nt, Artificial Sequence
  Synthetic
cccccagggggugggggccaa

SEQ ID NO: 30518 - RNA, 22 nt, Artificial Sequence
  Synthetic
ccccccagggggugggggccaa

SEQ ID NO: 30519 - RNA, 23 nt, Artificial Sequence
  Synthetic
gccccccagggggugggggccaa

SEQ ID NO: 30520 - RNA, 24 nt, Artificial Sequence
  Synthetic
cgccccccagggggugggggccaa

SEQ ID NO: 30521 - RNA, 18 nt, Artificial Sequence
  Synthetic
acauggagacgggccaca

SEQ ID NO: 30522 - RNA, 19 nt, Artificial Sequence
  Synthetic
gacauggagacgggccaca

SEQ ID NO: 30523 - RNA, 20 nt, Artificial Sequence
  Synthetic
ggacauggagacgggccaca

SEQ ID NO: 30524 - RNA, 21 nt, Artificial Sequence
  Synthetic
uggacauggagacgggccaca

SEQ ID NO: 30525 - RNA, 22 nt, Artificial Sequence
  Synthetic
cuggacauggagacgggccaca

SEQ ID NO: 30526 - RNA, 23 nt, Artificial Sequence
  Synthetic
ccuggacauggagacgggccaca

SEQ ID NO: 30527 - RNA, 24 nt, Artificial Sequence
  Synthetic
uccuggacauggagacgggccaca

SEQ ID NO: 30528 - RNA, 18 nt, Artificial Sequence
  Synthetic
gccugcccguccuggaca

SEQ ID NO: 30529 - RNA, 19 nt, Artificial Sequence
  Synthetic
ugccugcccguccuggaca

SEQ ID NO: 30530 - RNA, 20 nt, Artificial Sequence
  Synthetic
cugccugcccguccuggaca

SEQ ID NO: 30531 - RNA, 21 nt, Artificial Sequence
  Synthetic
acugccugcccguccuggaca

SEQ ID NO: 30532 - RNA, 22 nt, Artificial Sequence
  Synthetic
gacugccugcccguccuggaca

SEQ ID NO: 30533 - RNA, 23 nt, Artificial Sequence
  Synthetic
ggacugccugcccguccuggaca

SEQ ID NO: 30534 - RNA, 24 nt, Artificial Sequence
  Synthetic
gggacugccugcccguccuggaca

SEQ ID NO: 30535 - RNA, 18 nt, Artificial Sequence
  Synthetic
cgacgcccccgcgggcca

SEQ ID NO: 30536 - RNA, 19 nt, Artificial Sequence
  Synthetic
gcgacgcccccgcgggcca

SEQ ID NO: 30537 - RNA, 20 nt, Artificial Sequence
  Synthetic
ggcgacgcccccgcgggcca

SEQ ID NO: 30538 - RNA, 21 nt, Artificial Sequence
  Synthetic
cggcgacgcccccgcgggcca

SEQ ID NO: 30539 - RNA, 22 nt, Artificial Sequence
  Synthetic
ccggcgacgcccccgcgggcca

SEQ ID NO: 30540 - RNA, 23 nt, Artificial Sequence
  Synthetic
gccggcgacgcccccgcgggcca

SEQ ID NO: 30541 - RNA, 24 nt, Artificial Sequence
  Synthetic
ggccggcgacgcccccgcgggcca

SEQ ID NO: 30542 - RNA, 18 nt, Artificial Sequence
  Synthetic
acgugaacaagacgguca

SEQ ID NO: 30543 - RNA, 19 nt, Artificial Sequence
  Synthetic
uacgugaacaagacgguca

SEQ ID NO: 30544 - RNA, 20 nt, Artificial Sequence
  Synthetic
uuacgugaacaagacgguca

SEQ ID NO: 30545 - RNA, 21 nt, Artificial Sequence
  Synthetic
cuuacgugaacaagacgguca

SEQ ID NO: 30546 - RNA, 22 nt, Artificial Sequence
  Synthetic
ccuuacgugaacaagacgguca

SEQ ID NO: 30547 - RNA, 23 nt, Artificial Sequence
  Synthetic
gccuuacgugaacaagacgguca

SEQ ID NO: 30548 - RNA, 24 nt, Artificial Sequence
  Synthetic
cgccuuacgugaacaagacgguca

SEQ ID NO: 30549 - RNA, 18 nt, Artificial Sequence
  Synthetic
ugguccucguggaccaga

SEQ ID NO: 30550 - RNA, 19 nt, Artificial Sequence
  Synthetic
gugguccucguggaccaga

SEQ ID NO: 30551 - RNA, 20 nt, Artificial Sequence
  Synthetic
cgugguccucguggaccaga

SEQ ID NO: 30552 - RNA, 21 nt, Artificial Sequence
  Synthetic
acgugguccucguggaccaga

SEQ ID NO: 30553 - RNA, 22 nt, Artificial Sequence
  Synthetic
uacgugguccucguggaccaga

SEQ ID NO: 30554 - RNA, 23 nt, Artificial Sequence
  Synthetic
cuacgugguccucguggaccaga

SEQ ID NO: 30555 - RNA, 24 nt, Artificial Sequence
  Synthetic
ccuacgugguccucguggaccaga

SEQ ID NO: 30556 - RNA, 18 nt, Artificial Sequence
  Synthetic
cgccccccacgccgcgga

SEQ ID NO: 30557 - RNA, 19 nt, Artificial Sequence
  Synthetic
ccgccccccacgccgcgga

SEQ ID NO: 30558 - RNA, 20 nt, Artificial Sequence
  Synthetic
gccgccccccacgccgcgga

SEQ ID NO: 30559 - RNA, 21 nt, Artificial Sequence
  Synthetic
ugccgccccccacgccgcgga

SEQ ID NO: 30560 - RNA, 22 nt, Artificial Sequence
  Synthetic
gugccgccccccacgccgcgga

SEQ ID NO: 30561 - RNA, 23 nt, Artificial Sequence
  Synthetic
ggugccgccccccacgccgcgga

SEQ ID NO: 30562 - RNA, 24 nt, Artificial Sequence
  Synthetic
cggugccgccccccacgccgcgga

SEQ ID NO: 30563 - RNA, 18 nt, Artificial Sequence
  Synthetic
gggagggccgggcgcgga

SEQ ID NO: 30564 - RNA, 19 nt, Artificial Sequence
  Synthetic
cgggagggccgggcgcgga

SEQ ID NO: 30565 - RNA, 20 nt, Artificial Sequence
  Synthetic
ucgggagggccgggcgcgga

SEQ ID NO: 30566 - RNA, 21 nt, Artificial Sequence
  Synthetic
gucgggagggccgggcgcgga

SEQ ID NO: 30567 - RNA, 22 nt, Artificial Sequence
  Synthetic
ggucgggagggccgggcgcgga

SEQ ID NO: 30568 - RNA, 23 nt, Artificial Sequence
  Synthetic
gggucgggagggccgggcgcgga

SEQ ID NO: 30569 - RNA, 24 nt, Artificial Sequence
  Synthetic
cgggucgggagggccgggcgcgga

SEQ ID NO: 30570 - RNA, 18 nt, Artificial Sequence
  Synthetic
gacgccccccgcgucgga

SEQ ID NO: 30571 - RNA, 19 nt, Artificial Sequence
  Synthetic
cgacgccccccgcgucgga

SEQ ID NO: 30572 - RNA, 20 nt, Artificial Sequence
  Synthetic
ccgacgccccccgcgucgga

SEQ ID NO: 30573 - RNA, 21 nt, Artificial Sequence
  Synthetic
cccgacgccccccgcgucgga

SEQ ID NO: 30574 - RNA, 22 nt, Artificial Sequence
  Synthetic
acccgacgccccccgcgucgga

SEQ ID NO: 30575 - RNA, 23 nt, Artificial Sequence
  Synthetic
uacccgacgccccccgcgucgga

SEQ ID NO: 30576 - RNA, 24 nt, Artificial Sequence
  Synthetic
cuacccgacgccccccgcgucgga

SEQ ID NO: 30577 - RNA, 18 nt, Artificial Sequence
  Synthetic
uucagcaccaucccgaua

SEQ ID NO: 30578 - RNA, 19 nt, Artificial Sequence
  Synthetic
guucagcaccaucccgaua

SEQ ID NO: 30579 - RNA, 20 nt, Artificial Sequence
  Synthetic
cguucagcaccaucccgaua

SEQ ID NO: 30580 - RNA, 21 nt, Artificial Sequence
  Synthetic
ucguucagcaccaucccgaua

SEQ ID NO: 30581 - RNA, 22 nt, Artificial Sequence
  Synthetic
gucguucagcaccaucccgaua

SEQ ID NO: 30582 - RNA, 23 nt, Artificial Sequence
  Synthetic
ggucguucagcaccaucccgaua

SEQ ID NO: 30583 - RNA, 24 nt, Artificial Sequence
  Synthetic
gggucguucagcaccaucccgaua

SEQ ID NO: 30584 - RNA, 18 nt, Artificial Sequence
  Synthetic
gccaggaagacgcgccac

SEQ ID NO: 30585 - RNA, 19 nt, Artificial Sequence
  Synthetic
ugccaggaagacgcgccac

SEQ ID NO: 30586 - RNA, 20 nt, Artificial Sequence
  Synthetic
gugccaggaagacgcgccac

SEQ ID NO: 30587 - RNA, 21 nt, Artificial Sequence
  Synthetic
ugugccaggaagacgcgccac

SEQ ID NO: 30588 - RNA, 22 nt, Artificial Sequence
  Synthetic
gugugccaggaagacgcgccac

SEQ ID NO: 30589 - RNA, 23 nt, Artificial Sequence
  Synthetic
agugugccaggaagacgcgccac

SEQ ID NO: 30590 - RNA, 24 nt, Artificial Sequence
  Synthetic
aagugugccaggaagacgcgccac

SEQ ID NO: 30591 - RNA, 18 nt, Artificial Sequence
  Synthetic
gacgcccccgcgggccac

SEQ ID NO: 30592 - RNA, 19 nt, Artificial Sequence
  Synthetic
cgacgcccccgcgggccac

SEQ ID NO: 30593 - RNA, 20 nt, Artificial Sequence
  Synthetic
gcgacgcccccgcgggccac

SEQ ID NO: 30594 - RNA, 21 nt, Artificial Sequence
  Synthetic
ggcgacgcccccgcgggccac

SEQ ID NO: 30595 - RNA, 22 nt, Artificial Sequence
  Synthetic
cggcgacgcccccgcgggccac

SEQ ID NO: 30596 - RNA, 23 nt, Artificial Sequence
  Synthetic
ccggcgacgcccccgcgggccac

SEQ ID NO: 30597 - RNA, 24 nt, Artificial Sequence
  Synthetic
gccggcgacgcccccgcgggccac

SEQ ID NO: 30598 - RNA, 18 nt, Artificial Sequence
  Synthetic
cgugaacaagacggucac

SEQ ID NO: 30599 - RNA, 19 nt, Artificial Sequence
  Synthetic
acgugaacaagacggucac

SEQ ID NO: 30600 - RNA, 20 nt, Artificial Sequence
  Synthetic
uacgugaacaagacggucac

SEQ ID NO: 30601 - RNA, 21 nt, Artificial Sequence
  Synthetic
uuacgugaacaagacggucac

SEQ ID NO: 30602 - RNA, 22 nt, Artificial Sequence
  Synthetic
cuuacgugaacaagacggucac

SEQ ID NO: 30603 - RNA, 23 nt, Artificial Sequence
  Synthetic
ccuuacgugaacaagacggucac

SEQ ID NO: 30604 - RNA, 24 nt, Artificial Sequence
  Synthetic
gccuuacgugaacaagacggucac

SEQ ID NO: 30605 - RNA, 18 nt, Artificial Sequence
  Synthetic
gguccucguggaccagac

SEQ ID NO: 30606 - RNA, 19 nt, Artificial Sequence
  Synthetic
ugguccucguggaccagac

SEQ ID NO: 30607 - RNA, 20 nt, Artificial Sequence
  Synthetic
gugguccucguggaccagac

SEQ ID NO: 30608 - RNA, 21 nt, Artificial Sequence
  Synthetic
cgugguccucguggaccagac

SEQ ID NO: 30609 - RNA, 22 nt, Artificial Sequence
  Synthetic
acgugguccucguggaccagac

SEQ ID NO: 30610 - RNA, 23 nt, Artificial Sequence
  Synthetic
uacgugguccucguggaccagac

SEQ ID NO: 30611 - RNA, 24 nt, Artificial Sequence
  Synthetic
cuacgugguccucguggaccagac

SEQ ID NO: 30612 - RNA, 18 nt, Artificial Sequence
  Synthetic
ccggcgcuggggagagac

SEQ ID NO: 30613 - RNA, 19 nt, Artificial Sequence
  Synthetic
uccggcgcuggggagagac

SEQ ID NO: 30614 - RNA, 20 nt, Artificial Sequence
  Synthetic
guccggcgcuggggagagac

SEQ ID NO: 30615 - RNA, 21 nt, Artificial Sequence
  Synthetic
cguccggcgcuggggagagac

SEQ ID NO: 30616 - RNA, 22 nt, Artificial Sequence
  Synthetic
gcguccggcgcuggggagagac

SEQ ID NO: 30617 - RNA, 23 nt, Artificial Sequence
  Synthetic
cgcguccggcgcuggggagagac

SEQ ID NO: 30618 - RNA, 24 nt, Artificial Sequence
  Synthetic
ccgcguccggcgcuggggagagac

SEQ ID NO: 30619 - RNA, 18 nt, Artificial Sequence
  Synthetic
uggcccggcacggacgac

SEQ ID NO: 30620 - RNA, 19 nt, Artificial Sequence
  Synthetic
guggcccggcacggacgac

SEQ ID NO: 30621 - RNA, 20 nt, Artificial Sequence
  Synthetic
cguggcccggcacggacgac

SEQ ID NO: 30622 - RNA, 21 nt, Artificial Sequence
  Synthetic
ccguggcccggcacggacgac

SEQ ID NO: 30623 - RNA, 22 nt, Artificial Sequence
  Synthetic
cccguggcccggcacggacgac

SEQ ID NO: 30624 - RNA, 23 nt, Artificial Sequence
  Synthetic
ccccguggcccggcacggacgac

SEQ ID NO: 30625 - RNA, 24 nt, Artificial Sequence
  Synthetic
cccccguggcccggcacggacgac

SEQ ID NO: 30626 - RNA, 18 nt, Artificial Sequence
  Synthetic
cgggcgcggagggaggac

SEQ ID NO: 30627 - RNA, 19 nt, Artificial Sequence
  Synthetic
ccgggcgcggagggaggac

SEQ ID NO: 30628 - RNA, 20 nt, Artificial Sequence
  Synthetic
gccgggcgcggagggaggac

SEQ ID NO: 30629 - RNA, 21 nt, Artificial Sequence
  Synthetic
ggccgggcgcggagggaggac

SEQ ID NO: 30630 - RNA, 22 nt, Artificial Sequence
  Synthetic
gggccgggcgcggagggaggac

SEQ ID NO: 30631 - RNA, 23 nt, Artificial Sequence
  Synthetic
agggccgggcgcggagggaggac

SEQ ID NO: 30632 - RNA, 24 nt, Artificial Sequence
  Synthetic
gagggccgggcgcggagggaggac

SEQ ID NO: 30633 - RNA, 18 nt, Artificial Sequence
  Synthetic
ccgcgccgggccccggac

SEQ ID NO: 30634 - RNA, 19 nt, Artificial Sequence
  Synthetic
gccgcgccgggccccggac

SEQ ID NO: 30635 - RNA, 20 nt, Artificial Sequence
  Synthetic
cgccgcgccgggccccggac

SEQ ID NO: 30636 - RNA, 21 nt, Artificial Sequence
  Synthetic
gcgccgcgccgggccccggac

SEQ ID NO: 30637 - RNA, 22 nt, Artificial Sequence
  Synthetic
ggcgccgcgccgggccccggac

SEQ ID NO: 30638 - RNA, 23 nt, Artificial Sequence
  Synthetic
cggcgccgcgccgggccccggac

SEQ ID NO: 30639 - RNA, 24 nt, Artificial Sequence
  Synthetic
gcggcgccgcgccgggccccggac

SEQ ID NO: 30640 - RNA, 18 nt, Artificial Sequence
  Synthetic
cgggccccggacucggac

SEQ ID NO: 30641 - RNA, 19 nt, Artificial Sequence
  Synthetic
ccgggccccggacucggac

SEQ ID NO: 30642 - RNA, 20 nt, Artificial Sequence
  Synthetic
gccgggccccggacucggac

SEQ ID NO: 30643 - RNA, 21 nt, Artificial Sequence
  Synthetic
cgccgggccccggacucggac

SEQ ID NO: 30644 - RNA, 22 nt, Artificial Sequence
  Synthetic
gcgccgggccccggacucggac

SEQ ID NO: 30645 - RNA, 23 nt, Artificial Sequence
  Synthetic
cgcgccgggccccggacucggac

SEQ ID NO: 30646 - RNA, 24 nt, Artificial Sequence
  Synthetic
ccgcgccgggccccggacucggac

SEQ ID NO: 30647 - RNA, 18 nt, Artificial Sequence
  Synthetic
aagaggcgcgggucggac

SEQ ID NO: 30648 - RNA, 19 nt, Artificial Sequence
  Synthetic
gaagaggcgcgggucggac

SEQ ID NO: 30649 - RNA, 20 nt, Artificial Sequence
  Synthetic
ggaagaggcgcgggucggac

SEQ ID NO: 30650 - RNA, 21 nt, Artificial Sequence
  Synthetic
cggaagaggcgcgggucggac

SEQ ID NO: 30651 - RNA, 22 nt, Artificial Sequence
  Synthetic
ccggaagaggcgcgggucggac

SEQ ID NO: 30652 - RNA, 23 nt, Artificial Sequence
  Synthetic
cccggaagaggcgcgggucggac

SEQ ID NO: 30653 - RNA, 24 nt, Artificial Sequence
  Synthetic
ccccggaagaggcgcgggucggac

SEQ ID NO: 30654 - RNA, 18 nt, Artificial Sequence
  Synthetic
ugccugcccguccuggac

SEQ ID NO: 30655 - RNA, 19 nt, Artificial Sequence
  Synthetic
cugccugcccguccuggac

SEQ ID NO: 30656 - RNA, 20 nt, Artificial Sequence
  Synthetic
acugccugcccguccuggac

SEQ ID NO: 30657 - RNA, 21 nt, Artificial Sequence
  Synthetic
gacugccugcccguccuggac

SEQ ID NO: 30658 - RNA, 22 nt, Artificial Sequence
  Synthetic
ggacugccugcccguccuggac

SEQ ID NO: 30659 - RNA, 23 nt, Artificial Sequence
  Synthetic
gggacugccugcccguccuggac

SEQ ID NO: 30660 - RNA, 24 nt, Artificial Sequence
  Synthetic
ggggacugccugcccguccuggac

SEQ ID NO: 30661 - RNA, 18 nt, Artificial Sequence
  Synthetic
ggcaacaugcucuuugac

SEQ ID NO: 30662 - RNA, 19 nt, Artificial Sequence
  Synthetic
gggcaacaugcucuuugac

SEQ ID NO: 30663 - RNA, 20 nt, Artificial Sequence
  Synthetic
ugggcaacaugcucuuugac

SEQ ID NO: 30664 - RNA, 21 nt, Artificial Sequence
  Synthetic
gugggcaacaugcucuuugac

SEQ ID NO: 30665 - RNA, 22 nt, Artificial Sequence
  Synthetic
ggugggcaacaugcucuuugac

SEQ ID NO: 30666 - RNA, 23 nt, Artificial Sequence
  Synthetic
cggugggcaacaugcucuuugac

SEQ ID NO: 30667 - RNA, 24 nt, Artificial Sequence
  Synthetic
ccggugggcaacaugcucuuugac

SEQ ID NO: 30668 - RNA, 18 nt, Artificial Sequence
  Synthetic
guggcccuggcgccuuac

SEQ ID NO: 30669 - RNA, 19 nt, Artificial Sequence
  Synthetic
cguggcccuggcgccuuac

SEQ ID NO: 30670 - RNA, 20 nt, Artificial Sequence
  Synthetic
ucguggcccuggcgccuuac

SEQ ID NO: 30671 - RNA, 21 nt, Artificial Sequence
  Synthetic
gucguggcccuggcgccuuac

SEQ ID NO: 30672 - RNA, 22 nt, Artificial Sequence
  Synthetic
cgucguggcccuggcgccuuac

SEQ ID NO: 30673 - RNA, 23 nt, Artificial Sequence
  Synthetic
gcgucguggcccuggcgccuuac

SEQ ID NO: 30674 - RNA, 24 nt, Artificial Sequence
  Synthetic
agcgucguggcccuggcgccuuac

SEQ ID NO: 30675 - RNA, 18 nt, Artificial Sequence
  Synthetic
uaucuggacgggcaaccc

SEQ ID NO: 30676 - RNA, 19 nt, Artificial Sequence
  Synthetic
uuaucuggacgggcaaccc

SEQ ID NO: 30677 - RNA, 20 nt, Artificial Sequence
  Synthetic
uuuaucuggacgggcaaccc

SEQ ID NO: 30678 - RNA, 21 nt, Artificial Sequence
  Synthetic
cuuuaucuggacgggcaaccc

SEQ ID NO: 30679 - RNA, 22 nt, Artificial Sequence
  Synthetic
acuuuaucuggacgggcaaccc

SEQ ID NO: 30680 - RNA, 23 nt, Artificial Sequence
  Synthetic
gacuuuaucuggacgggcaaccc

SEQ ID NO: 30681 - RNA, 24 nt, Artificial Sequence
  Synthetic
ggacuuuaucuggacgggcaaccc

SEQ ID NO: 30682 - RNA, 18 nt, Artificial Sequence
  Synthetic
cccgauagugaacgaccc

SEQ ID NO: 30683 - RNA, 19 nt, Artificial Sequence
  Synthetic
ucccgauagugaacgaccc

SEQ ID NO: 30684 - RNA, 20 nt, Artificial Sequence
  Synthetic
aucccgauagugaacgaccc

SEQ ID NO: 30685 - RNA, 21 nt, Artificial Sequence
  Synthetic
caucccgauagugaacgaccc

SEQ ID NO: 30686 - RNA, 22 nt, Artificial Sequence
  Synthetic
ccaucccgauagugaacgaccc

SEQ ID NO: 30687 - RNA, 23 nt, Artificial Sequence
  Synthetic
accaucccgauagugaacgaccc

SEQ ID NO: 30688 - RNA, 24 nt, Artificial Sequence
  Synthetic
caccaucccgauagugaacgaccc

SEQ ID NO: 30689 - RNA, 18 nt, Artificial Sequence
  Synthetic
gcggugcgggggcgaccc

SEQ ID NO: 30690 - RNA, 19 nt, Artificial Sequence
  Synthetic
ggcggugcgggggcgaccc

SEQ ID NO: 30691 - RNA, 20 nt, Artificial Sequence
  Synthetic
cggcggugcgggggcgaccc

SEQ ID NO: 30692 - RNA, 21 nt, Artificial Sequence
  Synthetic
gcggcggugcgggggcgaccc

SEQ ID NO: 30693 - RNA, 22 nt, Artificial Sequence
  Synthetic
ggcggcggugcgggggcgaccc

SEQ ID NO: 30694 - RNA, 23 nt, Artificial Sequence
  Synthetic
gggcggcggugcgggggcgaccc

SEQ ID NO: 30695 - RNA, 24 nt, Artificial Sequence
  Synthetic
ggggcggcggugcgggggcgaccc

SEQ ID NO: 30696 - RNA, 18 nt, Artificial Sequence
  Synthetic
gagggcaggacgcccccc

SEQ ID NO: 30697 - RNA, 19 nt, Artificial Sequence
  Synthetic
ggagggcaggacgcccccc

SEQ ID NO: 30698 - RNA, 20 nt, Artificial Sequence
  Synthetic
cggagggcaggacgcccccc

SEQ ID NO: 30699 - RNA, 21 nt, Artificial Sequence
  Synthetic
gcggagggcaggacgcccccc

SEQ ID NO: 30700 - RNA, 22 nt, Artificial Sequence
  Synthetic
ggcggagggcaggacgcccccc

SEQ ID NO: 30701 - RNA, 23 nt, Artificial Sequence
  Synthetic
cggcggagggcaggacgcccccc

SEQ ID NO: 30702 - RNA, 24 nt, Artificial Sequence
  Synthetic
gcggcggagggcaggacgcccccc

SEQ ID NO: 30703 - RNA, 18 nt, Artificial Sequence
  Synthetic
gcucgccccucgcccccc

SEQ ID NO: 30704 - RNA, 19 nt, Artificial Sequence
  Synthetic
cgcucgccccucgcccccc

SEQ ID NO: 30705 - RNA, 20 nt, Artificial Sequence
  Synthetic
gcgcucgccccucgcccccc

SEQ ID NO: 30706 - RNA, 21 nt, Artificial Sequence
  Synthetic
cgcgcucgccccucgcccccc

SEQ ID NO: 30707 - RNA, 22 nt, Artificial Sequence
  Synthetic
ccgcgcucgccccucgcccccc

SEQ ID NO: 30708 - RNA, 23 nt, Artificial Sequence
  Synthetic
cccgcgcucgccccucgcccccc

SEQ ID NO: 30709 - RNA, 24 nt, Artificial Sequence
  Synthetic
ccccgcgcucgccccucgcccccc

SEQ ID NO: 30710 - RNA, 18 nt, Artificial Sequence
  Synthetic
ccggccggcgacgccccc

SEQ ID NO: 30711 - RNA, 19 nt, Artificial Sequence
  Synthetic
gccggccggcgacgccccc

SEQ ID NO: 30712 - RNA, 20 nt, Artificial Sequence
  Synthetic
cgccggccggcgacgccccc

SEQ ID NO: 30713 - RNA, 21 nt, Artificial Sequence
  Synthetic
gcgccggccggcgacgccccc

SEQ ID NO: 30714 - RNA, 22 nt, Artificial Sequence
  Synthetic
cgcgccggccggcgacgccccc

SEQ ID NO: 30715 - RNA, 23 nt, Artificial Sequence
  Synthetic
ccgcgccggccggcgacgccccc

SEQ ID NO: 30716 - RNA, 24 nt, Artificial Sequence
  Synthetic
cccgcgccggccggcgacgccccc

SEQ ID NO: 30717 - RNA, 18 nt, Artificial Sequence
  Synthetic
cgcucgccccucgccccc

SEQ ID NO: 30718 - RNA, 19 nt, Artificial Sequence
  Synthetic
gcgcucgccccucgccccc

SEQ ID NO: 30719 - RNA, 20 nt, Artificial Sequence
  Synthetic
cgcgcucgccccucgccccc

SEQ ID NO: 30720 - RNA, 21 nt, Artificial Sequence
  Synthetic
ccgcgcucgccccucgccccc

SEQ ID NO: 30721 - RNA, 22 nt, Artificial Sequence
  Synthetic
cccgcgcucgccccucgccccc

SEQ ID NO: 30722 - RNA, 23 nt, Artificial Sequence
  Synthetic
ccccgcgcucgccccucgccccc

SEQ ID NO: 30723 - RNA, 24 nt, Artificial Sequence
  Synthetic
gccccgcgcucgccccucgccccc

SEQ ID NO: 30724 - RNA, 18 nt, Artificial Sequence
  Synthetic
cuacgucccgcccgcccc

SEQ ID NO: 30725 - RNA, 19 nt, Artificial Sequence
  Synthetic
acuacgucccgcccgcccc

SEQ ID NO: 30726 - RNA, 20 nt, Artificial Sequence
  Synthetic
gacuacgucccgcccgcccc

SEQ ID NO: 30727 - RNA, 18 nt, Artificial Sequence
  Synthetic
ggggcggcggcccgcccc

SEQ ID NO: 30728 - RNA, 19 nt, Artificial Sequence
  Synthetic
gggggcggcggcccgcccc

SEQ ID NO: 30729 - RNA, 20 nt, Artificial Sequence
  Synthetic
agggggcggcggcccgcccc

SEQ ID NO: 30730 - RNA, 21 nt, Artificial Sequence
  Synthetic
gagggggcggcggcccgcccc

SEQ ID NO: 30731 - RNA, 22 nt, Artificial Sequence
  Synthetic
ggagggggcggcggcccgcccc

SEQ ID NO: 30732 - RNA, 23 nt, Artificial Sequence
  Synthetic
cggagggggcggcggcccgcccc

SEQ ID NO: 30733 - RNA, 24 nt, Artificial Sequence
  Synthetic
gcggagggggcggcggcccgcccc

SEQ ID NO: 30734 - RNA, 18 nt, Artificial Sequence
  Synthetic
ccgucuccgcgccgcccc

SEQ ID NO: 30735 - RNA, 19 nt, Artificial Sequence
  Synthetic
gccgucuccgcgccgcccc

SEQ ID NO: 30736 - RNA, 20 nt, Artificial Sequence
  Synthetic
cgccgucuccgcgccgcccc

SEQ ID NO: 30737 - RNA, 21 nt, Artificial Sequence
  Synthetic
ccgccgucuccgcgccgcccc

SEQ ID NO: 30738 - RNA, 22 nt, Artificial Sequence
  Synthetic
cccgccgucuccgcgccgcccc

SEQ ID NO: 30739 - RNA, 23 nt, Artificial Sequence
  Synthetic
ccccgccgucuccgcgccgcccc

SEQ ID NO: 30740 - RNA, 24 nt, Artificial Sequence
  Synthetic
cccccgccgucuccgcgccgcccc

SEQ ID NO: 30741 - RNA, 18 nt, Artificial Sequence
  Synthetic
ggcgcccccuggcgcccc

SEQ ID NO: 30742 - RNA, 19 nt, Artificial Sequence
  Synthetic
cggcgcccccuggcgcccc

SEQ ID NO: 30743 - RNA, 20 nt, Artificial Sequence
  Synthetic
ccggcgcccccuggcgcccc

SEQ ID NO: 30744 - RNA, 21 nt, Artificial Sequence
  Synthetic
accggcgcccccuggcgcccc

SEQ ID NO: 30745 - RNA, 22 nt, Artificial Sequence
  Synthetic
gaccggcgcccccuggcgcccc

SEQ ID NO: 30746 - RNA, 23 nt, Artificial Sequence
  Synthetic
cgaccggcgcccccuggcgcccc

SEQ ID NO: 30747 - RNA, 24 nt, Artificial Sequence
  Synthetic
ccgaccggcgcccccuggcgcccc

SEQ ID NO: 30748 - RNA, 18 nt, Artificial Sequence
  Synthetic
cagguguccucgggcccc

SEQ ID NO: 30749 - RNA, 19 nt, Artificial Sequence
  Synthetic
acagguguccucgggcccc

SEQ ID NO: 30750 - RNA, 20 nt, Artificial Sequence
  Synthetic
cacagguguccucgggcccc

SEQ ID NO: 30751 - RNA, 21 nt, Artificial Sequence
  Synthetic
gcacagguguccucgggcccc

SEQ ID NO: 30752 - RNA, 22 nt, Artificial Sequence
  Synthetic
cgcacagguguccucgggcccc

SEQ ID NO: 30753 - RNA, 23 nt, Artificial Sequence
  Synthetic
ccgcacagguguccucgggcccc

SEQ ID NO: 30754 - RNA, 24 nt, Artificial Sequence
  Synthetic
uccgcacagguguccucgggcccc

SEQ ID NO: 30755 - RNA, 18 nt, Artificial Sequence
  Synthetic
gggggcggcggcccgccc

SEQ ID NO: 30756 - RNA, 19 nt, Artificial Sequence
  Synthetic
agggggcggcggcccgccc

SEQ ID NO: 30757 - RNA, 20 nt, Artificial Sequence
  Synthetic
gagggggcggcggcccgccc

SEQ ID NO: 30758 - RNA, 21 nt, Artificial Sequence
  Synthetic
ggagggggcggcggcccgccc

SEQ ID NO: 30759 - RNA, 22 nt, Artificial Sequence
  Synthetic
cggagggggcggcggcccgccc

SEQ ID NO: 30760 - RNA, 23 nt, Artificial Sequence
  Synthetic
gcggagggggcggcggcccgccc

SEQ ID NO: 30761 - RNA, 24 nt, Artificial Sequence
  Synthetic
cgcggagggggcggcggcccgccc

SEQ ID NO: 30762 - RNA, 18 nt, Artificial Sequence
  Synthetic
gacagccccgcgcggccc

SEQ ID NO: 30763 - RNA, 19 nt, Artificial Sequence
  Synthetic
agacagccccgcgcggccc

SEQ ID NO: 30764 - RNA, 20 nt, Artificial Sequence
  Synthetic
gagacagccccgcgcggccc

SEQ ID NO: 30765 - RNA, 21 nt, Artificial Sequence
  Synthetic
cgagacagccccgcgcggccc

SEQ ID NO: 30766 - RNA, 22 nt, Artificial Sequence
  Synthetic
gcgagacagccccgcgcggccc

SEQ ID NO: 30767 - RNA, 23 nt, Artificial Sequence
  Synthetic
cgcgagacagccccgcgcggccc

SEQ ID NO: 30768 - RNA, 24 nt, Artificial Sequence
  Synthetic
ccgcgagacagccccgcgcggccc

SEQ ID NO: 30769 - RNA, 18 nt, Artificial Sequence
  Synthetic
acagguguccucgggccc

SEQ ID NO: 30770 - RNA, 19 nt, Artificial Sequence
  Synthetic
cacagguguccucgggccc

SEQ ID NO: 30771 - RNA, 20 nt, Artificial Sequence
  Synthetic
gcacagguguccucgggccc

SEQ ID NO: 30772 - RNA, 21 nt, Artificial Sequence
  Synthetic
cgcacagguguccucgggccc

SEQ ID NO: 30773 - RNA, 22 nt, Artificial Sequence
  Synthetic
ccgcacagguguccucgggccc

SEQ ID NO: 30774 - RNA, 23 nt, Artificial Sequence
  Synthetic
uccgcacagguguccucgggccc

SEQ ID NO: 30775 - RNA, 24 nt, Artificial Sequence
  Synthetic
cuccgcacagguguccucgggccc

SEQ ID NO: 30776 - RNA, 18 nt, Artificial Sequence
  Synthetic
ggagggcggccccgagcc

SEQ ID NO: 30777 - RNA, 19 nt, Artificial Sequence
  Synthetic
cggagggcggccccgagcc

SEQ ID NO: 30778 - RNA, 20 nt, Artificial Sequence
  Synthetic
gcggagggcggccccgagcc

SEQ ID NO: 30779 - RNA, 21 nt, Artificial Sequence
  Synthetic
cgcggagggcggccccgagcc

SEQ ID NO: 30780 - RNA, 22 nt, Artificial Sequence
  Synthetic
acgcggagggcggccccgagcc

SEQ ID NO: 30781 - RNA, 23 nt, Artificial Sequence
  Synthetic
cacgcggagggcggccccgagcc

SEQ ID NO: 30782 - RNA, 24 nt, Artificial Sequence
  Synthetic
ccacgcggagggcggccccgagcc

SEQ ID NO: 30783 - RNA, 18 nt, Artificial Sequence
  Synthetic
ggugccgccccccacgcc

SEQ ID NO: 30784 - RNA, 19 nt, Artificial Sequence
  Synthetic
cggugccgccccccacgcc

SEQ ID NO: 30785 - RNA, 20 nt, Artificial Sequence
  Synthetic
ccggugccgccccccacgcc

SEQ ID NO: 30786 - RNA, 21 nt, Artificial Sequence
  Synthetic
cccggugccgccccccacgcc

SEQ ID NO: 30787 - RNA, 22 nt, Artificial Sequence
  Synthetic
ccccggugccgccccccacgcc

SEQ ID NO: 30788 - RNA, 23 nt, Artificial Sequence
  Synthetic
cccccggugccgccccccacgcc

SEQ ID NO: 30789 - RNA, 24 nt, Artificial Sequence
  Synthetic
acccccggugccgccccccacgcc

SEQ ID NO: 30790 - RNA, 18 nt, Artificial Sequence
  Synthetic
cccccgcgcugcugcgcc

SEQ ID NO: 30791 - RNA, 19 nt, Artificial Sequence
  Synthetic
gcccccgcgcugcugcgcc

SEQ ID NO: 30792 - RNA, 20 nt, Artificial Sequence
  Synthetic
ggcccccgcgcugcugcgcc

SEQ ID NO: 30793 - RNA, 21 nt, Artificial Sequence
  Synthetic
cggcccccgcgcugcugcgcc

SEQ ID NO: 30794 - RNA, 22 nt, Artificial Sequence
  Synthetic
ucggcccccgcgcugcugcgcc

SEQ ID NO: 30795 - RNA, 23 nt, Artificial Sequence
  Synthetic
cucggcccccgcgcugcugcgcc

SEQ ID NO: 30796 - RNA, 24 nt, Artificial Sequence
  Synthetic
ccucggcccccgcgcugcugcgcc

SEQ ID NO: 30797 - RNA, 18 nt, Artificial Sequence
  Synthetic
gugcgggccggcacggcc

SEQ ID NO: 30798 - RNA, 19 nt, Artificial Sequence
  Synthetic
cgugcgggccggcacggcc

SEQ ID NO: 30799 - RNA, 20 nt, Artificial Sequence
  Synthetic
ccgugcgggccggcacggcc

SEQ ID NO: 30800 - RNA, 21 nt, Artificial Sequence
  Synthetic
gccgugcgggccggcacggcc

SEQ ID NO: 30801 - RNA, 22 nt, Artificial Sequence
  Synthetic
ggccgugcgggccggcacggcc

SEQ ID NO: 30802 - RNA, 23 nt, Artificial Sequence
  Synthetic
cggccgugcgggccggcacggcc

SEQ ID NO: 30803 - RNA, 24 nt, Artificial Sequence
  Synthetic
gcggccgugcgggccggcacggcc

SEQ ID NO: 30804 - RNA, 18 nt, Artificial Sequence
  Synthetic
acucgggcgaccgcggcc

SEQ ID NO: 30805 - RNA, 19 nt, Artificial Sequence
  Synthetic
gacucgggcgaccgcggcc

SEQ ID NO: 30806 - RNA, 20 nt, Artificial Sequence
  Synthetic
ggacucgggcgaccgcggcc

SEQ ID NO: 30807 - RNA, 21 nt, Artificial Sequence
  Synthetic
cggacucgggcgaccgcggcc

SEQ ID NO: 30808 - RNA, 22 nt, Artificial Sequence
  Synthetic
ucggacucgggcgaccgcggcc

SEQ ID NO: 30809 - RNA, 23 nt, Artificial Sequence
  Synthetic
cucggacucgggcgaccgcggcc

SEQ ID NO: 30810 - RNA, 24 nt, Artificial Sequence
  Synthetic
acucggacucgggcgaccgcggcc

SEQ ID NO: 30811 - RNA, 18 nt, Artificial Sequence
  Synthetic
agacagccccgcgcggcc

SEQ ID NO: 30812 - RNA, 19 nt, Artificial Sequence
  Synthetic
gagacagccccgcgcggcc

SEQ ID NO: 30813 - RNA, 20 nt, Artificial Sequence
  Synthetic
cgagacagccccgcgcggcc

SEQ ID NO: 30814 - RNA, 21 nt, Artificial Sequence
  Synthetic
gcgagacagccccgcgcggcc

SEQ ID NO: 30815 - RNA, 22 nt, Artificial Sequence
  Synthetic
cgcgagacagccccgcgcggcc

SEQ ID NO: 30816 - RNA, 23 nt, Artificial Sequence
  Synthetic
ccgcgagacagccccgcgcggcc

SEQ ID NO: 30817 - RNA, 24 nt, Artificial Sequence
  Synthetic
cccgcgagacagccccgcgcggcc

SEQ ID NO: 30818 - RNA, 18 nt, Artificial Sequence
  Synthetic
gccacgcggagggcggcc

SEQ ID NO: 30819 - RNA, 19 nt, Artificial Sequence
  Synthetic
cgccacgcggagggcggcc

SEQ ID NO: 30820 - RNA, 20 nt, Artificial Sequence
  Synthetic
gcgccacgcggagggcggcc

SEQ ID NO: 30821 - RNA, 21 nt, Artificial Sequence
  Synthetic
cgcgccacgcggagggcggcc

SEQ ID NO: 30822 - RNA, 22 nt, Artificial Sequence
  Synthetic
acgcgccacgcggagggcggcc

SEQ ID NO: 30823 - RNA, 23 nt, Artificial Sequence
  Synthetic
gacgcgccacgcggagggcggcc

SEQ ID NO: 30824 - RNA, 24 nt, Artificial Sequence
  Synthetic
agacgcgccacgcggagggcggcc

SEQ ID NO: 30825 - RNA, 18 nt, Artificial Sequence
  Synthetic
gcggcgccgcgccgggcc

SEQ ID NO: 30826 - RNA, 19 nt, Artificial Sequence
  Synthetic
ggcggcgccgcgccgggcc

SEQ ID NO: 30827 - RNA, 20 nt, Artificial Sequence
  Synthetic
gggcggcgccgcgccgggcc

SEQ ID NO: 30828 - RNA, 21 nt, Artificial Sequence
  Synthetic
agggcggcgccgcgccgggcc

SEQ ID NO: 30829 - RNA, 22 nt, Artificial Sequence
  Synthetic
gagggcggcgccgcgccgggcc

SEQ ID NO: 30830 - RNA, 23 nt, Artificial Sequence
  Synthetic
agagggcggcgccgcgccgggcc

SEQ ID NO: 30831 - RNA, 24 nt, Artificial Sequence
  Synthetic
aagagggcggcgccgcgccgggcc

SEQ ID NO: 30832 - RNA, 18 nt, Artificial Sequence
  Synthetic
gcgacgcccccgcgggcc

SEQ ID NO: 30833 - RNA, 19 nt, Artificial Sequence
  Synthetic
ggcgacgcccccgcgggcc

SEQ ID NO: 30834 - RNA, 20 nt, Artificial Sequence
  Synthetic
cggcgacgcccccgcgggcc

SEQ ID NO: 30835 - RNA, 21 nt, Artificial Sequence
  Synthetic
ccggcgacgcccccgcgggcc

SEQ ID NO: 30836 - RNA, 22 nt, Artificial Sequence
  Synthetic
gccggcgacgcccccgcgggcc

SEQ ID NO: 30837 - RNA, 23 nt, Artificial Sequence
  Synthetic
ggccggcgacgcccccgcgggcc

SEQ ID NO: 30838 - RNA, 24 nt, Artificial Sequence
  Synthetic
cggccggcgacgcccccgcgggcc

SEQ ID NO: 30839 - RNA, 18 nt, Artificial Sequence
  Synthetic
cgcgccgccccgcgggcc

SEQ ID NO: 30840 - RNA, 19 nt, Artificial Sequence
  Synthetic
ccgcgccgccccgcgggcc

SEQ ID NO: 30841 - RNA, 20 nt, Artificial Sequence
  Synthetic
uccgcgccgccccgcgggcc

SEQ ID NO: 30842 - RNA, 21 nt, Artificial Sequence
  Synthetic
cuccgcgccgccccgcgggcc

SEQ ID NO: 30843 - RNA, 22 nt, Artificial Sequence
  Synthetic
ucuccgcgccgccccgcgggcc

SEQ ID NO: 30844 - RNA, 23 nt, Artificial Sequence
  Synthetic
gucuccgcgccgccccgcgggcc

SEQ ID NO: 30845 - RNA, 24 nt, Artificial Sequence
  Synthetic
cgucuccgcgccgccccgcgggcc

SEQ ID NO: 30846 - RNA, 18 nt, Artificial Sequence
  Synthetic
cacagguguccucgggcc

SEQ ID NO: 30847 - RNA, 19 nt, Artificial Sequence
  Synthetic
gcacagguguccucgggcc

SEQ ID NO: 30848 - RNA, 20 nt, Artificial Sequence
  Synthetic
cgcacagguguccucgggcc

SEQ ID NO: 30849 - RNA, 21 nt, Artificial Sequence
  Synthetic
ccgcacagguguccucgggcc

SEQ ID NO: 30850 - RNA, 22 nt, Artificial Sequence
  Synthetic
uccgcacagguguccucgggcc

SEQ ID NO: 30851 - RNA, 23 nt, Artificial Sequence
  Synthetic
cuccgcacagguguccucgggcc

SEQ ID NO: 30852 - RNA, 24 nt, Artificial Sequence
  Synthetic
ccuccgcacagguguccucgggcc

SEQ ID NO: 30853 - RNA, 18 nt, Artificial Sequence
  Synthetic
ugcugcgccgcgggggcc

SEQ ID NO: 30854 - RNA, 19 nt, Artificial Sequence
  Synthetic
cugcugcgccgcgggggcc

SEQ ID NO: 30855 - RNA, 20 nt, Artificial Sequence
  Synthetic
gcugcugcgccgcgggggcc

SEQ ID NO: 30856 - RNA, 21 nt, Artificial Sequence
  Synthetic
cgcugcugcgccgcgggggcc

SEQ ID NO: 30857 - RNA, 22 nt, Artificial Sequence
  Synthetic
gcgcugcugcgccgcgggggcc

SEQ ID NO: 30858 - RNA, 23 nt, Artificial Sequence
  Synthetic
cgcgcugcugcgccgcgggggcc

SEQ ID NO: 30859 - RNA, 24 nt, Artificial Sequence
  Synthetic
ccgcgcugcugcgccgcgggggcc

SEQ ID NO: 30860 - RNA, 18 nt, Artificial Sequence
  Synthetic
ccccagggggugggggcc

SEQ ID NO: 30861 - RNA, 19 nt, Artificial Sequence
  Synthetic
cccccagggggugggggcc

SEQ ID NO: 30862 - RNA, 20 nt, Artificial Sequence
  Synthetic
ccccccagggggugggggcc

SEQ ID NO: 30863 - RNA, 21 nt, Artificial Sequence
  Synthetic
gccccccagggggugggggcc

SEQ ID NO: 30864 - RNA, 22 nt, Artificial Sequence
  Synthetic
cgccccccagggggugggggcc

SEQ ID NO: 30865 - RNA, 23 nt, Artificial Sequence
  Synthetic
ucgccccccagggggugggggcc

SEQ ID NO: 30866 - RNA, 24 nt, Artificial Sequence
  Synthetic
cucgccccccagggggugggggcc

SEQ ID NO: 30867 - RNA, 18 nt, Artificial Sequence
  Synthetic
gggccgaggaagugugcc

SEQ ID NO: 30868 - RNA, 19 nt, Artificial Sequence
  Synthetic
ggggccgaggaagugugcc

SEQ ID NO: 30869 - RNA, 20 nt, Artificial Sequence
  Synthetic
gggggccgaggaagugugcc

SEQ ID NO: 30870 - RNA, 21 nt, Artificial Sequence
  Synthetic
cgggggccgaggaagugugcc

SEQ ID NO: 30871 - RNA, 22 nt, Artificial Sequence
  Synthetic
gcgggggccgaggaagugugcc

SEQ ID NO: 30872 - RNA, 23 nt, Artificial Sequence
  Synthetic
cgcgggggccgaggaagugugcc

SEQ ID NO: 30873 - RNA, 24 nt, Artificial Sequence
  Synthetic
ccgcgggggccgaggaagugugcc

SEQ ID NO: 30874 - RNA, 18 nt, Artificial Sequence
  Synthetic
gccgccgcacccugcucc

SEQ ID NO: 30875 - RNA, 19 nt, Artificial Sequence
  Synthetic
agccgccgcacccugcucc

SEQ ID NO: 30876 - RNA, 20 nt, Artificial Sequence
  Synthetic
gagccgccgcacccugcucc

SEQ ID NO: 30877 - RNA, 21 nt, Artificial Sequence
  Synthetic
ggagccgccgcacccugcucc

SEQ ID NO: 30878 - RNA, 22 nt, Artificial Sequence
  Synthetic
uggagccgccgcacccugcucc

SEQ ID NO: 30879 - RNA, 23 nt, Artificial Sequence
  Synthetic
guggagccgccgcacccugcucc

SEQ ID NO: 30880 - RNA, 24 nt, Artificial Sequence
  Synthetic
cguggagccgccgcacccugcucc

SEQ ID NO: 30881 - RNA, 18 nt, Artificial Sequence
  Synthetic
ccgcucgccccggcgucc

SEQ ID NO: 30882 - RNA, 19 nt, Artificial Sequence
  Synthetic
gccgcucgccccggcgucc

SEQ ID NO: 30883 - RNA, 20 nt, Artificial Sequence
  Synthetic
ggccgcucgccccggcgucc

SEQ ID NO: 30884 - RNA, 21 nt, Artificial Sequence
  Synthetic
gggccgcucgccccggcgucc

SEQ ID NO: 30885 - RNA, 22 nt, Artificial Sequence
  Synthetic
cgggccgcucgccccggcgucc

SEQ ID NO: 30886 - RNA, 23 nt, Artificial Sequence
  Synthetic
acgggccgcucgccccggcgucc

SEQ ID NO: 30887 - RNA, 24 nt, Artificial Sequence
  Synthetic
cacgggccgcucgccccggcgucc

SEQ ID NO: 30888 - RNA, 18 nt, Artificial Sequence
  Synthetic
uccuccgcacaggugucc

SEQ ID NO: 30889 - RNA, 19 nt, Artificial Sequence
  Synthetic
cuccuccgcacaggugucc

SEQ ID NO: 30890 - RNA, 20 nt, Artificial Sequence
  Synthetic
ccuccuccgcacaggugucc

SEQ ID NO: 30891 - RNA, 21 nt, Artificial Sequence
  Synthetic
uccuccuccgcacaggugucc

SEQ ID NO: 30892 - RNA, 22 nt, Artificial Sequence
  Synthetic
cuccuccuccgcacaggugucc

SEQ ID NO: 30893 - RNA, 23 nt, Artificial Sequence
  Synthetic
ccuccuccuccgcacaggugucc

SEQ ID NO: 30894 - RNA, 24 nt, Artificial Sequence
  Synthetic
uccuccuccuccgcacaggugucc

SEQ ID NO: 30895 - RNA, 18 nt, Artificial Sequence
  Synthetic
cggagggcggccccgagc

SEQ ID NO: 30896 - RNA, 19 nt, Artificial Sequence
  Synthetic
gcggagggcggccccgagc

SEQ ID NO: 30897 - RNA, 20 nt, Artificial Sequence
  Synthetic
cgcggagggcggccccgagc

SEQ ID NO: 30898 - RNA, 21 nt, Artificial Sequence
  Synthetic
acgcggagggcggccccgagc

SEQ ID NO: 30899 - RNA, 22 nt, Artificial Sequence
  Synthetic
cacgcggagggcggccccgagc

SEQ ID NO: 30900 - RNA, 23 nt, Artificial Sequence
  Synthetic
ccacgcggagggcggccccgagc

SEQ ID NO: 30901 - RNA, 24 nt, Artificial Sequence
  Synthetic
gccacgcggagggcggccccgagc

SEQ ID NO: 30902 - RNA, 18 nt, Artificial Sequence
  Synthetic
cccguggugucugcgagc

SEQ ID NO: 30903 - RNA, 19 nt, Artificial Sequence
  Synthetic
ccccguggugucugcgagc

SEQ ID NO: 30904 - RNA, 20 nt, Artificial Sequence
  Synthetic
cccccguggugucugcgagc

SEQ ID NO: 30905 - RNA, 21 nt, Artificial Sequence
  Synthetic
gcccccguggugucugcgagc

SEQ ID NO: 30906 - RNA, 22 nt, Artificial Sequence
  Synthetic
cgcccccguggugucugcgagc

SEQ ID NO: 30907 - RNA, 23 nt, Artificial Sequence
  Synthetic
ccgcccccguggugucugcgagc

SEQ ID NO: 30908 - RNA, 24 nt, Artificial Sequence
  Synthetic
gccgcccccguggugucugcgagc

SEQ ID NO: 30909 - RNA, 18 nt, Artificial Sequence
  Synthetic
aacgacccccggacccgc

SEQ ID NO: 30910 - RNA, 19 nt, Artificial Sequence
  Synthetic
gaacgacccccggacccgc

SEQ ID NO: 30911 - RNA, 20 nt, Artificial Sequence
  Synthetic
ugaacgacccccggacccgc

SEQ ID NO: 30912 - RNA, 21 nt, Artificial Sequence
  Synthetic
gugaacgacccccggacccgc

SEQ ID NO: 30913 - RNA, 22 nt, Artificial Sequence
  Synthetic
agugaacgacccccggacccgc

SEQ ID NO: 30914 - RNA, 23 nt, Artificial Sequence
  Synthetic
uagugaacgacccccggacccgc

SEQ ID NO: 30915 - RNA, 24 nt, Artificial Sequence
  Synthetic
auagugaacgacccccggacccgc

SEQ ID NO: 30916 - RNA, 18 nt, Artificial Sequence
  Synthetic
gcgggccgcggcccccgc

SEQ ID NO: 30917 - RNA, 19 nt, Artificial Sequence
  Synthetic
ugcgggccgcggcccccgc

SEQ ID NO: 30918 - RNA, 20 nt, Artificial Sequence
  Synthetic
cugcgggccgcggcccccgc

SEQ ID NO: 30919 - RNA, 21 nt, Artificial Sequence
  Synthetic
gcugcgggccgcggcccccgc

SEQ ID NO: 30920 - RNA, 22 nt, Artificial Sequence
  Synthetic
ugcugcgggccgcggcccccgc

SEQ ID NO: 30921 - RNA, 23 nt, Artificial Sequence
  Synthetic
cugcugcgggccgcggcccccgc

SEQ ID NO: 30922 - RNA, 24 nt, Artificial Sequence
  Synthetic
ccugcugcgggccgcggcccccgc

SEQ ID NO: 30923 - RNA, 18 nt, Artificial Sequence
  Synthetic
cccgcgcugcugcgccgc

SEQ ID NO: 30924 - RNA, 19 nt, Artificial Sequence
  Synthetic
ccccgcgcugcugcgccgc

SEQ ID NO: 30925 - RNA, 20 nt, Artificial Sequence
  Synthetic
cccccgcgcugcugcgccgc

SEQ ID NO: 30926 - RNA, 21 nt, Artificial Sequence
  Synthetic
gcccccgcgcugcugcgccgc

SEQ ID NO: 30927 - RNA, 22 nt, Artificial Sequence
  Synthetic
ggcccccgcgcugcugcgccgc

SEQ ID NO: 30928 - RNA, 23 nt, Artificial Sequence
  Synthetic
cggcccccgcgcugcugcgccgc

SEQ ID NO: 30929 - RNA, 24 nt, Artificial Sequence
  Synthetic
ucggcccccgcgcugcugcgccgc

SEQ ID NO: 30930 - RNA, 18 nt, Artificial Sequence
  Synthetic
cgaagagcgccccggcgc

SEQ ID NO: 30931 - RNA, 19 nt, Artificial Sequence
  Synthetic
ccgaagagcgccccggcgc

SEQ ID NO: 30932 - RNA, 20 nt, Artificial Sequence
  Synthetic
cccgaagagcgccccggcgc

SEQ ID NO: 30933 - RNA, 21 nt, Artificial Sequence
  Synthetic
ccccgaagagcgccccggcgc

SEQ ID NO: 30934 - RNA, 22 nt, Artificial Sequence
  Synthetic
cccccgaagagcgccccggcgc

SEQ ID NO: 30935 - RNA, 23 nt, Artificial Sequence
  Synthetic
ccccccgaagagcgccccggcgc

SEQ ID NO: 30936 - RNA, 24 nt, Artificial Sequence
  Synthetic
gccccccgaagagcgccccggcgc

SEQ ID NO: 30937 - RNA, 18 nt, Artificial Sequence
  Synthetic
cgcguccgcguccggcgc

SEQ ID NO: 30938 - RNA, 19 nt, Artificial Sequence
  Synthetic
ucgcguccgcguccggcgc

SEQ ID NO: 30939 - RNA, 20 nt, Artificial Sequence
  Synthetic
gucgcguccgcguccggcgc

SEQ ID NO: 30940 - RNA, 21 nt, Artificial Sequence
  Synthetic
cgucgcguccgcguccggcgc

SEQ ID NO: 30941 - RNA, 22 nt, Artificial Sequence
  Synthetic
gcgucgcguccgcguccggcgc

SEQ ID NO: 30942 - RNA, 23 nt, Artificial Sequence
  Synthetic
agcgucgcguccgcguccggcgc

SEQ ID NO: 30943 - RNA, 24 nt, Artificial Sequence
  Synthetic
gagcgucgcguccgcguccggcgc

SEQ ID NO: 30944 - RNA, 18 nt, Artificial Sequence
  Synthetic
ccccgcgcucccugucgc

SEQ ID NO: 30945 - RNA, 19 nt, Artificial Sequence
  Synthetic
gccccgcgcucccugucgc

SEQ ID NO: 30946 - RNA, 20 nt, Artificial Sequence
  Synthetic
ggccccgcgcucccugucgc

SEQ ID NO: 30947 - RNA, 21 nt, Artificial Sequence
  Synthetic
cggccccgcgcucccugucgc

SEQ ID NO: 30948 - RNA, 22 nt, Artificial Sequence
  Synthetic
acggccccgcgcucccugucgc

SEQ ID NO: 30949 - RNA, 23 nt, Artificial Sequence
  Synthetic
gacggccccgcgcucccugucgc

SEQ ID NO: 30950 - RNA, 24 nt, Artificial Sequence
  Synthetic
ggacggccccgcgcucccugucgc

SEQ ID NO: 30951 - RNA, 18 nt, Artificial Sequence
  Synthetic
cccgaagagcgccccggc

SEQ ID NO: 30952 - RNA, 19 nt, Artificial Sequence
  Synthetic
ccccgaagagcgccccggc

SEQ ID NO: 30953 - RNA, 20 nt, Artificial Sequence
  Synthetic
cccccgaagagcgccccggc

SEQ ID NO: 30954 - RNA, 21 nt, Artificial Sequence
  Synthetic
ccccccgaagagcgccccggc

SEQ ID NO: 30955 - RNA, 22 nt, Artificial Sequence
  Synthetic
gccccccgaagagcgccccggc

SEQ ID NO: 30956 - RNA, 23 nt, Artificial Sequence
  Synthetic
cgccccccgaagagcgccccggc

SEQ ID NO: 30957 - RNA, 24 nt, Artificial Sequence
  Synthetic
ccgccccccgaagagcgccccggc

SEQ ID NO: 30958 - RNA, 18 nt, Artificial Sequence
  Synthetic
acccccccguggcccggc

SEQ ID NO: 30959 - RNA, 19 nt, Artificial Sequence
  Synthetic
cacccccccguggcccggc

SEQ ID NO: 30960 - RNA, 20 nt, Artificial Sequence
  Synthetic
ccacccccccguggcccggc

SEQ ID NO: 30961 - RNA, 21 nt, Artificial Sequence
  Synthetic
cccacccccccguggcccggc

SEQ ID NO: 30962 - RNA, 22 nt, Artificial Sequence
  Synthetic
gcccacccccccguggcccggc

SEQ ID NO: 30963 - RNA, 23 nt, Artificial Sequence
  Synthetic
cgcccacccccccguggcccggc

SEQ ID NO: 30964 - RNA, 24 nt, Artificial Sequence
  Synthetic
ucgcccacccccccguggcccggc

SEQ ID NO: 30965 - RNA, 18 nt, Artificial Sequence
  Synthetic
cuucccccugcggccggc

SEQ ID NO: 30966 - RNA, 19 nt, Artificial Sequence
  Synthetic
ucuucccccugcggccggc

SEQ ID NO: 30967 - RNA, 20 nt, Artificial Sequence
  Synthetic
cucuucccccugcggccggc

SEQ ID NO: 30968 - RNA, 21 nt, Artificial Sequence
  Synthetic
ucucuucccccugcggccggc

SEQ ID NO: 30969 - RNA, 22 nt, Artificial Sequence
  Synthetic
cucucuucccccugcggccggc

SEQ ID NO: 30970 - RNA, 23 nt, Artificial Sequence
  Synthetic
ccucucuucccccugcggccggc

SEQ ID NO: 30971 - RNA, 24 nt, Artificial Sequence
  Synthetic
gccucucuucccccugcggccggc

SEQ ID NO: 30972 - RNA, 18 nt, Artificial Sequence
  Synthetic
gggucgggagggccgggc

SEQ ID NO: 30973 - RNA, 19 nt, Artificial Sequence
  Synthetic
cgggucgggagggccgggc

SEQ ID NO: 30974 - RNA, 20 nt, Artificial Sequence
  Synthetic
gcgggucgggagggccgggc

SEQ ID NO: 30975 - RNA, 21 nt, Artificial Sequence
  Synthetic
cgcgggucgggagggccgggc

SEQ ID NO: 30976 - RNA, 22 nt, Artificial Sequence
  Synthetic
gcgcgggucgggagggccgggc

SEQ ID NO: 30977 - RNA, 23 nt, Artificial Sequence
  Synthetic
cgcgcgggucgggagggccgggc

SEQ ID NO: 30978 - RNA, 24 nt, Artificial Sequence
  Synthetic
gcgcgcgggucgggagggccgggc

SEQ ID NO: 30979 - RNA, 18 nt, Artificial Sequence
  Synthetic
gagcacgcgcgcaacugc

SEQ ID NO: 30980 - RNA, 19 nt, Artificial Sequence
  Synthetic
cgagcacgcgcgcaacugc

SEQ ID NO: 30981 - RNA, 20 nt, Artificial Sequence
  Synthetic
ccgagcacgcgcgcaacugc

SEQ ID NO: 30982 - RNA, 21 nt, Artificial Sequence
  Synthetic
cccgagcacgcgcgcaacugc

SEQ ID NO: 30983 - RNA, 22 nt, Artificial Sequence
  Synthetic
ccccgagcacgcgcgcaacugc

SEQ ID NO: 30984 - RNA, 23 nt, Artificial Sequence
  Synthetic
uccccgagcacgcgcgcaacugc

SEQ ID NO: 30985 - RNA, 24 nt, Artificial Sequence
  Synthetic
cuccccgagcacgcgcgcaacugc

SEQ ID NO: 30986 - RNA, 18 nt, Artificial Sequence
  Synthetic
gcgcgggggcggcggugc

SEQ ID NO: 30987 - RNA, 19 nt, Artificial Sequence
  Synthetic
ggcgcgggggcggcggugc

SEQ ID NO: 30988 - RNA, 20 nt, Artificial Sequence
  Synthetic
cggcgcgggggcggcggugc

SEQ ID NO: 30989 - RNA, 21 nt, Artificial Sequence
  Synthetic
ccggcgcgggggcggcggugc

SEQ ID NO: 30990 - RNA, 22 nt, Artificial Sequence
  Synthetic
cccggcgcgggggcggcggugc

SEQ ID NO: 30991 - RNA, 23 nt, Artificial Sequence
  Synthetic
ccccggcgcgggggcggcggugc

SEQ ID NO: 30992 - RNA, 24 nt, Artificial Sequence
  Synthetic
gccccggcgcgggggcggcggugc

SEQ ID NO: 30993 - RNA, 18 nt, Artificial Sequence
  Synthetic
ggggccgaggaagugugc

SEQ ID NO: 30994 - RNA, 19 nt, Artificial Sequence
  Synthetic
gggggccgaggaagugugc

SEQ ID NO: 30995 - RNA, 20 nt, Artificial Sequence
  Synthetic
cgggggccgaggaagugugc

SEQ ID NO: 30996 - RNA, 21 nt, Artificial Sequence
  Synthetic
gcgggggccgaggaagugugc

SEQ ID NO: 30997 - RNA, 22 nt, Artificial Sequence
  Synthetic
cgcgggggccgaggaagugugc

SEQ ID NO: 30998 - RNA, 23 nt, Artificial Sequence
  Synthetic
ccgcgggggccgaggaagugugc

SEQ ID NO: 30999 - RNA, 24 nt, Artificial Sequence
  Synthetic
gccgcgggggccgaggaagugugc

SEQ ID NO: 31000 - RNA, 18 nt, Artificial Sequence
  Synthetic
acgcgcuaccugcccauc

SEQ ID NO: 31001 - RNA, 19 nt, Artificial Sequence
  Synthetic
cacgcgcuaccugcccauc

SEQ ID NO: 31002 - RNA, 20 nt, Artificial Sequence
  Synthetic
ucacgcgcuaccugcccauc

SEQ ID NO: 31003 - RNA, 21 nt, Artificial Sequence
  Synthetic
cucacgcgcuaccugcccauc

SEQ ID NO: 31004 - RNA, 22 nt, Artificial Sequence
  Synthetic
ccucacgcgcuaccugcccauc

SEQ ID NO: 31005 - RNA, 23 nt, Artificial Sequence
  Synthetic
gccucacgcgcuaccugcccauc

SEQ ID NO: 31006 - RNA, 24 nt, Artificial Sequence
  Synthetic
ggccucacgcgcuaccugcccauc

SEQ ID NO: 31007 - RNA, 18 nt, Artificial Sequence
  Synthetic
ggggccuacgugguccuc

SEQ ID NO: 31008 - RNA, 19 nt, Artificial Sequence
  Synthetic
aggggccuacgugguccuc

SEQ ID NO: 31009 - RNA, 20 nt, Artificial Sequence
  Synthetic
uaggggccuacgugguccuc

SEQ ID NO: 31010 - RNA, 21 nt, Artificial Sequence
  Synthetic
auaggggccuacgugguccuc

SEQ ID NO: 31011 - RNA, 22 nt, Artificial Sequence
  Synthetic
cauaggggccuacgugguccuc

SEQ ID NO: 31012 - RNA, 23 nt, Artificial Sequence
  Synthetic
acauaggggccuacgugguccuc

SEQ ID NO: 31013 - RNA, 24 nt, Artificial Sequence
  Synthetic
cacauaggggccuacgugguccuc

SEQ ID NO: 31014 - RNA, 18 nt, Artificial Sequence
  Synthetic
cgcgccacccguggucuc

SEQ ID NO: 31015 - RNA, 19 nt, Artificial Sequence
  Synthetic
ucgcgccacccguggucuc

SEQ ID NO: 31016 - RNA, 20 nt, Artificial Sequence
  Synthetic
gucgcgccacccguggucuc

SEQ ID NO: 31017 - RNA, 21 nt, Artificial Sequence
  Synthetic
ggucgcgccacccguggucuc

SEQ ID NO: 31018 - RNA, 22 nt, Artificial Sequence
  Synthetic
cggucgcgccacccguggucuc

SEQ ID NO: 31019 - RNA, 23 nt, Artificial Sequence
  Synthetic
ccggucgcgccacccguggucuc

SEQ ID NO: 31020 - RNA, 24 nt, Artificial Sequence
  Synthetic
uccggucgcgccacccguggucuc

SEQ ID NO: 31021 - RNA, 18 nt, Artificial Sequence
  Synthetic
ggggacugccugcccguc

SEQ ID NO: 31022 - RNA, 19 nt, Artificial Sequence
  Synthetic
gggggacugccugcccguc

SEQ ID NO: 31023 - RNA, 20 nt, Artificial Sequence
  Synthetic
cgggggacugccugcccguc

SEQ ID NO: 31024 - RNA, 21 nt, Artificial Sequence
  Synthetic
acgggggacugccugcccguc

SEQ ID NO: 31025 - RNA, 22 nt, Artificial Sequence
  Synthetic
cacgggggacugccugcccguc

SEQ ID NO: 31026 - RNA, 23 nt, Artificial Sequence
  Synthetic
ucacgggggacugccugcccguc

SEQ ID NO: 31027 - RNA, 24 nt, Artificial Sequence
  Synthetic
gucacgggggacugccugcccguc

SEQ ID NO: 31028 - RNA, 18 nt, Artificial Sequence
  Synthetic
uacgugaacaagacgguc

SEQ ID NO: 31029 - RNA, 19 nt, Artificial Sequence
  Synthetic
uuacgugaacaagacgguc

SEQ ID NO: 31030 - RNA, 20 nt, Artificial Sequence
  Synthetic
cuuacgugaacaagacgguc

SEQ ID NO: 31031 - RNA, 21 nt, Artificial Sequence
  Synthetic
ccuuacgugaacaagacgguc

SEQ ID NO: 31032 - RNA, 22 nt, Artificial Sequence
  Synthetic
gccuuacgugaacaagacgguc

SEQ ID NO: 31033 - RNA, 23 nt, Artificial Sequence
  Synthetic
cgccuuacgugaacaagacgguc

SEQ ID NO: 31034 - RNA, 24 nt, Artificial Sequence
  Synthetic
gcgccuuacgugaacaagacgguc

SEQ ID NO: 31035 - RNA, 18 nt, Artificial Sequence
  Synthetic
gaccgacgcgcgcggguc

SEQ ID NO: 31036 - RNA, 19 nt, Artificial Sequence
  Synthetic
cgaccgacgcgcgcggguc

SEQ ID NO: 31037 - RNA, 20 nt, Artificial Sequence
  Synthetic
gcgaccgacgcgcgcggguc

SEQ ID NO: 31038 - RNA, 21 nt, Artificial Sequence
  Synthetic
cgcgaccgacgcgcgcggguc

SEQ ID NO: 31039 - RNA, 22 nt, Artificial Sequence
  Synthetic
gcgcgaccgacgcgcgcggguc

SEQ ID NO: 31040 - RNA, 23 nt, Artificial Sequence
  Synthetic
ggcgcgaccgacgcgcgcggguc

SEQ ID NO: 31041 - RNA, 24 nt, Artificial Sequence
  Synthetic
aggcgcgaccgacgcgcgcggguc

SEQ ID NO: 31042 - RNA, 18 nt, Artificial Sequence
  Synthetic
cugcccaucgcggggguc

SEQ ID NO: 31043 - RNA, 19 nt, Artificial Sequence
  Synthetic
ccugcccaucgcggggguc

SEQ ID NO: 31044 - RNA, 20 nt, Artificial Sequence
  Synthetic
accugcccaucgcggggguc

SEQ ID NO: 31045 - RNA, 21 nt, Artificial Sequence
  Synthetic
uaccugcccaucgcggggguc

SEQ ID NO: 31046 - RNA, 22 nt, Artificial Sequence
  Synthetic
cuaccugcccaucgcggggguc

SEQ ID NO: 31047 - RNA, 23 nt, Artificial Sequence
  Synthetic
gcuaccugcccaucgcggggguc

SEQ ID NO: 31048 - RNA, 24 nt, Artificial Sequence
  Synthetic
cgcuaccugcccaucgcggggguc

SEQ ID NO: 31049 - RNA, 18 nt, Artificial Sequence
  Synthetic
gggggugggaucuggguc

SEQ ID NO: 31050 - RNA, 19 nt, Artificial Sequence
  Synthetic
cgggggugggaucuggguc

SEQ ID NO: 31051 - RNA, 20 nt, Artificial Sequence
  Synthetic
gcgggggugggaucuggguc

SEQ ID NO: 31052 - RNA, 21 nt, Artificial Sequence
  Synthetic
ggcgggggugggaucuggguc

SEQ ID NO: 31053 - RNA, 22 nt, Artificial Sequence
  Synthetic
gggcgggggugggaucuggguc

SEQ ID NO: 31054 - RNA, 23 nt, Artificial Sequence
  Synthetic
cgggcgggggugggaucuggguc

SEQ ID NO: 31055 - RNA, 24 nt, Artificial Sequence
  Synthetic
gcgggcgggggugggaucuggguc

SEQ ID NO: 31056 - RNA, 18 nt, Artificial Sequence
  Synthetic
gucgcgccacccgugguc

SEQ ID NO: 31057 - RNA, 19 nt, Artificial Sequence
  Synthetic
ggucgcgccacccgugguc

SEQ ID NO: 31058 - RNA, 20 nt, Artificial Sequence
  Synthetic
cggucgcgccacccgugguc

SEQ ID NO: 31059 - RNA, 21 nt, Artificial Sequence
  Synthetic
ccggucgcgccacccgugguc

SEQ ID NO: 31060 - RNA, 22 nt, Artificial Sequence
  Synthetic
uccggucgcgccacccgugguc

SEQ ID NO: 31061 - RNA, 23 nt, Artificial Sequence
  Synthetic
cuccggucgcgccacccgugguc

SEQ ID NO: 31062 - RNA, 24 nt, Artificial Sequence
  Synthetic
ccuccggucgcgccacccgugguc

SEQ ID NO: 31063 - RNA, 18 nt, Artificial Sequence
  Synthetic
gugguccucguggaccag

SEQ ID NO: 31064 - RNA, 19 nt, Artificial Sequence
  Synthetic
cgugguccucguggaccag

SEQ ID NO: 31065 - RNA, 20 nt, Artificial Sequence
  Synthetic
acgugguccucguggaccag

SEQ ID NO: 31066 - RNA, 21 nt, Artificial Sequence
  Synthetic
uacgugguccucguggaccag

SEQ ID NO: 31067 - RNA, 22 nt, Artificial Sequence
  Synthetic
cuacgugguccucguggaccag

SEQ ID NO: 31068 - RNA, 23 nt, Artificial Sequence
  Synthetic
ccuacgugguccucguggaccag

SEQ ID NO: 31069 - RNA, 24 nt, Artificial Sequence
  Synthetic
gccuacgugguccucguggaccag

SEQ ID NO: 31070 - RNA, 18 nt, Artificial Sequence
  Synthetic
guccggcgcuggggagag

SEQ ID NO: 31071 - RNA, 19 nt, Artificial Sequence
  Synthetic
cguccggcgcuggggagag

SEQ ID NO: 31072 - RNA, 20 nt, Artificial Sequence
  Synthetic
gcguccggcgcuggggagag

SEQ ID NO: 31073 - RNA, 21 nt, Artificial Sequence
  Synthetic
cgcguccggcgcuggggagag

SEQ ID NO: 31074 - RNA, 22 nt, Artificial Sequence
  Synthetic
ccgcguccggcgcuggggagag

SEQ ID NO: 31075 - RNA, 23 nt, Artificial Sequence
  Synthetic
uccgcguccggcgcuggggagag

SEQ ID NO: 31076 - RNA, 24 nt, Artificial Sequence
  Synthetic
guccgcguccggcgcuggggagag

SEQ ID NO: 31077 - RNA, 18 nt, Artificial Sequence
  Synthetic
acgccccccgcgucggag

SEQ ID NO: 31078 - RNA, 19 nt, Artificial Sequence
  Synthetic
gacgccccccgcgucggag

SEQ ID NO: 31079 - RNA, 20 nt, Artificial Sequence
  Synthetic
cgacgccccccgcgucggag

SEQ ID NO: 31080 - RNA, 21 nt, Artificial Sequence
  Synthetic
ccgacgccccccgcgucggag

SEQ ID NO: 31081 - RNA, 22 nt, Artificial Sequence
  Synthetic
cccgacgccccccgcgucggag

SEQ ID NO: 31082 - RNA, 23 nt, Artificial Sequence
  Synthetic
acccgacgccccccgcgucggag

SEQ ID NO: 31083 - RNA, 24 nt, Artificial Sequence
  Synthetic
uacccgacgccccccgcgucggag

SEQ ID NO: 31084 - RNA, 18 nt, Artificial Sequence
  Synthetic
cacccguggucucgggag

SEQ ID NO: 31085 - RNA, 19 nt, Artificial Sequence
  Synthetic
ccacccguggucucgggag

SEQ ID NO: 31086 - RNA, 20 nt, Artificial Sequence
  Synthetic
gccacccguggucucgggag

SEQ ID NO: 31087 - RNA, 21 nt, Artificial Sequence
  Synthetic
cgccacccguggucucgggag

SEQ ID NO: 31088 - RNA, 22 nt, Artificial Sequence
  Synthetic
gcgccacccguggucucgggag

SEQ ID NO: 31089 - RNA, 23 nt, Artificial Sequence
  Synthetic
cgcgccacccguggucucgggag

SEQ ID NO: 31090 - RNA, 24 nt, Artificial Sequence
  Synthetic
ucgcgccacccguggucucgggag

SEQ ID NO: 31091 - RNA, 18 nt, Artificial Sequence
  Synthetic
cccguccuggacauggag

SEQ ID NO: 31092 - RNA, 19 nt, Artificial Sequence
  Synthetic
gcccguccuggacauggag

SEQ ID NO: 31093 - RNA, 20 nt, Artificial Sequence
  Synthetic
ugcccguccuggacauggag

SEQ ID NO: 31094 - RNA, 21 nt, Artificial Sequence
  Synthetic
cugcccguccuggacauggag

SEQ ID NO: 31095 - RNA, 22 nt, Artificial Sequence
  Synthetic
ccugcccguccuggacauggag

SEQ ID NO: 31096 - RNA, 23 nt, Artificial Sequence
  Synthetic
gccugcccguccuggacauggag

SEQ ID NO: 31097 - RNA, 24 nt, Artificial Sequence
  Synthetic
ugccugcccguccuggacauggag

SEQ ID NO: 31098 - RNA, 18 nt, Artificial Sequence
  Synthetic
ccaggaagacgcgccacg

SEQ ID NO: 31099 - RNA, 19 nt, Artificial Sequence
  Synthetic
gccaggaagacgcgccacg

SEQ ID NO: 31100 - RNA, 20 nt, Artificial Sequence
  Synthetic
ugccaggaagacgcgccacg

SEQ ID NO: 31101 - RNA, 21 nt, Artificial Sequence
  Synthetic
gugccaggaagacgcgccacg

SEQ ID NO: 31102 - RNA, 22 nt, Artificial Sequence
  Synthetic
ugugccaggaagacgcgccacg

SEQ ID NO: 31103 - RNA, 23 nt, Artificial Sequence
  Synthetic
gugugccaggaagacgcgccacg

SEQ ID NO: 31104 - RNA, 24 nt, Artificial Sequence
  Synthetic
agugugccaggaagacgcgccacg

SEQ ID NO: 31105 - RNA, 18 nt, Artificial Sequence
  Synthetic
gugaacaagacggucacg

SEQ ID NO: 31106 - RNA, 19 nt, Artificial Sequence
  Synthetic
cgugaacaagacggucacg

SEQ ID NO: 31107 - RNA, 20 nt, Artificial Sequence
  Synthetic
acgugaacaagacggucacg

SEQ ID NO: 31108 - RNA, 21 nt, Artificial Sequence
  Synthetic
uacgugaacaagacggucacg

SEQ ID NO: 31109 - RNA, 22 nt, Artificial Sequence
  Synthetic
uuacgugaacaagacggucacg

SEQ ID NO: 31110 - RNA, 23 nt, Artificial Sequence
  Synthetic
cuuacgugaacaagacggucacg

SEQ ID NO: 31111 - RNA, 24 nt, Artificial Sequence
  Synthetic
ccuuacgugaacaagacggucacg

SEQ ID NO: 31112 - RNA, 18 nt, Artificial Sequence
  Synthetic
guccucguggaccagacg

SEQ ID NO: 31113 - RNA, 19 nt, Artificial Sequence
  Synthetic
gguccucguggaccagacg

SEQ ID NO: 31114 - RNA, 20 nt, Artificial Sequence
  Synthetic
ugguccucguggaccagacg

SEQ ID NO: 31115 - RNA, 21 nt, Artificial Sequence
  Synthetic
gugguccucguggaccagacg

SEQ ID NO: 31116 - RNA, 22 nt, Artificial Sequence
  Synthetic
cgugguccucguggaccagacg

SEQ ID NO: 31117 - RNA, 23 nt, Artificial Sequence
  Synthetic
acgugguccucguggaccagacg

SEQ ID NO: 31118 - RNA, 24 nt, Artificial Sequence
  Synthetic
uacgugguccucguggaccagacg

SEQ ID NO: 31119 - RNA, 18 nt, Artificial Sequence
  Synthetic
cguggcccggcacggacg

SEQ ID NO: 31120 - RNA, 19 nt, Artificial Sequence
  Synthetic
ccguggcccggcacggacg

SEQ ID NO: 31121 - RNA, 20 nt, Artificial Sequence
  Synthetic
cccguggcccggcacggacg

SEQ ID NO: 31122 - RNA, 21 nt, Artificial Sequence
  Synthetic
ccccguggcccggcacggacg

SEQ ID NO: 31123 - RNA, 22 nt, Artificial Sequence
  Synthetic
cccccguggcccggcacggacg

SEQ ID NO: 31124 - RNA, 23 nt, Artificial Sequence
  Synthetic
ccccccguggcccggcacggacg

SEQ ID NO: 31125 - RNA, 24 nt, Artificial Sequence
  Synthetic
cccccccguggcccggcacggacg

SEQ ID NO: 31126 - RNA, 18 nt, Artificial Sequence
  Synthetic
cggugcgggggcgacccg

SEQ ID NO: 31127 - RNA, 19 nt, Artificial Sequence
  Synthetic
gcggugcgggggcgacccg

SEQ ID NO: 31128 - RNA, 20 nt, Artificial Sequence
  Synthetic
ggcggugcgggggcgacccg

SEQ ID NO: 31129 - RNA, 21 nt, Artificial Sequence
  Synthetic
cggcggugcgggggcgacccg

SEQ ID NO: 31130 - RNA, 22 nt, Artificial Sequence
  Synthetic
gcggcggugcgggggcgacccg

SEQ ID NO: 31131 - RNA, 23 nt, Artificial Sequence
  Synthetic
ggcggcggugcgggggcgacccg

SEQ ID NO: 31132 - RNA, 24 nt, Artificial Sequence
  Synthetic
gggcggcggugcgggggcgacccg

SEQ ID NO: 31133 - RNA, 18 nt, Artificial Sequence
  Synthetic
agccucuggaugaccccg

SEQ ID NO: 31134 - RNA, 19 nt, Artificial Sequence
  Synthetic
cagccucuggaugaccccg

SEQ ID NO: 31135 - RNA, 20 nt, Artificial Sequence
  Synthetic
acagccucuggaugaccccg

SEQ ID NO: 31136 - RNA, 21 nt, Artificial Sequence
  Synthetic
aacagccucuggaugaccccg

SEQ ID NO: 31137 - RNA, 22 nt, Artificial Sequence
  Synthetic
gaacagccucuggaugaccccg

SEQ ID NO: 31138 - RNA, 23 nt, Artificial Sequence
  Synthetic
ggaacagccucuggaugaccccg

SEQ ID NO: 31139 - RNA, 24 nt, Artificial Sequence
  Synthetic
uggaacagccucuggaugaccccg

SEQ ID NO: 31140 - RNA, 18 nt, Artificial Sequence
  Synthetic
cgucccgcccgccccccg

SEQ ID NO: 31141 - RNA, 19 nt, Artificial Sequence
  Synthetic
acgucccgcccgccccccg

SEQ ID NO: 31142 - RNA, 20 nt, Artificial Sequence
  Synthetic
uacgucccgcccgccccccg

SEQ ID NO: 31143 - RNA, 21 nt, Artificial Sequence
  Synthetic
cuacgucccgcccgccccccg

SEQ ID NO: 31144 - RNA, 22 nt, Artificial Sequence
  Synthetic
acuacgucccgcccgccccccg

SEQ ID NO: 31145 - RNA, 23 nt, Artificial Sequence
  Synthetic
gacuacgucccgcccgccccccg

SEQ ID NO: 31146 - RNA, 24 nt, Artificial Sequence
  Synthetic
ggacuacgucccgcccgccccccg

SEQ ID NO: 31147 - RNA, 18 nt, Artificial Sequence
  Synthetic
gcgcccccuggcgccccg

SEQ ID NO: 31148 - RNA, 19 nt, Artificial Sequence
  Synthetic
ggcgcccccuggcgccccg

SEQ ID NO: 31149 - RNA, 20 nt, Artificial Sequence
  Synthetic
cggcgcccccuggcgccccg

SEQ ID NO: 31150 - RNA, 21 nt, Artificial Sequence
  Synthetic
ccggcgcccccuggcgccccg

SEQ ID NO: 31151 - RNA, 22 nt, Artificial Sequence
  Synthetic
accggcgcccccuggcgccccg

SEQ ID NO: 31152 - RNA, 23 nt, Artificial Sequence
  Synthetic
gaccggcgcccccuggcgccccg

SEQ ID NO: 31153 - RNA, 24 nt, Artificial Sequence
  Synthetic
cgaccggcgcccccuggcgccccg

SEQ ID NO: 31154 - RNA, 18 nt, Artificial Sequence
  Synthetic
agguguccucgggccccg

SEQ ID NO: 31155 - RNA, 19 nt, Artificial Sequence
  Synthetic
cagguguccucgggccccg

SEQ ID NO: 31156 - RNA, 20 nt, Artificial Sequence
  Synthetic
acagguguccucgggccccg

SEQ ID NO: 31157 - RNA, 21 nt, Artificial Sequence
  Synthetic
cacagguguccucgggccccg

SEQ ID NO: 31158 - RNA, 22 nt, Artificial Sequence
  Synthetic
gcacagguguccucgggccccg

SEQ ID NO: 31159 - RNA, 23 nt, Artificial Sequence
  Synthetic
cgcacagguguccucgggccccg

SEQ ID NO: 31160 - RNA, 24 nt, Artificial Sequence
  Synthetic
ccgcacagguguccucgggccccg

SEQ ID NO: 31161 - RNA, 18 nt, Artificial Sequence
  Synthetic
gugccgccccccacgccg

SEQ ID NO: 31162 - RNA, 19 nt, Artificial Sequence
  Synthetic
ggugccgccccccacgccg

SEQ ID NO: 31163 - RNA, 20 nt, Artificial Sequence
  Synthetic
cggugccgccccccacgccg

SEQ ID NO: 31164 - RNA, 21 nt, Artificial Sequence
  Synthetic
ccggugccgccccccacgccg

SEQ ID NO: 31165 - RNA, 22 nt, Artificial Sequence
  Synthetic
cccggugccgccccccacgccg

SEQ ID NO: 31166 - RNA, 23 nt, Artificial Sequence
  Synthetic
ccccggugccgccccccacgccg

SEQ ID NO: 31167 - RNA, 24 nt, Artificial Sequence
  Synthetic
cccccggugccgccccccacgccg

SEQ ID NO: 31168 - RNA, 18 nt, Artificial Sequence
  Synthetic
ccccgcgcugcugcgccg

SEQ ID NO: 31169 - RNA, 19 nt, Artificial Sequence
  Synthetic
cccccgcgcugcugcgccg

SEQ ID NO: 31170 - RNA, 20 nt, Artificial Sequence
  Synthetic
gcccccgcgcugcugcgccg

SEQ ID NO: 31171 - RNA, 21 nt, Artificial Sequence
  Synthetic
ggcccccgcgcugcugcgccg

SEQ ID NO: 31172 - RNA, 22 nt, Artificial Sequence
  Synthetic
cggcccccgcgcugcugcgccg

SEQ ID NO: 31173 - RNA, 23 nt, Artificial Sequence
  Synthetic
ucggcccccgcgcugcugcgccg

SEQ ID NO: 31174 - RNA, 24 nt, Artificial Sequence
  Synthetic
cucggcccccgcgcugcugcgccg

SEQ ID NO: 31175 - RNA, 18 nt, Artificial Sequence
  Synthetic
cucuucccccugcggccg

SEQ ID NO: 31176 - RNA, 19 nt, Artificial Sequence
  Synthetic
ucucuucccccugcggccg

SEQ ID NO: 31177 - RNA, 20 nt, Artificial Sequence
  Synthetic
cucucuucccccugcggccg

SEQ ID NO: 31178 - RNA, 21 nt, Artificial Sequence
  Synthetic
ccucucuucccccugcggccg

SEQ ID NO: 31179 - RNA, 22 nt, Artificial Sequence
  Synthetic
gccucucuucccccugcggccg

SEQ ID NO: 31180 - RNA, 23 nt, Artificial Sequence
  Synthetic
ggccucucuucccccugcggccg

SEQ ID NO: 31181 - RNA, 24 nt, Artificial Sequence
  Synthetic
uggccucucuucccccugcggccg

SEQ ID NO: 31182 - RNA, 18 nt, Artificial Sequence
  Synthetic
gcugcgccgcgggggccg

SEQ ID NO: 31183 - RNA, 19 nt, Artificial Sequence
  Synthetic
ugcugcgccgcgggggccg

SEQ ID NO: 31184 - RNA, 20 nt, Artificial Sequence
  Synthetic
cugcugcgccgcgggggccg

SEQ ID NO: 31185 - RNA, 21 nt, Artificial Sequence
  Synthetic
gcugcugcgccgcgggggccg

SEQ ID NO: 31186 - RNA, 22 nt, Artificial Sequence
  Synthetic
cgcugcugcgccgcgggggccg

SEQ ID NO: 31187 - RNA, 23 nt, Artificial Sequence
  Synthetic
gcgcugcugcgccgcgggggccg

SEQ ID NO: 31188 - RNA, 24 nt, Artificial Sequence
  Synthetic
cgcgcugcugcgccgcgggggccg

SEQ ID NO: 31189 - RNA, 18 nt, Artificial Sequence
  Synthetic
gcgccgcccgccgugccg

SEQ ID NO: 31190 - RNA, 19 nt, Artificial Sequence
  Synthetic
cgcgccgcccgccgugccg

SEQ ID NO: 31191 - RNA, 20 nt, Artificial Sequence
  Synthetic
ccgcgccgcccgccgugccg

SEQ ID NO: 31192 - RNA, 21 nt, Artificial Sequence
  Synthetic
cccgcgccgcccgccgugccg

SEQ ID NO: 31193 - RNA, 22 nt, Artificial Sequence
  Synthetic
gcccgcgccgcccgccgugccg

SEQ ID NO: 31194 - RNA, 23 nt, Artificial Sequence
  Synthetic
ggcccgcgccgcccgccgugccg

SEQ ID NO: 31195 - RNA, 24 nt, Artificial Sequence
  Synthetic
gggcccgcgccgcccgccgugccg

SEQ ID NO: 31196 - RNA, 18 nt, Artificial Sequence
  Synthetic
aggaagacgcgccacgcg

SEQ ID NO: 31197 - RNA, 19 nt, Artificial Sequence
  Synthetic
caggaagacgcgccacgcg

SEQ ID NO: 31198 - RNA, 20 nt, Artificial Sequence
  Synthetic
ccaggaagacgcgccacgcg

SEQ ID NO: 31199 - RNA, 21 nt, Artificial Sequence
  Synthetic
gccaggaagacgcgccacgcg

SEQ ID NO: 31200 - RNA, 22 nt, Artificial Sequence
  Synthetic
ugccaggaagacgcgccacgcg

SEQ ID NO: 31201 - RNA, 23 nt, Artificial Sequence
  Synthetic
gugccaggaagacgcgccacgcg

SEQ ID NO: 31202 - RNA, 24 nt, Artificial Sequence
  Synthetic
ugugccaggaagacgcgccacgcg

SEQ ID NO: 31203 - RNA, 18 nt, Artificial Sequence
  Synthetic
acgacccccggacccgcg

SEQ ID NO: 31204 - RNA, 19 nt, Artificial Sequence
  Synthetic
aacgacccccggacccgcg

SEQ ID NO: 31205 - RNA, 20 nt, Artificial Sequence
  Synthetic
gaacgacccccggacccgcg

SEQ ID NO: 31206 - RNA, 21 nt, Artificial Sequence
  Synthetic
ugaacgacccccggacccgcg

SEQ ID NO: 31207 - RNA, 22 nt, Artificial Sequence
  Synthetic
gugaacgacccccggacccgcg

SEQ ID NO: 31208 - RNA, 23 nt, Artificial Sequence
  Synthetic
agugaacgacccccggacccgcg

SEQ ID NO: 31209 - RNA, 24 nt, Artificial Sequence
  Synthetic
uagugaacgacccccggacccgcg

SEQ ID NO: 31210 - RNA, 18 nt, Artificial Sequence
  Synthetic
uacccgacgccccccgcg

SEQ ID NO: 31211 - RNA, 19 nt, Artificial Sequence
  Synthetic
cuacccgacgccccccgcg

SEQ ID NO: 31212 - RNA, 20 nt, Artificial Sequence
  Synthetic
acuacccgacgccccccgcg

SEQ ID NO: 31213 - RNA, 21 nt, Artificial Sequence
  Synthetic
gacuacccgacgccccccgcg

SEQ ID NO: 31214 - RNA, 22 nt, Artificial Sequence
  Synthetic
cgacuacccgacgccccccgcg

SEQ ID NO: 31215 - RNA, 23 nt, Artificial Sequence
  Synthetic
ccgacuacccgacgccccccgcg

SEQ ID NO: 31216 - RNA, 24 nt, Artificial Sequence
  Synthetic
cccgacuacccgacgccccccgcg

SEQ ID NO: 31217 - RNA, 18 nt, Artificial Sequence
  Synthetic
cgggccgcggcccccgcg

SEQ ID NO: 31218 - RNA, 19 nt, Artificial Sequence
  Synthetic
gcgggccgcggcccccgcg

SEQ ID NO: 31219 - RNA, 20 nt, Artificial Sequence
  Synthetic
ugcgggccgcggcccccgcg

SEQ ID NO: 31220 - RNA, 21 nt, Artificial Sequence
  Synthetic
cugcgggccgcggcccccgcg

SEQ ID NO: 31221 - RNA, 22 nt, Artificial Sequence
  Synthetic
gcugcgggccgcggcccccgcg

SEQ ID NO: 31222 - RNA, 23 nt, Artificial Sequence
  Synthetic
ugcugcgggccgcggcccccgcg

SEQ ID NO: 31223 - RNA, 24 nt, Artificial Sequence
  Synthetic
cugcugcgggccgcggcccccgcg

SEQ ID NO: 31224 - RNA, 18 nt, Artificial Sequence
  Synthetic
gccgccccccacgccgcg

SEQ ID NO: 31225 - RNA, 19 nt, Artificial Sequence
  Synthetic
ugccgccccccacgccgcg

SEQ ID NO: 31226 - RNA, 20 nt, Artificial Sequence
  Synthetic
gugccgccccccacgccgcg

SEQ ID NO: 31227 - RNA, 21 nt, Artificial Sequence
  Synthetic
ggugccgccccccacgccgcg

SEQ ID NO: 31228 - RNA, 22 nt, Artificial Sequence
  Synthetic
cggugccgccccccacgccgcg

SEQ ID NO: 31229 - RNA, 23 nt, Artificial Sequence
  Synthetic
ccggugccgccccccacgccgcg

SEQ ID NO: 31230 - RNA, 24 nt, Artificial Sequence
  Synthetic
cccggugccgccccccacgccgcg

SEQ ID NO: 31231 - RNA, 18 nt, Artificial Sequence
  Synthetic
caagagggcggcgccgcg

SEQ ID NO: 31232 - RNA, 19 nt, Artificial Sequence
  Synthetic
ccaagagggcggcgccgcg

SEQ ID NO: 31233 - RNA, 20 nt, Artificial Sequence
  Synthetic
gccaagagggcggcgccgcg

SEQ ID NO: 31234 - RNA, 21 nt, Artificial Sequence
  Synthetic
ggccaagagggcggcgccgcg

SEQ ID NO: 31235 - RNA, 22 nt, Artificial Sequence
  Synthetic
gggccaagagggcggcgccgcg

SEQ ID NO: 31236 - RNA, 23 nt, Artificial Sequence
  Synthetic
ggggccaagagggcggcgccgcg

SEQ ID NO: 31237 - RNA, 24 nt, Artificial Sequence
  Synthetic
gggggccaagagggcggcgccgcg

SEQ ID NO: 31238 - RNA, 18 nt, Artificial Sequence
  Synthetic
ucgggagggccgggcgcg

SEQ ID NO: 31239 - RNA, 19 nt, Artificial Sequence
  Synthetic
gucgggagggccgggcgcg

SEQ ID NO: 31240 - RNA, 20 nt, Artificial Sequence
  Synthetic
ggucgggagggccgggcgcg

SEQ ID NO: 31241 - RNA, 21 nt, Artificial Sequence
  Synthetic
gggucgggagggccgggcgcg

SEQ ID NO: 31242 - RNA, 22 nt, Artificial Sequence
  Synthetic
cgggucgggagggccgggcgcg

SEQ ID NO: 31243 - RNA, 23 nt, Artificial Sequence
  Synthetic
gcgggucgggagggccgggcgcg

SEQ ID NO: 31244 - RNA, 24 nt, Artificial Sequence
  Synthetic
cgcgggucgggagggccgggcgcg

SEQ ID NO: 31245 - RNA, 18 nt, Artificial Sequence
  Synthetic
ggcacccuggugggcgcg

SEQ ID NO: 31246 - RNA, 19 nt, Artificial Sequence
  Synthetic
gggcacccuggugggcgcg

SEQ ID NO: 31247 - RNA, 20 nt, Artificial Sequence
  Synthetic
agggcacccuggugggcgcg

SEQ ID NO: 31248 - RNA, 21 nt, Artificial Sequence
  Synthetic
cagggcacccuggugggcgcg

SEQ ID NO: 31249 - RNA, 22 nt, Artificial Sequence
  Synthetic
ccagggcacccuggugggcgcg

SEQ ID NO: 31250 - RNA, 23 nt, Artificial Sequence
  Synthetic
accagggcacccuggugggcgcg

SEQ ID NO: 31251 - RNA, 24 nt, Artificial Sequence
  Synthetic
gaccagggcacccuggugggcgcg

SEQ ID NO: 31252 - RNA, 18 nt, Artificial Sequence
  Synthetic
ccgaagagcgccccggcg

SEQ ID NO: 31253 - RNA, 19 nt, Artificial Sequence
  Synthetic
cccgaagagcgccccggcg

SEQ ID NO: 31254 - RNA, 20 nt, Artificial Sequence
  Synthetic
ccccgaagagcgccccggcg

SEQ ID NO: 31255 - RNA, 21 nt, Artificial Sequence
  Synthetic
cccccgaagagcgccccggcg

SEQ ID NO: 31256 - RNA, 22 nt, Artificial Sequence
  Synthetic
ccccccgaagagcgccccggcg

SEQ ID NO: 31257 - RNA, 23 nt, Artificial Sequence
  Synthetic
gccccccgaagagcgccccggcg

SEQ ID NO: 31258 - RNA, 24 nt, Artificial Sequence
  Synthetic
cgccccccgaagagcgccccggcg

SEQ ID NO: 31259 - RNA, 18 nt, Artificial Sequence
  Synthetic
uucccccugcggccggcg

SEQ ID NO: 31260 - RNA, 19 nt, Artificial Sequence
  Synthetic
cuucccccugcggccggcg

SEQ ID NO: 31261 - RNA, 20 nt, Artificial Sequence
  Synthetic
ucuucccccugcggccggcg

SEQ ID NO: 31262 - RNA, 21 nt, Artificial Sequence
  Synthetic
cucuucccccugcggccggcg

SEQ ID NO: 31263 - RNA, 22 nt, Artificial Sequence
  Synthetic
ucucuucccccugcggccggcg

SEQ ID NO: 31264 - RNA, 23 nt, Artificial Sequence
  Synthetic
cucucuucccccugcggccggcg

SEQ ID NO: 31265 - RNA, 24 nt, Artificial Sequence
  Synthetic
ccucucuucccccugcggccggcg

SEQ ID NO: 31266 - RNA, 18 nt, Artificial Sequence
  Synthetic
ucgcguccgcguccggcg

SEQ ID NO: 31267 - RNA, 19 nt, Artificial Sequence
  Synthetic
gucgcguccgcguccggcg

SEQ ID NO: 31268 - RNA, 20 nt, Artificial Sequence
  Synthetic
cgucgcguccgcguccggcg

SEQ ID NO: 31269 - RNA, 21 nt, Artificial Sequence
  Synthetic
gcgucgcguccgcguccggcg

SEQ ID NO: 31270 - RNA, 22 nt, Artificial Sequence
  Synthetic
agcgucgcguccgcguccggcg

SEQ ID NO: 31271 - RNA, 23 nt, Artificial Sequence
  Synthetic
gagcgucgcguccgcguccggcg

SEQ ID NO: 31272 - RNA, 24 nt, Artificial Sequence
  Synthetic
ggagcgucgcguccgcguccggcg

SEQ ID NO: 31273 - RNA, 18 nt, Artificial Sequence
  Synthetic
ggcgaagacgccgcggcg

SEQ ID NO: 31274 - RNA, 19 nt, Artificial Sequence
  Synthetic
gggcgaagacgccgcggcg

SEQ ID NO: 31275 - RNA, 20 nt, Artificial Sequence
  Synthetic
ugggcgaagacgccgcggcg

SEQ ID NO: 31276 - RNA, 21 nt, Artificial Sequence
  Synthetic
gugggcgaagacgccgcggcg

SEQ ID NO: 31277 - RNA, 22 nt, Artificial Sequence
  Synthetic
ggugggcgaagacgccgcggcg

SEQ ID NO: 31278 - RNA, 23 nt, Artificial Sequence
  Synthetic
gggugggcgaagacgccgcggcg

SEQ ID NO: 31279 - RNA, 24 nt, Artificial Sequence
  Synthetic
cgggugggcgaagacgccgcggcg

SEQ ID NO: 31280 - RNA, 18 nt, Artificial Sequence
  Synthetic
gaagacgccgcggcggcg

SEQ ID NO: 31281 - RNA, 19 nt, Artificial Sequence
  Synthetic
cgaagacgccgcggcggcg

SEQ ID NO: 31282 - RNA, 20 nt, Artificial Sequence
  Synthetic
gcgaagacgccgcggcggcg

SEQ ID NO: 31283 - RNA, 21 nt, Artificial Sequence
  Synthetic
ggcgaagacgccgcggcggcg

SEQ ID NO: 31284 - RNA, 22 nt, Artificial Sequence
  Synthetic
gggcgaagacgccgcggcggcg

SEQ ID NO: 31285 - RNA, 23 nt, Artificial Sequence
  Synthetic
ugggcgaagacgccgcggcggcg

SEQ ID NO: 31286 - RNA, 24 nt, Artificial Sequence
  Synthetic
gugggcgaagacgccgcggcggcg

SEQ ID NO: 31287 - RNA, 18 nt, Artificial Sequence
  Synthetic
ggucgggagggccgggcg

SEQ ID NO: 31288 - RNA, 19 nt, Artificial Sequence
  Synthetic
gggucgggagggccgggcg

SEQ ID NO: 31289 - RNA, 20 nt, Artificial Sequence
  Synthetic
cgggucgggagggccgggcg

SEQ ID NO: 31290 - RNA, 21 nt, Artificial Sequence
  Synthetic
gcgggucgggagggccgggcg

SEQ ID NO: 31291 - RNA, 22 nt, Artificial Sequence
  Synthetic
cgcgggucgggagggccgggcg

SEQ ID NO: 31292 - RNA, 23 nt, Artificial Sequence
  Synthetic
gcgcgggucgggagggccgggcg

SEQ ID NO: 31293 - RNA, 24 nt, Artificial Sequence
  Synthetic
cgcgcgggucgggagggccgggcg

SEQ ID NO: 31294 - RNA, 18 nt, Artificial Sequence
  Synthetic
cgcgcuaccugcccaucg

SEQ ID NO: 31295 - RNA, 19 nt, Artificial Sequence
  Synthetic
acgcgcuaccugcccaucg

SEQ ID NO: 31296 - RNA, 20 nt, Artificial Sequence
  Synthetic
cacgcgcuaccugcccaucg

SEQ ID NO: 31297 - RNA, 21 nt, Artificial Sequence
  Synthetic
ucacgcgcuaccugcccaucg

SEQ ID NO: 31298 - RNA, 22 nt, Artificial Sequence
  Synthetic
cucacgcgcuaccugcccaucg

SEQ ID NO: 31299 - RNA, 23 nt, Artificial Sequence
  Synthetic
ccucacgcgcuaccugcccaucg

SEQ ID NO: 31300 - RNA, 24 nt, Artificial Sequence
  Synthetic
gccucacgcgcuaccugcccaucg

SEQ ID NO: 31301 - RNA, 18 nt, Artificial Sequence
  Synthetic
ggaggucugccacagucg

SEQ ID NO: 31302 - RNA, 19 nt, Artificial Sequence
  Synthetic
gggaggucugccacagucg

SEQ ID NO: 31303 - RNA, 20 nt, Artificial Sequence
  Synthetic
ggggaggucugccacagucg

SEQ ID NO: 31304 - RNA, 21 nt, Artificial Sequence
  Synthetic
gggggaggucugccacagucg

SEQ ID NO: 31305 - RNA, 22 nt, Artificial Sequence
  Synthetic
ggggggaggucugccacagucg

SEQ ID NO: 31306 - RNA, 23 nt, Artificial Sequence
  Synthetic
gggggggaggucugccacagucg

SEQ ID NO: 31307 - RNA, 24 nt, Artificial Sequence
  Synthetic
ggggggggaggucugccacagucg

SEQ ID NO: 31308 - RNA, 18 nt, Artificial Sequence
  Synthetic
gccccgcgcucccugucg

SEQ ID NO: 31309 - RNA, 19 nt, Artificial Sequence
  Synthetic
ggccccgcgcucccugucg

SEQ ID NO: 31310 - RNA, 20 nt, Artificial Sequence
  Synthetic
cggccccgcgcucccugucg

SEQ ID NO: 31311 - RNA, 21 nt, Artificial Sequence
  Synthetic
acggccccgcgcucccugucg

SEQ ID NO: 31312 - RNA, 22 nt, Artificial Sequence
  Synthetic
gacggccccgcgcucccugucg

SEQ ID NO: 31313 - RNA, 23 nt, Artificial Sequence
  Synthetic
ggacggccccgcgcucccugucg

SEQ ID NO: 31314 - RNA, 24 nt, Artificial Sequence
  Synthetic
cggacggccccgcgcucccugucg

SEQ ID NO: 31315 - RNA, 18 nt, Artificial Sequence
  Synthetic
gagggccgggcgcggagg

SEQ ID NO: 31316 - RNA, 19 nt, Artificial Sequence
  Synthetic
ggagggccgggcgcggagg

SEQ ID NO: 31317 - RNA, 20 nt, Artificial Sequence
  Synthetic
gggagggccgggcgcggagg

SEQ ID NO: 31318 - RNA, 21 nt, Artificial Sequence
  Synthetic
cgggagggccgggcgcggagg

SEQ ID NO: 31319 - RNA, 22 nt, Artificial Sequence
  Synthetic
ucgggagggccgggcgcggagg

SEQ ID NO: 31320 - RNA, 23 nt, Artificial Sequence
  Synthetic
gucgggagggccgggcgcggagg

SEQ ID NO: 31321 - RNA, 24 nt, Artificial Sequence
  Synthetic
ggucgggagggccgggcgcggagg

SEQ ID NO: 31322 - RNA, 18 nt, Artificial Sequence
  Synthetic
cccggacccgcguggagg

SEQ ID NO: 31323 - RNA, 19 nt, Artificial Sequence
  Synthetic
ccccggacccgcguggagg

SEQ ID NO: 31324 - RNA, 20 nt, Artificial Sequence
  Synthetic
cccccggacccgcguggagg

SEQ ID NO: 31325 - RNA, 21 nt, Artificial Sequence
  Synthetic
acccccggacccgcguggagg

SEQ ID NO: 31326 - RNA, 22 nt, Artificial Sequence
  Synthetic
gacccccggacccgcguggagg

SEQ ID NO: 31327 - RNA, 23 nt, Artificial Sequence
  Synthetic
cgacccccggacccgcguggagg

SEQ ID NO: 31328 - RNA, 24 nt, Artificial Sequence
  Synthetic
acgacccccggacccgcguggagg

SEQ ID NO: 31329 - RNA, 18 nt, Artificial Sequence
  Synthetic
gcggcggcccgcccccgg

SEQ ID NO: 31330 - RNA, 19 nt, Artificial Sequence
  Synthetic
ggcggcggcccgcccccgg

SEQ ID NO: 31331 - RNA, 20 nt, Artificial Sequence
  Synthetic
gggcggcggcccgcccccgg

SEQ ID NO: 31332 - RNA, 21 nt, Artificial Sequence
  Synthetic
ggggcggcggcccgcccccgg

SEQ ID NO: 31333 - RNA, 22 nt, Artificial Sequence
  Synthetic
gggggcggcggcccgcccccgg

SEQ ID NO: 31334 - RNA, 23 nt, Artificial Sequence
  Synthetic
agggggcggcggcccgcccccgg

SEQ ID NO: 31335 - RNA, 24 nt, Artificial Sequence
  Synthetic
gagggggcggcggcccgcccccgg

SEQ ID NO: 31336 - RNA, 18 nt, Artificial Sequence
  Synthetic
gguguccucgggccccgg

SEQ ID NO: 31337 - RNA, 19 nt, Artificial Sequence
  Synthetic
agguguccucgggccccgg

SEQ ID NO: 31338 - RNA, 20 nt, Artificial Sequence
  Synthetic
cagguguccucgggccccgg

SEQ ID NO: 31339 - RNA, 21 nt, Artificial Sequence
  Synthetic
acagguguccucgggccccgg

SEQ ID NO: 31340 - RNA, 22 nt, Artificial Sequence
  Synthetic
cacagguguccucgggccccgg

SEQ ID NO: 31341 - RNA, 23 nt, Artificial Sequence
  Synthetic
gcacagguguccucgggccccgg

SEQ ID NO: 31342 - RNA, 24 nt, Artificial Sequence
  Synthetic
cgcacagguguccucgggccccgg

SEQ ID NO: 31343 - RNA, 18 nt, Artificial Sequence
  Synthetic
ucuucccccugcggccgg

SEQ ID NO: 31344 - RNA, 19 nt, Artificial Sequence
  Synthetic
cucuucccccugcggccgg

SEQ ID NO: 31345 - RNA, 20 nt, Artificial Sequence
  Synthetic
ucucuucccccugcggccgg

SEQ ID NO: 31346 - RNA, 21 nt, Artificial Sequence
  Synthetic
cucucuucccccugcggccgg

SEQ ID NO: 31347 - RNA, 22 nt, Artificial Sequence
  Synthetic
ccucucuucccccugcggccgg

SEQ ID NO: 31348 - RNA, 23 nt, Artificial Sequence
  Synthetic
gccucucuucccccugcggccgg

SEQ ID NO: 31349 - RNA, 24 nt, Artificial Sequence
  Synthetic
ggccucucuucccccugcggccgg

SEQ ID NO: 31350 - RNA, 18 nt, Artificial Sequence
  Synthetic
cugcgagcgcggacgcgg

SEQ ID NO: 31351 - RNA, 19 nt, Artificial Sequence
  Synthetic
ucugcgagcgcggacgcgg

SEQ ID NO: 31352 - RNA, 20 nt, Artificial Sequence
  Synthetic
gucugcgagcgcggacgcgg

SEQ ID NO: 31353 - RNA, 21 nt, Artificial Sequence
  Synthetic
ugucugcgagcgcggacgcgg

SEQ ID NO: 31354 - RNA, 22 nt, Artificial Sequence
  Synthetic
gugucugcgagcgcggacgcgg

SEQ ID NO: 31355 - RNA, 23 nt, Artificial Sequence
  Synthetic
ggugucugcgagcgcggacgcgg

SEQ ID NO: 31356 - RNA, 24 nt, Artificial Sequence
  Synthetic
uggugucugcgagcgcggacgcgg

SEQ ID NO: 31357 - RNA, 18 nt, Artificial Sequence
  Synthetic
ccgccccccacgccgcgg

SEQ ID NO: 31358 - RNA, 19 nt, Artificial Sequence
  Synthetic
gccgccccccacgccgcgg

SEQ ID NO: 31359 - RNA, 20 nt, Artificial Sequence
  Synthetic
ugccgccccccacgccgcgg

SEQ ID NO: 31360 - RNA, 21 nt, Artificial Sequence
  Synthetic
gugccgccccccacgccgcgg

SEQ ID NO: 31361 - RNA, 22 nt, Artificial Sequence
  Synthetic
ggugccgccccccacgccgcgg

SEQ ID NO: 31362 - RNA, 23 nt, Artificial Sequence
  Synthetic
cggugccgccccccacgccgcgg

SEQ ID NO: 31363 - RNA, 24 nt, Artificial Sequence
  Synthetic
ccggugccgccccccacgccgcgg

SEQ ID NO: 31364 - RNA, 18 nt, Artificial Sequence
  Synthetic
cgggagggccgggcgcgg

SEQ ID NO: 31365 - RNA, 19 nt, Artificial Sequence
  Synthetic
ucgggagggccgggcgcgg

SEQ ID NO: 31366 - RNA, 20 nt, Artificial Sequence
  Synthetic
gucgggagggccgggcgcgg

SEQ ID NO: 31367 - RNA, 21 nt, Artificial Sequence
  Synthetic
ggucgggagggccgggcgcgg

SEQ ID NO: 31368 - RNA, 22 nt, Artificial Sequence
  Synthetic
gggucgggagggccgggcgcgg

SEQ ID NO: 31369 - RNA, 23 nt, Artificial Sequence
  Synthetic
cgggucgggagggccgggcgcgg

SEQ ID NO: 31370 - RNA, 24 nt, Artificial Sequence
  Synthetic
gcgggucgggagggccgggcgcgg

SEQ ID NO: 31371 - RNA, 18 nt, Artificial Sequence
  Synthetic
gcgaagacgccgcggcgg

SEQ ID NO: 31372 - RNA, 19 nt, Artificial Sequence
  Synthetic
ggcgaagacgccgcggcgg

SEQ ID NO: 31373 - RNA, 20 nt, Artificial Sequence
  Synthetic
gggcgaagacgccgcggcgg

SEQ ID NO: 31374 - RNA, 21 nt, Artificial Sequence
  Synthetic
ugggcgaagacgccgcggcgg

SEQ ID NO: 31375 - RNA, 22 nt, Artificial Sequence
  Synthetic
gugggcgaagacgccgcggcgg

SEQ ID NO: 31376 - RNA, 23 nt, Artificial Sequence
  Synthetic
ggugggcgaagacgccgcggcgg

SEQ ID NO: 31377 - RNA, 24 nt, Artificial Sequence
  Synthetic
gggugggcgaagacgccgcggcgg

SEQ ID NO: 31378 - RNA, 18 nt, Artificial Sequence
  Synthetic
cgcgcgcaggcgcggcgg

SEQ ID NO: 31379 - RNA, 19 nt, Artificial Sequence
  Synthetic
gcgcgcgcaggcgcggcgg

SEQ ID NO: 31380 - RNA, 20 nt, Artificial Sequence
  Synthetic
ggcgcgcgcaggcgcggcgg

SEQ ID NO: 31381 - RNA, 21 nt, Artificial Sequence
  Synthetic
gggcgcgcgcaggcgcggcgg

SEQ ID NO: 31382 - RNA, 22 nt, Artificial Sequence
  Synthetic
ggggcgcgcgcaggcgcggcgg

SEQ ID NO: 31383 - RNA, 23 nt, Artificial Sequence
  Synthetic
gggggcgcgcgcaggcgcggcgg

SEQ ID NO: 31384 - RNA, 24 nt, Artificial Sequence
  Synthetic
ggggggcgcgcgcaggcgcggcgg

SEQ ID NO: 31385 - RNA, 18 nt, Artificial Sequence
  Synthetic
ccgccucuuccucugcgg

SEQ ID NO: 31386 - RNA, 19 nt, Artificial Sequence
  Synthetic
uccgccucuuccucugcgg

SEQ ID NO: 31387 - RNA, 20 nt, Artificial Sequence
  Synthetic
cuccgccucuuccucugcgg

SEQ ID NO: 31388 - RNA, 21 nt, Artificial Sequence
  Synthetic
ccuccgccucuuccucugcgg

SEQ ID NO: 31389 - RNA, 22 nt, Artificial Sequence
  Synthetic
uccuccgccucuuccucugcgg

SEQ ID NO: 31390 - RNA, 23 nt, Artificial Sequence
  Synthetic
cuccuccgccucuuccucugcgg

SEQ ID NO: 31391 - RNA, 24 nt, Artificial Sequence
  Synthetic
ccuccuccgccucuuccucugcgg

SEQ ID NO: 31392 - RNA, 18 nt, Artificial Sequence
  Synthetic
ggcggcgccccguugcgg

SEQ ID NO: 31393 - RNA, 19 nt, Artificial Sequence
  Synthetic
cggcggcgccccguugcgg

SEQ ID NO: 31394 - RNA, 20 nt, Artificial Sequence
  Synthetic
gcggcggcgccccguugcgg

SEQ ID NO: 31395 - RNA, 21 nt, Artificial Sequence
  Synthetic
agcggcggcgccccguugcgg

SEQ ID NO: 31396 - RNA, 22 nt, Artificial Sequence
  Synthetic
cagcggcggcgccccguugcgg

SEQ ID NO: 31397 - RNA, 23 nt, Artificial Sequence
  Synthetic
gcagcggcggcgccccguugcgg

SEQ ID NO: 31398 - RNA, 24 nt, Artificial Sequence
  Synthetic
agcagcggcggcgccccguugcgg

SEQ ID NO: 31399 - RNA, 18 nt, Artificial Sequence
  Synthetic
ccgacgcgcgcgggucgg

SEQ ID NO: 31400 - RNA, 19 nt, Artificial Sequence
  Synthetic
accgacgcgcgcgggucgg

SEQ ID NO: 31401 - RNA, 20 nt, Artificial Sequence
  Synthetic
gaccgacgcgcgcgggucgg

SEQ ID NO: 31402 - RNA, 21 nt, Artificial Sequence
  Synthetic
cgaccgacgcgcgcgggucgg

SEQ ID NO: 31403 - RNA, 22 nt, Artificial Sequence
  Synthetic
gcgaccgacgcgcgcgggucgg

SEQ ID NO: 31404 - RNA, 23 nt, Artificial Sequence
  Synthetic
cgcgaccgacgcgcgcgggucgg

SEQ ID NO: 31405 - RNA, 24 nt, Artificial Sequence
  Synthetic
gcgcgaccgacgcgcgcgggucgg

SEQ ID NO: 31406 - RNA, 18 nt, Artificial Sequence
  Synthetic
cgccgcggcggcggaggg

SEQ ID NO: 31407 - RNA, 19 nt, Artificial Sequence
  Synthetic
acgccgcggcggcggaggg

SEQ ID NO: 31408 - RNA, 20 nt, Artificial Sequence
  Synthetic
gacgccgcggcggcggaggg

SEQ ID NO: 31409 - RNA, 21 nt, Artificial Sequence
  Synthetic
agacgccgcggcggcggaggg

SEQ ID NO: 31410 - RNA, 22 nt, Artificial Sequence
  Synthetic
aagacgccgcggcggcggaggg

SEQ ID NO: 31411 - RNA, 23 nt, Artificial Sequence
  Synthetic
gaagacgccgcggcggcggaggg

SEQ ID NO: 31412 - RNA, 24 nt, Artificial Sequence
  Synthetic
cgaagacgccgcggcggcggaggg

SEQ ID NO: 31413 - RNA, 18 nt, Artificial Sequence
  Synthetic
gcgcgcgggucgggaggg

SEQ ID NO: 31414 - RNA, 19 nt, Artificial Sequence
  Synthetic
cgcgcgcgggucgggaggg

SEQ ID NO: 31415 - RNA, 20 nt, Artificial Sequence
  Synthetic
acgcgcgcgggucgggaggg

SEQ ID NO: 31416 - RNA, 21 nt, Artificial Sequence
  Synthetic
gacgcgcgcgggucgggaggg

SEQ ID NO: 31417 - RNA, 22 nt, Artificial Sequence
  Synthetic
cgacgcgcgcgggucgggaggg

SEQ ID NO: 31418 - RNA, 23 nt, Artificial Sequence
  Synthetic
ccgacgcgcgcgggucgggaggg

SEQ ID NO: 31419 - RNA, 24 nt, Artificial Sequence
  Synthetic
accgacgcgcgcgggucgggaggg

SEQ ID NO: 31420 - RNA, 18 nt, Artificial Sequence
  Synthetic
guguccucgggccccggg

SEQ ID NO: 31421 - RNA, 19 nt, Artificial Sequence
  Synthetic
gguguccucgggccccggg

SEQ ID NO: 31422 - RNA, 20 nt, Artificial Sequence
  Synthetic
agguguccucgggccccggg

SEQ ID NO: 31423 - RNA, 21 nt, Artificial Sequence
  Synthetic
cagguguccucgggccccggg

SEQ ID NO: 31424 - RNA, 22 nt, Artificial Sequence
  Synthetic
acagguguccucgggccccggg

SEQ ID NO: 31425 - RNA, 23 nt, Artificial Sequence
  Synthetic
cacagguguccucgggccccggg

SEQ ID NO: 31426 - RNA, 24 nt, Artificial Sequence
  Synthetic
gcacagguguccucgggccccggg

SEQ ID NO: 31427 - RNA, 18 nt, Artificial Sequence
  Synthetic
gcgaccgacgcgcgcggg

SEQ ID NO: 31428 - RNA, 19 nt, Artificial Sequence
  Synthetic
cgcgaccgacgcgcgcggg

SEQ ID NO: 31429 - RNA, 20 nt, Artificial Sequence
  Synthetic
gcgcgaccgacgcgcgcggg

SEQ ID NO: 31430 - RNA, 21 nt, Artificial Sequence
  Synthetic
ggcgcgaccgacgcgcgcggg

SEQ ID NO: 31431 - RNA, 22 nt, Artificial Sequence
  Synthetic
aggcgcgaccgacgcgcgcggg

SEQ ID NO: 31432 - RNA, 23 nt, Artificial Sequence
  Synthetic
caggcgcgaccgacgcgcgcggg

SEQ ID NO: 31433 - RNA, 24 nt, Artificial Sequence
  Synthetic
gcaggcgcgaccgacgcgcgcggg

SEQ ID NO: 31434 - RNA, 18 nt, Artificial Sequence
  Synthetic
ccccggaagaggcgcggg

SEQ ID NO: 31435 - RNA, 19 nt, Artificial Sequence
  Synthetic
cccccggaagaggcgcggg

SEQ ID NO: 31436 - RNA, 20 nt, Artificial Sequence
  Synthetic
gcccccggaagaggcgcggg

SEQ ID NO: 31437 - RNA, 21 nt, Artificial Sequence
  Synthetic
cgcccccggaagaggcgcggg

SEQ ID NO: 31438 - RNA, 22 nt, Artificial Sequence
  Synthetic
ccgcccccggaagaggcgcggg

SEQ ID NO: 31439 - RNA, 23 nt, Artificial Sequence
  Synthetic
cccgcccccggaagaggcgcggg

SEQ ID NO: 31440 - RNA, 24 nt, Artificial Sequence
  Synthetic
gcccgcccccggaagaggcgcggg

SEQ ID NO: 31441 - RNA, 18 nt, Artificial Sequence
  Synthetic
cgccucuuccucugcggg

SEQ ID NO: 31442 - RNA, 19 nt, Artificial Sequence
  Synthetic
ccgccucuuccucugcggg

SEQ ID NO: 31443 - RNA, 20 nt, Artificial Sequence
  Synthetic
uccgccucuuccucugcggg

SEQ ID NO: 31444 - RNA, 21 nt, Artificial Sequence
  Synthetic
cuccgccucuuccucugcggg

SEQ ID NO: 31445 - RNA, 22 nt, Artificial Sequence
  Synthetic
ccuccgccucuuccucugcggg

SEQ ID NO: 31446 - RNA, 23 nt, Artificial Sequence
  Synthetic
uccuccgccucuuccucugcggg

SEQ ID NO: 31447 - RNA, 24 nt, Artificial Sequence
  Synthetic
cuccuccgccucuuccucugcggg

SEQ ID NO: 31448 - RNA, 18 nt, Artificial Sequence
  Synthetic
gcggcgccccguugcggg

SEQ ID NO: 31449 - RNA, 19 nt, Artificial Sequence
  Synthetic
ggcggcgccccguugcggg

SEQ ID NO: 31450 - RNA, 20 nt, Artificial Sequence
  Synthetic
cggcggcgccccguugcggg

SEQ ID NO: 31451 - RNA, 21 nt, Artificial Sequence
  Synthetic
gcggcggcgccccguugcggg

SEQ ID NO: 31452 - RNA, 22 nt, Artificial Sequence
  Synthetic
agcggcggcgccccguugcggg

SEQ ID NO: 31453 - RNA, 23 nt, Artificial Sequence
  Synthetic
cagcggcggcgccccguugcggg

SEQ ID NO: 31454 - RNA, 24 nt, Artificial Sequence
  Synthetic
gcagcggcggcgccccguugcggg

SEQ ID NO: 31455 - RNA, 18 nt, Artificial Sequence
  Synthetic
ccccucgccccccagggg

SEQ ID NO: 31456 - RNA, 19 nt, Artificial Sequence
  Synthetic
gccccucgccccccagggg

SEQ ID NO: 31457 - RNA, 20 nt, Artificial Sequence
  Synthetic
cgccccucgccccccagggg

SEQ ID NO: 31458 - RNA, 21 nt, Artificial Sequence
  Synthetic
ucgccccucgccccccagggg

SEQ ID NO: 31459 - RNA, 22 nt, Artificial Sequence
  Synthetic
cucgccccucgccccccagggg

SEQ ID NO: 31460 - RNA, 23 nt, Artificial Sequence
  Synthetic
gcucgccccucgccccccagggg

SEQ ID NO: 31461 - RNA, 24 nt, Artificial Sequence
  Synthetic
cgcucgccccucgccccccagggg

SEQ ID NO: 31462 - RNA, 18 nt, Artificial Sequence
  Synthetic
uguccucgggccccgggg

SEQ ID NO: 31463 - RNA, 19 nt, Artificial Sequence
  Synthetic
guguccucgggccccgggg

SEQ ID NO: 31464 - RNA, 20 nt, Artificial Sequence
  Synthetic
gguguccucgggccccgggg

SEQ ID NO: 31465 - RNA, 21 nt, Artificial Sequence
  Synthetic
agguguccucgggccccgggg

SEQ ID NO: 31466 - RNA, 22 nt, Artificial Sequence
  Synthetic
cagguguccucgggccccgggg

SEQ ID NO: 31467 - RNA, 23 nt, Artificial Sequence
  Synthetic
acagguguccucgggccccgggg

SEQ ID NO: 31468 - RNA, 24 nt, Artificial Sequence
  Synthetic
cacagguguccucgggccccgggg

SEQ ID NO: 31469 - RNA, 18 nt, Artificial Sequence
  Synthetic
gccccguugcgggcgggg

SEQ ID NO: 31470 - RNA, 19 nt, Artificial Sequence
  Synthetic
cgccccguugcgggcgggg

SEQ ID NO: 31471 - RNA, 20 nt, Artificial Sequence
  Synthetic
gcgccccguugcgggcgggg

SEQ ID NO: 31472 - RNA, 21 nt, Artificial Sequence
  Synthetic
ggcgccccguugcgggcgggg

SEQ ID NO: 31473 - RNA, 22 nt, Artificial Sequence
  Synthetic
cggcgccccguugcgggcgggg

SEQ ID NO: 31474 - RNA, 23 nt, Artificial Sequence
  Synthetic
gcggcgccccguugcgggcgggg

SEQ ID NO: 31475 - RNA, 24 nt, Artificial Sequence
  Synthetic
ggcggcgccccguugcgggcgggg

SEQ ID NO: 31476 - RNA, 18 nt, Artificial Sequence
  Synthetic
cccucgccccccaggggg

SEQ ID NO: 31477 - RNA, 19 nt, Artificial Sequence
  Synthetic
ccccucgccccccaggggg

SEQ ID NO: 31478 - RNA, 20 nt, Artificial Sequence
  Synthetic
gccccucgccccccaggggg

SEQ ID NO: 31479 - RNA, 21 nt, Artificial Sequence
  Synthetic
cgccccucgccccccaggggg

SEQ ID NO: 31480 - RNA, 22 nt, Artificial Sequence
  Synthetic
ucgccccucgccccccaggggg

SEQ ID NO: 31481 - RNA, 23 nt, Artificial Sequence
  Synthetic
cucgccccucgccccccaggggg

SEQ ID NO: 31482 - RNA, 24 nt, Artificial Sequence
  Synthetic
gcucgccccucgccccccaggggg

SEQ ID NO: 31483 - RNA, 18 nt, Artificial Sequence
  Synthetic
guccucgggccccggggg

SEQ ID NO: 31484 - RNA, 19 nt, Artificial Sequence
  Synthetic
uguccucgggccccggggg

SEQ ID NO: 31485 - RNA, 20 nt, Artificial Sequence
  Synthetic
guguccucgggccccggggg

SEQ ID NO: 31486 - RNA, 21 nt, Artificial Sequence
  Synthetic
gguguccucgggccccggggg

SEQ ID NO: 31487 - RNA, 22 nt, Artificial Sequence
  Synthetic
agguguccucgggccccggggg

SEQ ID NO: 31488 - RNA, 23 nt, Artificial Sequence
  Synthetic
cagguguccucgggccccggggg

SEQ ID NO: 31489 - RNA, 24 nt, Artificial Sequence
  Synthetic
acagguguccucgggccccggggg

SEQ ID NO: 31490 - RNA, 18 nt, Artificial Sequence
  Synthetic
gcugcugcgccgcggggg

SEQ ID NO: 31491 - RNA, 19 nt, Artificial Sequence
  Synthetic
cgcugcugcgccgcggggg

SEQ ID NO: 31492 - RNA, 20 nt, Artificial Sequence
  Synthetic
gcgcugcugcgccgcggggg

SEQ ID NO: 31493 - RNA, 21 nt, Artificial Sequence
  Synthetic
cgcgcugcugcgccgcggggg

SEQ ID NO: 31494 - RNA, 22 nt, Artificial Sequence
  Synthetic
ccgcgcugcugcgccgcggggg

SEQ ID NO: 31495 - RNA, 23 nt, Artificial Sequence
  Synthetic
cccgcgcugcugcgccgcggggg

SEQ ID NO: 31496 - RNA, 24 nt, Artificial Sequence
  Synthetic
ccccgcgcugcugcgccgcggggg

SEQ ID NO: 31497 - RNA, 18 nt, Artificial Sequence
  Synthetic
uccgcguccggcgcuggg

SEQ ID NO: 31498 - RNA, 19 nt, Artificial Sequence
  Synthetic
guccgcguccggcgcuggg

SEQ ID NO: 31499 - RNA, 20 nt, Artificial Sequence
  Synthetic
cguccgcguccggcgcuggg

SEQ ID NO: 31500 - RNA, 21 nt, Artificial Sequence
  Synthetic
gcguccgcguccggcgcuggg

SEQ ID NO: 31501 - RNA, 22 nt, Artificial Sequence
  Synthetic
cgcguccgcguccggcgcuggg

SEQ ID NO: 31502 - RNA, 23 nt, Artificial Sequence
  Synthetic
ucgcguccgcguccggcgcuggg

SEQ ID NO: 31503 - RNA, 24 nt, Artificial Sequence
  Synthetic
gucgcguccgcguccggcgcuggg

SEQ ID NO: 31504 - RNA, 18 nt, Artificial Sequence
  Synthetic
ccaagcacagagucuggg

SEQ ID NO: 31505 - RNA, 19 nt, Artificial Sequence
  Synthetic
cccaagcacagagucuggg

SEQ ID NO: 31506 - RNA, 20 nt, Artificial Sequence
  Synthetic
acccaagcacagagucuggg

SEQ ID NO: 31507 - RNA, 21 nt, Artificial Sequence
  Synthetic
cacccaagcacagagucuggg

SEQ ID NO: 31508 - RNA, 22 nt, Artificial Sequence
  Synthetic
acacccaagcacagagucuggg

SEQ ID NO: 31509 - RNA, 23 nt, Artificial Sequence
  Synthetic
gacacccaagcacagagucuggg

SEQ ID NO: 31510 - RNA, 24 nt, Artificial Sequence
  Synthetic
cgacacccaagcacagagucuggg

SEQ ID NO: 31511 - RNA, 18 nt, Artificial Sequence
  Synthetic
cgcgcucccugucgcugg

SEQ ID NO: 31512 - RNA, 19 nt, Artificial Sequence
  Synthetic
ccgcgcucccugucgcugg

SEQ ID NO: 31513 - RNA, 20 nt, Artificial Sequence
  Synthetic
cccgcgcucccugucgcugg

SEQ ID NO: 31514 - RNA, 21 nt, Artificial Sequence
  Synthetic
ccccgcgcucccugucgcugg

SEQ ID NO: 31515 - RNA, 22 nt, Artificial Sequence
  Synthetic
gccccgcgcucccugucgcugg

SEQ ID NO: 31516 - RNA, 23 nt, Artificial Sequence
  Synthetic
ggccccgcgcucccugucgcugg

SEQ ID NO: 31517 - RNA, 24 nt, Artificial Sequence
  Synthetic
cggccccgcgcucccugucgcugg

SEQ ID NO: 31518 - RNA, 18 nt, Artificial Sequence
  Synthetic
cucugcgggcggggcugg

SEQ ID NO: 31519 - RNA, 19 nt, Artificial Sequence
  Synthetic
ccucugcgggcggggcugg

SEQ ID NO: 31520 - RNA, 20 nt, Artificial Sequence
  Synthetic
uccucugcgggcggggcugg

SEQ ID NO: 31521 - RNA, 21 nt, Artificial Sequence
  Synthetic
uuccucugcgggcggggcugg

SEQ ID NO: 31522 - RNA, 22 nt, Artificial Sequence
  Synthetic
cuuccucugcgggcggggcugg

SEQ ID NO: 31523 - RNA, 23 nt, Artificial Sequence
  Synthetic
ucuuccucugcgggcggggcugg

SEQ ID NO: 31524 - RNA, 24 nt, Artificial Sequence
  Synthetic
cucuuccucugcgggcggggcugg

SEQ ID NO: 31525 - RNA, 18 nt, Artificial Sequence
  Synthetic
gccguggacuuuaucugg

SEQ ID NO: 31526 - RNA, 19 nt, Artificial Sequence
  Synthetic
ggccguggacuuuaucugg

SEQ ID NO: 31527 - RNA, 20 nt, Artificial Sequence
  Synthetic
cggccguggacuuuaucugg

SEQ ID NO: 31528 - RNA, 21 nt, Artificial Sequence
  Synthetic
acggccguggacuuuaucugg

SEQ ID NO: 31529 - RNA, 22 nt, Artificial Sequence
  Synthetic
cacggccguggacuuuaucugg

SEQ ID NO: 31530 - RNA, 23 nt, Artificial Sequence
  Synthetic
gcacggccguggacuuuaucugg

SEQ ID NO: 31531 - RNA, 24 nt, Artificial Sequence
  Synthetic
ggcacggccguggacuuuaucugg

SEQ ID NO: 31532 - RNA, 18 nt, Artificial Sequence
  Synthetic
cgcaggcgcggcgggugg

SEQ ID NO: 31533 - RNA, 19 nt, Artificial Sequence
  Synthetic
gcgcaggcgcggcgggugg

SEQ ID NO: 31534 - RNA, 20 nt, Artificial Sequence
  Synthetic
cgcgcaggcgcggcgggugg

SEQ ID NO: 31535 - RNA, 21 nt, Artificial Sequence
  Synthetic
gcgcgcaggcgcggcgggugg

SEQ ID NO: 31536 - RNA, 22 nt, Artificial Sequence
  Synthetic
cgcgcgcaggcgcggcgggugg

SEQ ID NO: 31537 - RNA, 23 nt, Artificial Sequence
  Synthetic
gcgcgcgcaggcgcggcgggugg

SEQ ID NO: 31538 - RNA, 24 nt, Artificial Sequence
  Synthetic
ggcgcgcgcaggcgcggcgggugg

SEQ ID NO: 31539 - RNA, 18 nt, Artificial Sequence
  Synthetic
uuugaccagggcacccug

SEQ ID NO: 31540 - RNA, 19 nt, Artificial Sequence
  Synthetic
cuuugaccagggcacccug

SEQ ID NO: 31541 - RNA, 20 nt, Artificial Sequence
  Synthetic
ucuuugaccagggcacccug

SEQ ID NO: 31542 - RNA, 21 nt, Artificial Sequence
  Synthetic
cucuuugaccagggcacccug

SEQ ID NO: 31543 - RNA, 22 nt, Artificial Sequence
  Synthetic
gcucuuugaccagggcacccug

SEQ ID NO: 31544 - RNA, 23 nt, Artificial Sequence
  Synthetic
ugcucuuugaccagggcacccug

SEQ ID NO: 31545 - RNA, 24 nt, Artificial Sequence
  Synthetic
augcucuuugaccagggcacccug

SEQ ID NO: 31546 - RNA, 18 nt, Artificial Sequence
  Synthetic
cguccgcguccggcgcug

SEQ ID NO: 31547 - RNA, 19 nt, Artificial Sequence
  Synthetic
gcguccgcguccggcgcug

SEQ ID NO: 31548 - RNA, 20 nt, Artificial Sequence
  Synthetic
cgcguccgcguccggcgcug

SEQ ID NO: 31549 - RNA, 21 nt, Artificial Sequence
  Synthetic
ucgcguccgcguccggcgcug

SEQ ID NO: 31550 - RNA, 22 nt, Artificial Sequence
  Synthetic
gucgcguccgcguccggcgcug

SEQ ID NO: 31551 - RNA, 23 nt, Artificial Sequence
  Synthetic
cgucgcguccgcguccggcgcug

SEQ ID NO: 31552 - RNA, 24 nt, Artificial Sequence
  Synthetic
gcgucgcguccgcguccggcgcug

SEQ ID NO: 31553 - RNA, 18 nt, Artificial Sequence
  Synthetic
ccgcgcucccugucgcug

SEQ ID NO: 31554 - RNA, 19 nt, Artificial Sequence
  Synthetic
cccgcgcucccugucgcug

SEQ ID NO: 31555 - RNA, 20 nt, Artificial Sequence
  Synthetic
ccccgcgcucccugucgcug

SEQ ID NO: 31556 - RNA, 21 nt, Artificial Sequence
  Synthetic
gccccgcgcucccugucgcug

SEQ ID NO: 31557 - RNA, 22 nt, Artificial Sequence
  Synthetic
ggccccgcgcucccugucgcug

SEQ ID NO: 31558 - RNA, 23 nt, Artificial Sequence
  Synthetic
cggccccgcgcucccugucgcug

SEQ ID NO: 31559 - RNA, 24 nt, Artificial Sequence
  Synthetic
acggccccgcgcucccugucgcug

SEQ ID NO: 31560 - RNA, 18 nt, Artificial Sequence
  Synthetic
ccucugcgggcggggcug

SEQ ID NO: 31561 - RNA, 19 nt, Artificial Sequence
  Synthetic
uccucugcgggcggggcug

SEQ ID NO: 31562 - RNA, 20 nt, Artificial Sequence
  Synthetic
uuccucugcgggcggggcug

SEQ ID NO: 31563 - RNA, 21 nt, Artificial Sequence
  Synthetic
cuuccucugcgggcggggcug

SEQ ID NO: 31564 - RNA, 22 nt, Artificial Sequence
  Synthetic
ucuuccucugcgggcggggcug

SEQ ID NO: 31565 - RNA, 23 nt, Artificial Sequence
  Synthetic
cucuuccucugcgggcggggcug

SEQ ID NO: 31566 - RNA, 24 nt, Artificial Sequence
  Synthetic
ccucuuccucugcgggcggggcug

SEQ ID NO: 31567 - RNA, 18 nt, Artificial Sequence
  Synthetic
gaccagacggggaacgug

SEQ ID NO: 31568 - RNA, 19 nt, Artificial Sequence
  Synthetic
ggaccagacggggaacgug

SEQ ID NO: 31569 - RNA, 20 nt, Artificial Sequence
  Synthetic
uggaccagacggggaacgug

SEQ ID NO: 31570 - RNA, 21 nt, Artificial Sequence
  Synthetic
guggaccagacggggaacgug

SEQ ID NO: 31571 - RNA, 22 nt, Artificial Sequence
  Synthetic
cguggaccagacggggaacgug

SEQ ID NO: 31572 - RNA, 23 nt, Artificial Sequence
  Synthetic
ucguggaccagacggggaacgug

SEQ ID NO: 31573 - RNA, 24 nt, Artificial Sequence
  Synthetic
cucguggaccagacggggaacgug

SEQ ID NO: 31574 - RNA, 18 nt, Artificial Sequence
  Synthetic
gccgucgcggccgucgug

SEQ ID NO: 31575 - RNA, 19 nt, Artificial Sequence
  Synthetic
ugccgucgcggccgucgug

SEQ ID NO: 31576 - RNA, 20 nt, Artificial Sequence
  Synthetic
cugccgucgcggccgucgug

SEQ ID NO: 31577 - RNA, 21 nt, Artificial Sequence
  Synthetic
ccugccgucgcggccgucgug

SEQ ID NO: 31578 - RNA, 22 nt, Artificial Sequence
  Synthetic
cccugccgucgcggccgucgug

SEQ ID NO: 31579 - RNA, 23 nt, Artificial Sequence
  Synthetic
gcccugccgucgcggccgucgug

SEQ ID NO: 31580 - RNA, 24 nt, Artificial Sequence
  Synthetic
ggcccugccgucgcggccgucgug

SEQ ID NO: 31581 - RNA, 18 nt, Artificial Sequence
  Synthetic
ggcgcgggggcggcggug

SEQ ID NO: 31582 - RNA, 19 nt, Artificial Sequence
  Synthetic
cggcgcgggggcggcggug

SEQ ID NO: 31583 - RNA, 20 nt, Artificial Sequence
  Synthetic
ccggcgcgggggcggcggug

SEQ ID NO: 31584 - RNA, 21 nt, Artificial Sequence
  Synthetic
cccggcgcgggggcggcggug

SEQ ID NO: 31585 - RNA, 22 nt, Artificial Sequence
  Synthetic
ccccggcgcgggggcggcggug

SEQ ID NO: 31586 - RNA, 23 nt, Artificial Sequence
  Synthetic
gccccggcgcgggggcggcggug

SEQ ID NO: 31587 - RNA, 24 nt, Artificial Sequence
  Synthetic
cgccccggcgcgggggcggcggug

SEQ ID NO: 31588 - RNA, 18 nt, Artificial Sequence
  Synthetic
cauggagacgggccacau

SEQ ID NO: 31589 - RNA, 19 nt, Artificial Sequence
  Synthetic
acauggagacgggccacau

SEQ ID NO: 31590 - RNA, 20 nt, Artificial Sequence
  Synthetic
gacauggagacgggccacau

SEQ ID NO: 31591 - RNA, 21 nt, Artificial Sequence
  Synthetic
ggacauggagacgggccacau

SEQ ID NO: 31592 - RNA, 22 nt, Artificial Sequence
  Synthetic
uggacauggagacgggccacau

SEQ ID NO: 31593 - RNA, 23 nt, Artificial Sequence
  Synthetic
cuggacauggagacgggccacau

SEQ ID NO: 31594 - RNA, 24 nt, Artificial Sequence
  Synthetic
ccuggacauggagacgggccacau

SEQ ID NO: 31595 - RNA, 18 nt, Artificial Sequence
  Synthetic
cacggccguggacuuuau

SEQ ID NO: 31596 - RNA, 19 nt, Artificial Sequence
  Synthetic
gcacggccguggacuuuau

SEQ ID NO: 31597 - RNA, 20 nt, Artificial Sequence
  Synthetic
ggcacggccguggacuuuau

SEQ ID NO: 31598 - RNA, 21 nt, Artificial Sequence
  Synthetic
cggcacggccguggacuuuau

SEQ ID NO: 31599 - RNA, 22 nt, Artificial Sequence
  Synthetic
ccggcacggccguggacuuuau

SEQ ID NO: 31600 - RNA, 23 nt, Artificial Sequence
  Synthetic
gccggcacggccguggacuuuau

SEQ ID NO: 31601 - RNA, 24 nt, Artificial Sequence
  Synthetic
ggccggcacggccguggacuuuau

SEQ ID NO: 31602 - RNA, 18 nt, Artificial Sequence
  Synthetic
gcguccgcguccggcgcu

SEQ ID NO: 31603 - RNA, 19 nt, Artificial Sequence
  Synthetic
cgcguccgcguccggcgcu

SEQ ID NO: 31604 - RNA, 20 nt, Artificial Sequence
  Synthetic
ucgcguccgcguccggcgcu

SEQ ID NO: 31605 - RNA, 21 nt, Artificial Sequence
  Synthetic
gucgcguccgcguccggcgcu

SEQ ID NO: 31606 - RNA, 22 nt, Artificial Sequence
  Synthetic
cgucgcguccgcguccggcgcu

SEQ ID NO: 31607 - RNA, 23 nt, Artificial Sequence
  Synthetic
gcgucgcguccgcguccggcgcu

SEQ ID NO: 31608 - RNA, 24 nt, Artificial Sequence
  Synthetic
agcgucgcguccgcguccggcgcu

SEQ ID NO: 31609 - RNA, 18 nt, Artificial Sequence
  Synthetic
cccgcgcucccugucgcu

SEQ ID NO: 31610 - RNA, 19 nt, Artificial Sequence
  Synthetic
ccccgcgcucccugucgcu

SEQ ID NO: 31611 - RNA, 20 nt, Artificial Sequence
  Synthetic
gccccgcgcucccugucgcu

SEQ ID NO: 31612 - RNA, 21 nt, Artificial Sequence
  Synthetic
ggccccgcgcucccugucgcu

SEQ ID NO: 31613 - RNA, 22 nt, Artificial Sequence
  Synthetic
cggccccgcgcucccugucgcu

SEQ ID NO: 31614 - RNA, 23 nt, Artificial Sequence
  Synthetic
acggccccgcgcucccugucgcu

SEQ ID NO: 31615 - RNA, 24 nt, Artificial Sequence
  Synthetic
gacggccccgcgcucccugucgcu

SEQ ID NO: 31616 - RNA, 18 nt, Artificial Sequence
  Synthetic
gaacguggcggaccugcu

SEQ ID NO: 31617 - RNA, 19 nt, Artificial Sequence
  Synthetic
ggaacguggcggaccugcu

SEQ ID NO: 31618 - RNA, 20 nt, Artificial Sequence
  Synthetic
gggaacguggcggaccugcu

SEQ ID NO: 31619 - RNA, 21 nt, Artificial Sequence
  Synthetic
ggggaacguggcggaccugcu

SEQ ID NO: 31620 - RNA, 22 nt, Artificial Sequence
  Synthetic
cggggaacguggcggaccugcu

SEQ ID NO: 31621 - RNA, 23 nt, Artificial Sequence
  Synthetic
acggggaacguggcggaccugcu

SEQ ID NO: 31622 - RNA, 24 nt, Artificial Sequence
  Synthetic
gacggggaacguggcggaccugcu

SEQ ID NO: 31623 - RNA, 18 nt, Artificial Sequence
  Synthetic
uccuccgccucuuccucu

SEQ ID NO: 31624 - RNA, 19 nt, Artificial Sequence
  Synthetic
cuccuccgccucuuccucu

SEQ ID NO: 31625 - RNA, 20 nt, Artificial Sequence
  Synthetic
ccuccuccgccucuuccucu

SEQ ID NO: 31626 - RNA, 21 nt, Artificial Sequence
  Synthetic
uccuccuccgccucuuccucu

SEQ ID NO: 31627 - RNA, 22 nt, Artificial Sequence
  Synthetic
cuccuccuccgccucuuccucu

SEQ ID NO: 31628 - RNA, 23 nt, Artificial Sequence
  Synthetic
ccuccuccuccgccucuuccucu

SEQ ID NO: 31629 - RNA, 24 nt, Artificial Sequence
  Synthetic
uccuccuccuccgccucuuccucu

SEQ ID NO: 31630 - RNA, 18 nt, Artificial Sequence
  Synthetic
ggggugggaucugggucu

SEQ ID NO: 31631 - RNA, 19 nt, Artificial Sequence
  Synthetic
gggggugggaucugggucu

SEQ ID NO: 31632 - RNA, 20 nt, Artificial Sequence
  Synthetic
cgggggugggaucugggucu

SEQ ID NO: 31633 - RNA, 21 nt, Artificial Sequence
  Synthetic
gcgggggugggaucugggucu

SEQ ID NO: 31634 - RNA, 22 nt, Artificial Sequence
  Synthetic
ggcgggggugggaucugggucu

SEQ ID NO: 31635 - RNA, 23 nt, Artificial Sequence
  Synthetic
gggcgggggugggaucugggucu

SEQ ID NO: 31636 - RNA, 24 nt, Artificial Sequence
  Synthetic
cgggcgggggugggaucugggucu

SEQ ID NO: 31637 - RNA, 18 nt, Artificial Sequence
  Synthetic
ucgcgccacccguggucu

SEQ ID NO: 31638 - RNA, 19 nt, Artificial Sequence
  Synthetic
gucgcgccacccguggucu

SEQ ID NO: 31639 - RNA, 20 nt, Artificial Sequence
  Synthetic
ggucgcgccacccguggucu

SEQ ID NO: 31640 - RNA, 21 nt, Artificial Sequence
  Synthetic
cggucgcgccacccguggucu

SEQ ID NO: 31641 - RNA, 22 nt, Artificial Sequence
  Synthetic
ccggucgcgccacccguggucu

SEQ ID NO: 31642 - RNA, 23 nt, Artificial Sequence
  Synthetic
uccggucgcgccacccguggucu

SEQ ID NO: 31643 - RNA, 24 nt, Artificial Sequence
  Synthetic
cuccggucgcgccacccguggucu

SEQ ID NO: 31644 - RNA, 18 nt, Artificial Sequence
  Synthetic
gccgcccccguggugucu

SEQ ID NO: 31645 - RNA, 19 nt, Artificial Sequence
  Synthetic
cgccgcccccguggugucu

SEQ ID NO: 31646 - RNA, 20 nt, Artificial Sequence
  Synthetic
ccgccgcccccguggugucu

SEQ ID NO: 31647 - RNA, 21 nt, Artificial Sequence
  Synthetic
gccgccgcccccguggugucu

SEQ ID NO: 31648 - RNA, 22 nt, Artificial Sequence
  Synthetic
cgccgccgcccccguggugucu

SEQ ID NO: 31649 - RNA, 23 nt, Artificial Sequence
  Synthetic
ccgccgccgcccccguggugucu

SEQ ID NO: 31650 - RNA, 24 nt, Artificial Sequence
  Synthetic
gccgccgccgcccccguggugucu

SEQ ID NO: 31651 - RNA, 18 nt, Artificial Sequence
  Synthetic
gacacccaagcacagagu

SEQ ID NO: 31652 - RNA, 19 nt, Artificial Sequence
  Synthetic
cgacacccaagcacagagu

SEQ ID NO: 31653 - RNA, 20 nt, Artificial Sequence
  Synthetic
ccgacacccaagcacagagu

SEQ ID NO: 31654 - RNA, 21 nt, Artificial Sequence
  Synthetic
accgacacccaagcacagagu

SEQ ID NO: 31655 - RNA, 22 nt, Artificial Sequence
  Synthetic
gaccgacacccaagcacagagu

SEQ ID NO: 31656 - RNA, 23 nt, Artificial Sequence
  Synthetic
agaccgacacccaagcacagagu

SEQ ID NO: 31657 - RNA, 24 nt, Artificial Sequence
  Synthetic
cagaccgacacccaagcacagagu

SEQ ID NO: 31658 - RNA, 18 nt, Artificial Sequence
  Synthetic
ggaggccgaggcggccgu

SEQ ID NO: 31659 - RNA, 19 nt, Artificial Sequence
  Synthetic
uggaggccgaggcggccgu

SEQ ID NO: 31660 - RNA, 20 nt, Artificial Sequence
  Synthetic
guggaggccgaggcggccgu

SEQ ID NO: 31661 - RNA, 21 nt, Artificial Sequence
  Synthetic
cguggaggccgaggcggccgu

SEQ ID NO: 31662 - RNA, 22 nt, Artificial Sequence
  Synthetic
gcguggaggccgaggcggccgu

SEQ ID NO: 31663 - RNA, 23 nt, Artificial Sequence
  Synthetic
cgcguggaggccgaggcggccgu

SEQ ID NO: 31664 - RNA, 24 nt, Artificial Sequence
  Synthetic
ccgcguggaggccgaggcggccgu

SEQ ID NO: 31665 - RNA, 18 nt, Artificial Sequence
  Synthetic
ggccgucgccccgcgcgu

SEQ ID NO: 31666 - RNA, 19 nt, Artificial Sequence
  Synthetic
cggccgucgccccgcgcgu

SEQ ID NO: 31667 - RNA, 20 nt, Artificial Sequence
  Synthetic
gcggccgucgccccgcgcgu

SEQ ID NO: 31668 - RNA, 21 nt, Artificial Sequence
  Synthetic
cgcggccgucgccccgcgcgu

SEQ ID NO: 31669 - RNA, 22 nt, Artificial Sequence
  Synthetic
gcgcggccgucgccccgcgcgu

SEQ ID NO: 31670 - RNA, 23 nt, Artificial Sequence
  Synthetic
cgcgcggccgucgccccgcgcgu

SEQ ID NO: 31671 - RNA, 24 nt, Artificial Sequence
  Synthetic
ccgcgcggccgucgccccgcgcgu

SEQ ID NO: 31672 - RNA, 18 nt, Artificial Sequence
  Synthetic
gaggucugccacagucgu

SEQ ID NO: 31673 - RNA, 19 nt, Artificial Sequence
  Synthetic
ggaggucugccacagucgu

SEQ ID NO: 31674 - RNA, 20 nt, Artificial Sequence
  Synthetic
gggaggucugccacagucgu

SEQ ID NO: 31675 - RNA, 21 nt, Artificial Sequence
  Synthetic
ggggaggucugccacagucgu

SEQ ID NO: 31676 - RNA, 22 nt, Artificial Sequence
  Synthetic
gggggaggucugccacagucgu

SEQ ID NO: 31677 - RNA, 23 nt, Artificial Sequence
  Synthetic
ggggggaggucugccacagucgu

SEQ ID NO: 31678 - RNA, 24 nt, Artificial Sequence
  Synthetic
gggggggaggucugccacagucgu

SEQ ID NO: 31679 - RNA, 18 nt, Artificial Sequence
  Synthetic
cggcgcgggggcggcggu

SEQ ID NO: 31680 - RNA, 19 nt, Artificial Sequence
  Synthetic
ccggcgcgggggcggcggu

SEQ ID NO: 31681 - RNA, 20 nt, Artificial Sequence
  Synthetic
cccggcgcgggggcggcggu

SEQ ID NO: 31682 - RNA, 21 nt, Artificial Sequence
  Synthetic
ccccggcgcgggggcggcggu

SEQ ID NO: 31683 - RNA, 22 nt, Artificial Sequence
  Synthetic
gccccggcgcgggggcggcggu

SEQ ID NO: 31684 - RNA, 23 nt, Artificial Sequence
  Synthetic
cgccccggcgcgggggcggcggu

SEQ ID NO: 31685 - RNA, 24 nt, Artificial Sequence
  Synthetic
gcgccccggcgcgggggcggcggu

SEQ ID NO: 31686 - RNA, 18 nt, Artificial Sequence
  Synthetic
cgaccgacgcgcgcgggu

SEQ ID NO: 31687 - RNA, 19 nt, Artificial Sequence
  Synthetic
gcgaccgacgcgcgcgggu

SEQ ID NO: 31688 - RNA, 20 nt, Artificial Sequence
  Synthetic
cgcgaccgacgcgcgcgggu

SEQ ID NO: 31689 - RNA, 21 nt, Artificial Sequence
  Synthetic
gcgcgaccgacgcgcgcgggu

SEQ ID NO: 31690 - RNA, 22 nt, Artificial Sequence
  Synthetic
ggcgcgaccgacgcgcgcgggu

SEQ ID NO: 31691 - RNA, 23 nt, Artificial Sequence
  Synthetic
aggcgcgaccgacgcgcgcgggu

SEQ ID NO: 31692 - RNA, 24 nt, Artificial Sequence
  Synthetic
caggcgcgaccgacgcgcgcgggu

SEQ ID NO: 31693 - RNA, 18 nt, Artificial Sequence
  Synthetic
ccucgccccccagggggu

SEQ ID NO: 31694 - RNA, 19 nt, Artificial Sequence
  Synthetic
cccucgccccccagggggu

SEQ ID NO: 31695 - RNA, 20 nt, Artificial Sequence
  Synthetic
ccccucgccccccagggggu

SEQ ID NO: 31696 - RNA, 21 nt, Artificial Sequence
  Synthetic
gccccucgccccccagggggu

SEQ ID NO: 31697 - RNA, 22 nt, Artificial Sequence
  Synthetic
cgccccucgccccccagggggu

SEQ ID NO: 31698 - RNA, 23 nt, Artificial Sequence
  Synthetic
ucgccccucgccccccagggggu

SEQ ID NO: 31699 - RNA, 24 nt, Artificial Sequence
  Synthetic
cucgccccucgccccccagggggu

SEQ ID NO: 31700 - RNA, 18 nt, Artificial Sequence
  Synthetic
cgggggugggaucugggu

SEQ ID NO: 31701 - RNA, 19 nt, Artificial Sequence
  Synthetic
gcgggggugggaucugggu

SEQ ID NO: 31702 - RNA, 20 nt, Artificial Sequence
  Synthetic
ggcgggggugggaucugggu

SEQ ID NO: 31703 - RNA, 21 nt, Artificial Sequence
  Synthetic
gggcgggggugggaucugggu

SEQ ID NO: 31704 - RNA, 22 nt, Artificial Sequence
  Synthetic
cgggcgggggugggaucugggu

SEQ ID NO: 31705 - RNA, 23 nt, Artificial Sequence
  Synthetic
gcgggcgggggugggaucugggu

SEQ ID NO: 31706 - RNA, 24 nt, Artificial Sequence
  Synthetic
ugcgggcgggggugggaucugggu

SEQ ID NO: 31707 - RNA, 18 nt, Artificial Sequence
  Synthetic
ucugcgggcggggcuggu

SEQ ID NO: 31708 - RNA, 19 nt, Artificial Sequence
  Synthetic
cucugcgggcggggcuggu

SEQ ID NO: 31709 - RNA, 20 nt, Artificial Sequence
  Synthetic
ccucugcgggcggggcuggu

SEQ ID NO: 31710 - RNA, 21 nt, Artificial Sequence
  Synthetic
uccucugcgggcggggcuggu

SEQ ID NO: 31711 - RNA, 22 nt, Artificial Sequence
  Synthetic
uuccucugcgggcggggcuggu

SEQ ID NO: 31712 - RNA, 23 nt, Artificial Sequence
  Synthetic
cuuccucugcgggcggggcuggu

SEQ ID NO: 31713 - RNA, 24 nt, Artificial Sequence
  Synthetic
ucuuccucugcgggcggggcuggu

SEQ ID NO: 31714 - RNA, 18 nt, Artificial Sequence
  Synthetic
cagcggcggcgccccguu

SEQ ID NO: 31715 - RNA, 19 nt, Artificial Sequence
  Synthetic
gcagcggcggcgccccguu

SEQ ID NO: 31716 - RNA, 20 nt, Artificial Sequence
  Synthetic
agcagcggcggcgccccguu

SEQ ID NO: 31717 - RNA, 21 nt, Artificial Sequence
  Synthetic
cagcagcggcggcgccccguu

SEQ ID NO: 31718 - RNA, 22 nt, Artificial Sequence
  Synthetic
gcagcagcggcggcgccccguu

SEQ ID NO: 31719 - RNA, 23 nt, Artificial Sequence
  Synthetic
agcagcagcggcggcgccccguu

SEQ ID NO: 31720 - RNA, 24 nt, Artificial Sequence
  Synthetic
cagcagcagcggcggcgccccguu

SEQ ID NO: 31721 - RNA, 17 nt, Artificial Sequence
  Synthetic
gcggugaaggucgucgu

SEQ ID NO: 31722 - RNA, 20 nt, Artificial Sequence
  Synthetic
gucgcggugaaggucgucgu

SEQ ID NO: 31723 - RNA, 17 nt, Artificial Sequence
  Synthetic
cacacgucgcccccccc

SEQ ID NO: 31724 - RNA, 17 nt, Artificial Sequence
  Synthetic
ucgccccccccucccgc

SEQ ID NO: 31725 - RNA, 20 nt, Artificial Sequence
  Synthetic
cugcaucccgugcaugaaga

SEQ ID NO: 31726 - RNA, 20 nt, Artificial Sequence
  Synthetic
acgucgccccccccucccgc

SEQ ID NO: 31727 - RNA, 17 nt, Artificial Sequence
  Synthetic
caucccgugcaugaaga

SEQ ID NO: 31728 - RNA, 17 nt, Artificial Sequence
  Synthetic
ccugcccggcccagacu

SEQ ID NO: 31729 - RNA, 20 nt, Artificial Sequence
  Synthetic
gcgccugcccggcccagacu

SEQ ID NO: 31730 - RNA, 17 nt, Artificial Sequence
  Synthetic
ggcaguugguggucgga

SEQ ID NO: 31731 - RNA, 17 nt, Artificial Sequence
  Synthetic
ggggggacccaaacgac

SEQ ID NO: 31732 - RNA, 17 nt, Artificial Sequence
  Synthetic
gcaguugguggucggac

SEQ ID NO: 31733 - RNA, 17 nt, Artificial Sequence
  Synthetic
gacaccggccgaccccc

SEQ ID NO: 31734 - RNA, 17 nt, Artificial Sequence
  Synthetic
ggugaucucuggcacgc

SEQ ID NO: 31735 - RNA, 17 nt, Artificial Sequence
  Synthetic
gggaccggggugaucuc

SEQ ID NO: 31736 - RNA, 17 nt, Artificial Sequence
  Synthetic
gccggcccuuagauaag

SEQ ID NO: 31737 - RNA, 17 nt, Artificial Sequence
  Synthetic
gacagggggcgccccag

SEQ ID NO: 31738 - RNA, 17 nt, Artificial Sequence
  Synthetic
gcuucuccccaauagag

SEQ ID NO: 31739 - RNA, 17 nt, Artificial Sequence
  Synthetic
gugaucucuggcacgcg

SEQ ID NO: 31740 - RNA, 17 nt, Artificial Sequence
  Synthetic
gucggccacgccacucg

SEQ ID NO: 31741 - RNA, 17 nt, Artificial Sequence
  Synthetic
gccacgccacucgcggg

SEQ ID NO: 31742 - RNA, 17 nt, Artificial Sequence
  Synthetic
gugggucauuggcgugg

SEQ ID NO: 31743 - RNA, 17 nt, Artificial Sequence
  Synthetic
guccccccccucuauug

SEQ ID NO: 31744 - RNA, 17 nt, Artificial Sequence
  Synthetic
ggguccccccccucuau

SEQ ID NO: 31745 - RNA, 17 nt, Artificial Sequence
  Synthetic
gccuucuuggaguacgu

SEQ ID NO: 31746 - RNA, 17 nt, Artificial Sequence
  Synthetic
gaagaccgccagggggu

SEQ ID NO: 31747 - RNA, 17 nt, Artificial Sequence
  Synthetic
gguccccccccucuauu

SEQ ID NO: 31748 - RNA, 17 nt, Artificial Sequence
  Synthetic
gggcgcccccugucguu

SEQ ID NO: 31749 - RNA, 17 nt, Artificial Sequence
  Synthetic
ggcgcccccugucguuu

SEQ ID NO: 31750 - RNA, 20 nt, Artificial Sequence
  Synthetic
ggggggggacccaaacgaca

SEQ ID NO: 31751 - RNA, 20 nt, Artificial Sequence
  Synthetic
ggccggcuggaagaccgcca

SEQ ID NO: 31752 - RNA, 20 nt, Artificial Sequence
  Synthetic
gugggggguuacagcgacac

SEQ ID NO: 31753 - RNA, 20 nt, Artificial Sequence
  Synthetic
gggccggcuggaagaccgcc

SEQ ID NO: 31754 - RNA, 20 nt, Artificial Sequence
  Synthetic
gccggcuggaagaccgccag

SEQ ID NO: 31755 - RNA, 20 nt, Artificial Sequence
  Synthetic
ggggugaucucuggcacgcg

SEQ ID NO: 31756 - RNA, 20 nt, Artificial Sequence
  Synthetic
gagcccacccgcgaguggcg

SEQ ID NO: 31757 - RNA, 20 nt, Artificial Sequence
  Synthetic
gaguacgugggucauuggcg

SEQ ID NO: 31758 - RNA, 20 nt, Artificial Sequence
  Synthetic
ggggggacccaaacgacagg

SEQ ID NO: 31759 - RNA, 20 nt, Artificial Sequence
  Synthetic
gcgaggauacggaggagugg

SEQ ID NO: 31760 - RNA, 20 nt, Artificial Sequence
  Synthetic
guacgugggucauuggcgug

SEQ ID NO: 31761 - RNA, 20 nt, Artificial Sequence
  Synthetic
ggcgccccagaggcuaaggu

SEQ ID NO: 31762 - RNA, 20 nt, Artificial Sequence
  Synthetic
gaucucuggcacgcgggggu

SEQ ID NO: 31763 - RNA, 17 nt, Artificial Sequence
  Synthetic
agccggcccuuagauaa

SEQ ID NO: 31764 - RNA, 17 nt, Artificial Sequence
  Synthetic
acccacguacuccaaga

SEQ ID NO: 31765 - RNA, 17 nt, Artificial Sequence
  Synthetic
cagccggcccuuagaua

SEQ ID NO: 31766 - RNA, 17 nt, Artificial Sequence
  Synthetic
ccggcuggaagaccgcc

SEQ ID NO: 31767 - RNA, 17 nt, Artificial Sequence
  Synthetic
ucggccacgccacucgc

SEQ ID NO: 31768 - RNA, 17 nt, Artificial Sequence
  Synthetic
accgccagggggucggc

SEQ ID NO: 31769 - RNA, 17 nt, Artificial Sequence
  Synthetic
acgagcccacccgcgag

SEQ ID NO: 31770 - RNA, 17 nt, Artificial Sequence
  Synthetic
cccacccgcgaguggcg

SEQ ID NO: 31771 - RNA, 17 nt, Artificial Sequence
  Synthetic
uacgugggucauuggcg

SEQ ID NO: 31772 - RNA, 17 nt, Artificial Sequence
  Synthetic
ccggcccuuagauaagg

SEQ ID NO: 31773 - RNA, 17 nt, Artificial Sequence
  Synthetic
cuaaagcgaggauacgg

SEQ ID NO: 31774 - RNA, 17 nt, Artificial Sequence
  Synthetic
accggccgacccccugg

SEQ ID NO: 31775 - RNA, 17 nt, Artificial Sequence
  Synthetic
cgugggucauuggcgug

SEQ ID NO: 31776 - RNA, 17 nt, Artificial Sequence
  Synthetic
uggaguacgugggucau

SEQ ID NO: 31777 - RNA, 17 nt, Artificial Sequence
  Synthetic
acgugggucauuggcgu

SEQ ID NO: 31778 - RNA, 17 nt, Artificial Sequence
  Synthetic
ccacgccacucgcgggu

SEQ ID NO: 31779 - RNA, 17 nt, Artificial Sequence
  Synthetic
cuccguauccucgcuuu

SEQ ID NO: 31780 - RNA, 20 nt, Artificial Sequence
  Synthetic
cuggcacgcgggggugggaa

SEQ ID NO: 31781 - RNA, 20 nt, Artificial Sequence
  Synthetic
uccagccggcccuuagauaa

SEQ ID NO: 31782 - RNA, 20 nt, Artificial Sequence
  Synthetic
ccaacugcccccuuaucuaa

SEQ ID NO: 31783 - RNA, 20 nt, Artificial Sequence
  Synthetic
augacccacguacuccaaga

SEQ ID NO: 31784 - RNA, 20 nt, Artificial Sequence
  Synthetic
uuccagccggcccuuagaua

SEQ ID NO: 31785 - RNA, 20 nt, Artificial Sequence
  Synthetic
uuguuccuaaagcgaggaua

SEQ ID NO: 31786 - RNA, 20 nt, Artificial Sequence
  Synthetic
uaaguaacagagucugacua

SEQ ID NO: 31787 - RNA, 20 nt, Artificial Sequence
  Synthetic
agcgacaccggccgaccccc

SEQ ID NO: 31788 - RNA, 20 nt, Artificial Sequence
  Synthetic
cccgccuguguuuuugugcc

SEQ ID NO: 31789 - RNA, 20 nt, Artificial Sequence
  Synthetic
aggucggccacgccacucgc

SEQ ID NO: 31790 - RNA, 20 nt, Artificial Sequence
  Synthetic
aagaccgccagggggucggc

SEQ ID NO: 31791 - RNA, 20 nt, Artificial Sequence
  Synthetic
cgaggauacggaggaguggc

SEQ ID NO: 31792 - RNA, 20 nt, Artificial Sequence
  Synthetic
aacacgagcccacccgcgag

SEQ ID NO: 31793 - RNA, 20 nt, Artificial Sequence
  Synthetic
aaggucggccacgccacucg

SEQ ID NO: 31794 - RNA, 20 nt, Artificial Sequence
  Synthetic
ccggcuggaagaccgccagg

SEQ ID NO: 31795 - RNA, 20 nt, Artificial Sequence
  Synthetic
uuccuaaagcgaggauacgg

SEQ ID NO: 31796 - RNA, 20 nt, Artificial Sequence
  Synthetic
uaacagagucugacuaaggg

SEQ ID NO: 31797 - RNA, 20 nt, Artificial Sequence
  Synthetic
ucggccacgccacucgcggg

SEQ ID NO: 31798 - RNA, 20 nt, Artificial Sequence
  Synthetic
uugggucuuacugccugggg

SEQ ID NO: 31799 - RNA, 20 nt, Artificial Sequence
  Synthetic
acgugggucauuggcguggg

SEQ ID NO: 31800 - RNA, 20 nt, Artificial Sequence
  Synthetic
agagucugacuaaggguggg

SEQ ID NO: 31801 - RNA, 20 nt, Artificial Sequence
  Synthetic
uacgugggucauuggcgugg

SEQ ID NO: 31802 - RNA, 20 nt, Artificial Sequence
  Synthetic
cccuuagauaagggggcagu

SEQ ID NO: 31803 - RNA, 20 nt, Artificial Sequence
  Synthetic
caugccuucuuggaguacgu

SEQ ID NO: 31804 - RNA, 20 nt, Artificial Sequence
  Synthetic
aguacgugggucauuggcgu

SEQ ID NO: 31805 - RNA, 20 nt, Artificial Sequence
  Synthetic
cggccacgccacucgcgggu

SEQ ID NO: 31806 - RNA, 20 nt, Artificial Sequence
  Synthetic
uuggguccccccccucuauu

SEQ ID NO: 31807 - RNA, 20 nt, Artificial Sequence
  Synthetic
cucgcuuuaggaacaacuuu

SEQ ID NO: 31808 - RNA, 20 nt, Artificial Sequence
  Synthetic
cuccuccguauccucgcuuu

SEQ ID NO: 31809 - RNA, 20 nt, Artificial Sequence
  Synthetic
uggggcgcccccugucguuu

SEQ ID NO: 31810 - RNA, 17 nt, Artificial Sequence
  Synthetic
ggagggggggaaaagaa

SEQ ID NO: 31811 - RNA, 17 nt, Artificial Sequence
  Synthetic
gcacgcgggggugggaa

SEQ ID NO: 31812 - RNA, 17 nt, Artificial Sequence
  Synthetic
gggggacccaaacgaca

SEQ ID NO: 31813 - RNA, 17 nt, Artificial Sequence
  Synthetic
guguggaaggaaaugca

SEQ ID NO: 31814 - RNA, 17 nt, Artificial Sequence
  Synthetic
ggggggagugcggggga

SEQ ID NO: 31815 - RNA, 17 nt, Artificial Sequence
  Synthetic
ggcacgcggggguggga

SEQ ID NO: 31816 - RNA, 17 nt, Artificial Sequence
  Synthetic
gggagggggggugugga

SEQ ID NO: 31817 - RNA, 17 nt, Artificial Sequence
  Synthetic
guaacagagucugacua

SEQ ID NO: 31818 - RNA, 17 nt, Artificial Sequence
  Synthetic
gggcgccccagaggcua

SEQ ID NO: 31819 - RNA, 17 nt, Artificial Sequence
  Synthetic
gagggggggaaaagaac

SEQ ID NO: 31820 - RNA, 17 nt, Artificial Sequence
  Synthetic
gccaggcacaaaaacac

SEQ ID NO: 31821 - RNA, 17 nt, Artificial Sequence
  Synthetic
ggggguuacagcgacac

SEQ ID NO: 31822 - RNA, 17 nt, Artificial Sequence
  Synthetic
ggcgggugccgggggac

SEQ ID NO: 31823 - RNA, 17 nt, Artificial Sequence
  Synthetic
gcgggugccgggggacc

SEQ ID NO: 31824 - RNA, 17 nt, Artificial Sequence
  Synthetic
gcuugggucuuacugcc

SEQ ID NO: 31825 - RNA, 17 nt, Artificial Sequence
  Synthetic
gaggaguggcgggugcc

SEQ ID NO: 31826 - RNA, 17 nt, Artificial Sequence
  Synthetic
gccuguguuuuugugcc

SEQ ID NO: 31827 - RNA, 17 nt, Artificial Sequence
  Synthetic
ggcacaaaaacacaggc

SEQ ID NO: 31828 - RNA, 17 nt, Artificial Sequence
  Synthetic
gggggaaaagaacgggc

SEQ ID NO: 31829 - RNA, 17 nt, Artificial Sequence
  Synthetic
ggauacggaggaguggc

SEQ ID NO: 31830 - RNA, 17 nt, Artificial Sequence
  Synthetic
ggaggaguggcgggugc

SEQ ID NO: 31831 - RNA, 17 nt, Artificial Sequence
  Synthetic
ggggacccaaacgacag

SEQ ID NO: 31832 - RNA, 17 nt, Artificial Sequence
  Synthetic
ggcuggaagaccgccag

SEQ ID NO: 31833 - RNA, 17 nt, Artificial Sequence
  Synthetic
gcgaggauacggaggag

SEQ ID NO: 31834 - RNA, 17 nt, Artificial Sequence
  Synthetic
gggggagugcgggggag

SEQ ID NO: 31835 - RNA, 17 nt, Artificial Sequence
  Synthetic
gggaagggucgggggag

SEQ ID NO: 31836 - RNA, 17 nt, Artificial Sequence
  Synthetic
gggugaucucuggcacg

SEQ ID NO: 31837 - RNA, 17 nt, Artificial Sequence
  Synthetic
gcacaaaaacacaggcg

SEQ ID NO: 31838 - RNA, 17 nt, Artificial Sequence
  Synthetic
gggggugggaagggucg

SEQ ID NO: 31839 - RNA, 17 nt, Artificial Sequence
  Synthetic
gggacccaaacgacagg

SEQ ID NO: 31840 - RNA, 17 nt, Artificial Sequence
  Synthetic
gcuggaagaccgccagg

SEQ ID NO: 31841 - RNA, 17 nt, Artificial Sequence
  Synthetic
ggggagugcgggggagg

SEQ ID NO: 31842 - RNA, 17 nt, Artificial Sequence
  Synthetic
ggaagggucgggggagg

SEQ ID NO: 31843 - RNA, 17 nt, Artificial Sequence
  Synthetic
ggaguggcgggugccgg

SEQ ID NO: 31844 - RNA, 17 nt, Artificial Sequence
  Synthetic
ggggggggggagugcgg

SEQ ID NO: 31845 - RNA, 17 nt, Artificial Sequence
  Synthetic
ggggugggaagggucgg

SEQ ID NO: 31846 - RNA, 17 nt, Artificial Sequence
  Synthetic
gggagugcgggggaggg

SEQ ID NO: 31847 - RNA, 17 nt, Artificial Sequence
  Synthetic
gaagggucgggggaggg

SEQ ID NO: 31848 - RNA, 17 nt, Artificial Sequence
  Synthetic
gacuaagggugggaggg

SEQ ID NO: 31849 - RNA, 17 nt, Artificial Sequence
  Synthetic
ggagugcgggggagggg

SEQ ID NO: 31850 - RNA, 17 nt, Artificial Sequence
  Synthetic
gggggggagugcggggg

SEQ ID NO: 31851 - RNA, 17 nt, Artificial Sequence
  Synthetic
gugggaagggucggggg

SEQ ID NO: 31852 - RNA, 17 nt, Artificial Sequence
  Synthetic
gucuuacugccuggggg

SEQ ID NO: 31853 - RNA, 17 nt, Artificial Sequence
  Synthetic
ggucuuacugccugggg

SEQ ID NO: 31854 - RNA, 17 nt, Artificial Sequence
  Synthetic
gggucuuacugccuggg

SEQ ID NO: 31855 - RNA, 17 nt, Artificial Sequence
  Synthetic
gucugacuaaggguggg

SEQ ID NO: 31856 - RNA, 17 nt, Artificial Sequence
  Synthetic
gauaagggggcaguugg

SEQ ID NO: 31857 - RNA, 17 nt, Artificial Sequence
  Synthetic
gccgaccuuagccucug

SEQ ID NO: 31858 - RNA, 17 nt, Artificial Sequence
  Synthetic
gcgggggagggggggug

SEQ ID NO: 31859 - RNA, 17 nt, Artificial Sequence
  Synthetic
gccuggcucucuaugcu

SEQ ID NO: 31860 - RNA, 17 nt, Artificial Sequence
  Synthetic
ggccgaccuuagccucu

SEQ ID NO: 31861 - RNA, 17 nt, Artificial Sequence
  Synthetic
gccccagaggcuaaggu

SEQ ID NO: 31862 - RNA, 17 nt, Artificial Sequence
  Synthetic
gcgggggugggaagggu

SEQ ID NO: 31863 - RNA, 17 nt, Artificial Sequence
  Synthetic
gcuuuaggaacaacuuu

SEQ ID NO: 31864 - RNA, 20 nt, Artificial Sequence
  Synthetic
gugggagggggggaaaagaa

SEQ ID NO: 31865 - RNA, 20 nt, Artificial Sequence
  Synthetic
gggguguggaaggaaaugca

SEQ ID NO: 31866 - RNA, 20 nt, Artificial Sequence
  Synthetic
gggggcaguugguggucgga

SEQ ID NO: 31867 - RNA, 20 nt, Artificial Sequence
  Synthetic
gggggggggagugcggggga

SEQ ID NO: 31868 - RNA, 20 nt, Artificial Sequence
  Synthetic
gggugggaagggucggggga

SEQ ID NO: 31869 - RNA, 20 nt, Artificial Sequence
  Synthetic
gagucugacuaaggguggga

SEQ ID NO: 31870 - RNA, 20 nt, Artificial Sequence
  Synthetic
ggggcaguugguggucggac

SEQ ID NO: 31871 - RNA, 20 nt, Artificial Sequence
  Synthetic
guggcgggugccgggggacc

SEQ ID NO: 31872 - RNA, 20 nt, Artificial Sequence
  Synthetic
gcguggccgaccuuagccuc

SEQ ID NO: 31873 - RNA, 20 nt, Artificial Sequence
  Synthetic
gggggggacccaaacgacag

SEQ ID NO: 31874 - RNA, 20 nt, Artificial Sequence
  Synthetic
ggggggggagugcgggggag

SEQ ID NO: 31875 - RNA, 20 nt, Artificial Sequence
  Synthetic
ggugggaagggucgggggag

SEQ ID NO: 31876 - RNA, 20 nt, Artificial Sequence
  Synthetic
gccuggggggggggagugcg

SEQ ID NO: 31877 - RNA, 20 nt, Artificial Sequence
  Synthetic
gccaggcacaaaaacacagg

SEQ ID NO: 31878 - RNA, 20 nt, Artificial Sequence
  Synthetic
gggggggagugcgggggagg

SEQ ID NO: 31879 - RNA, 20 nt, Artificial Sequence
  Synthetic
gugggaagggucgggggagg

SEQ ID NO: 31880 - RNA, 20 nt, Artificial Sequence
  Synthetic
gucugacuaagggugggagg

SEQ ID NO: 31881 - RNA, 20 nt, Artificial Sequence
  Synthetic
gcuuuaggaacaacuuuagg

SEQ ID NO: 31882 - RNA, 20 nt, Artificial Sequence
  Synthetic
ggaggaguggcgggugccgg

SEQ ID NO: 31883 - RNA, 20 nt, Artificial Sequence
  Synthetic
gggugaucucuggcacgcgg

SEQ ID NO: 31884 - RNA, 20 nt, Artificial Sequence
  Synthetic
gcgggggugggaagggucgg

SEQ ID NO: 31885 - RNA, 20 nt, Artificial Sequence
  Synthetic
ggggggagugcgggggaggg

SEQ ID NO: 31886 - RNA, 20 nt, Artificial Sequence
  Synthetic
gcuucuccccaauagagggg

SEQ ID NO: 31887 - RNA, 20 nt, Artificial Sequence
  Synthetic
gggggagugcgggggagggg

SEQ ID NO: 31888 - RNA, 20 nt, Artificial Sequence
  Synthetic
gcacaaaaacacaggcgggg

SEQ ID NO: 31889 - RNA, 20 nt, Artificial Sequence
  Synthetic
ggggggggggagugcggggg

SEQ ID NO: 31890 - RNA, 20 nt, Artificial Sequence
  Synthetic
ggggugggaagggucggggg

SEQ ID NO: 31891 - RNA, 20 nt, Artificial Sequence
  Synthetic
ggucuuacugccuggggggg

SEQ ID NO: 31892 - RNA, 20 nt, Artificial Sequence
  Synthetic
gggucuuacugccugggggg

SEQ ID NO: 31893 - RNA, 20 nt, Artificial Sequence
  Synthetic
gacaccggccgacccccugg

SEQ ID NO: 31894 - RNA, 20 nt, Artificial Sequence
  Synthetic
gcuugggucuuacugccugg

SEQ ID NO: 31895 - RNA, 20 nt, Artificial Sequence
  Synthetic
guggccgaccuuagccucug

SEQ ID NO: 31896 - RNA, 20 nt, Artificial Sequence
  Synthetic
gggugggacacaugccuucu

SEQ ID NO: 31897 - RNA, 20 nt, Artificial Sequence
  Synthetic
gugccuggcucucuaugcuu

SEQ ID NO: 31898 - RNA, 17 nt, Artificial Sequence
  Synthetic
uaacagagucugacuaa

SEQ ID NO: 31899 - RNA, 17 nt, Artificial Sequence
  Synthetic
acugcccccuuaucuaa

SEQ ID NO: 31900 - RNA, 17 nt, Artificial Sequence
  Synthetic
cggcuggaagaccgcca

SEQ ID NO: 31901 - RNA, 17 nt, Artificial Sequence
  Synthetic
ugcuucuccccaauaga

SEQ ID NO: 31902 - RNA, 17 nt, Artificial Sequence
  Synthetic
ugggaagggucggggga

SEQ ID NO: 31903 - RNA, 17 nt, Artificial Sequence
  Synthetic
ucugacuaaggguggga

SEQ ID NO: 31904 - RNA, 17 nt, Artificial Sequence
  Synthetic
uuccuaaagcgaggaua

SEQ ID NO: 31905 - RNA, 17 nt, Artificial Sequence
  Synthetic
aacugcccccuuaucua

SEQ ID NO: 31906 - RNA, 17 nt, Artificial Sequence
  Synthetic
cuuuaggaacaacuuua

SEQ ID NO: 31907 - RNA, 17 nt, Artificial Sequence
  Synthetic
cgugccagagaucaccc

SEQ ID NO: 31908 - RNA, 17 nt, Artificial Sequence
  Synthetic
ccgcacucccccccccc

SEQ ID NO: 31909 - RNA, 17 nt, Artificial Sequence
  Synthetic
agaucaccccggucccc

SEQ ID NO: 31910 - RNA, 17 nt, Artificial Sequence
  Synthetic
cccaagcauagagagcc

SEQ ID NO: 31911 - RNA, 17 nt, Artificial Sequence
  Synthetic
cucuauuggggagaagc

SEQ ID NO: 31912 - RNA, 17 nt, Artificial Sequence
  Synthetic
ccuggcggucuuccagc

SEQ ID NO: 31913 - RNA, 17 nt, Artificial Sequence
  Synthetic
cuuaucuaagggccggc

SEQ ID NO: 31914 - RNA, 17 nt, Artificial Sequence
  Synthetic
cccccuuaucuaagggc

SEQ ID NO: 31915 - RNA, 17 nt, Artificial Sequence
  Synthetic
cuggggggggggagugc

SEQ ID NO: 31916 - RNA, 17 nt, Artificial Sequence
  Synthetic
uggccgaccuuagccuc

SEQ ID NO: 31917 - RNA, 17 nt, Artificial Sequence
  Synthetic
cgggggugggaaggguc

SEQ ID NO: 31918 - RNA, 17 nt, Artificial Sequence
  Synthetic
cugacuaagggugggag

SEQ ID NO: 31919 - RNA, 17 nt, Artificial Sequence
  Synthetic
cugcuucuccccaauag

SEQ ID NO: 31920 - RNA, 17 nt, Artificial Sequence
  Synthetic
uuuaggaacaacuuuag

SEQ ID NO: 31921 - RNA, 17 nt, Artificial Sequence
  Synthetic
ugccuucuuggaguacg

SEQ ID NO: 31922 - RNA, 17 nt, Artificial Sequence
  Synthetic
cgggugccgggggaccg

SEQ ID NO: 31923 - RNA, 17 nt, Artificial Sequence
  Synthetic
aggaguggcgggugccg

SEQ ID NO: 31924 - RNA, 17 nt, Artificial Sequence
  Synthetic
aaguuguuccuaaagcg

SEQ ID NO: 31925 - RNA, 17 nt, Artificial Sequence
  Synthetic
uggggggggggagugcg

SEQ ID NO: 31926 - RNA, 17 nt, Artificial Sequence
  Synthetic
aggcacaaaaacacagg

SEQ ID NO: 31927 - RNA, 17 nt, Artificial Sequence
  Synthetic
cuucuccccaauagagg

SEQ ID NO: 31928 - RNA, 17 nt, Artificial Sequence
  Synthetic
ugacuaagggugggagg

SEQ ID NO: 31929 - RNA, 17 nt, Artificial Sequence
  Synthetic
uuaggaacaacuuuagg

SEQ ID NO: 31930 - RNA, 17 nt, Artificial Sequence
  Synthetic
ugaucucuggcacgcgg

SEQ ID NO: 31931 - RNA, 17 nt, Artificial Sequence
  Synthetic
cagagucugacuaaggg

SEQ ID NO: 31932 - RNA, 17 nt, Artificial Sequence
  Synthetic
uucuccccaauagaggg

SEQ ID NO: 31933 - RNA, 17 nt, Artificial Sequence
  Synthetic
uaggaacaacuuuaggg

SEQ ID NO: 31934 - RNA, 17 nt, Artificial Sequence
  Synthetic
ucuccccaauagagggg

SEQ ID NO: 31935 - RNA, 17 nt, Artificial Sequence
  Synthetic
acuaagggugggagggg

SEQ ID NO: 31936 - RNA, 17 nt, Artificial Sequence
  Synthetic
aggaacaacuuuagggg

SEQ ID NO: 31937 - RNA, 17 nt, Artificial Sequence
  Synthetic
caaaaacacaggcgggg

SEQ ID NO: 31938 - RNA, 17 nt, Artificial Sequence
  Synthetic
cuccccaauagaggggg

SEQ ID NO: 31939 - RNA, 17 nt, Artificial Sequence
  Synthetic
ucucuggcacgcggggg

SEQ ID NO: 31940 - RNA, 17 nt, Artificial Sequence
  Synthetic
cuuacugccuggggggg

SEQ ID NO: 31941 - RNA, 17 nt, Artificial Sequence
  Synthetic
ucuuacugccugggggg

SEQ ID NO: 31942 - RNA, 17 nt, Artificial Sequence
  Synthetic
ugggucauuggcguggg

SEQ ID NO: 31943 - RNA, 17 nt, Artificial Sequence
  Synthetic
ugggucuuacugccugg

SEQ ID NO: 31944 - RNA, 17 nt, Artificial Sequence
  Synthetic
aggauacggaggagugg

SEQ ID NO: 31945 - RNA, 17 nt, Artificial Sequence
  Synthetic
uugggucuuacugccug

SEQ ID NO: 31946 - RNA, 17 nt, Artificial Sequence
  Synthetic
ccuggggggggggagug

SEQ ID NO: 31947 - RNA, 17 nt, Artificial Sequence
  Synthetic
cuugggucuuacugccu

SEQ ID NO: 31948 - RNA, 17 nt, Artificial Sequence
  Synthetic
ugggacacaugccuucu

SEQ ID NO: 31949 - RNA, 17 nt, Artificial Sequence
  Synthetic
uuagauaagggggcagu

SEQ ID NO: 31950 - RNA, 17 nt, Artificial Sequence
  Synthetic
agagucugacuaagggu

SEQ ID NO: 31951 - RNA, 17 nt, Artificial Sequence
  Synthetic
aaaaacacaggcggggu

SEQ ID NO: 31952 - RNA, 17 nt, Artificial Sequence
  Synthetic
cucuggcacgcgggggu

SEQ ID NO: 31953 - RNA, 17 nt, Artificial Sequence
  Synthetic
agggggcaguugguggu

SEQ ID NO: 31954 - RNA, 17 nt, Artificial Sequence
  Synthetic
ccuggcucucuaugcuu

SEQ ID NO: 31955 - RNA, 20 nt, Artificial Sequence
  Synthetic
aaguaacagagucugacuaa

SEQ ID NO: 31956 - RNA, 20 nt, Artificial Sequence
  Synthetic
accugcuucuccccaauaga

SEQ ID NO: 31957 - RNA, 20 nt, Artificial Sequence
  Synthetic
ucuggcacgcggggguggga

SEQ ID NO: 31958 - RNA, 20 nt, Artificial Sequence
  Synthetic
cgggggagggggggugugga

SEQ ID NO: 31959 - RNA, 20 nt, Artificial Sequence
  Synthetic
agggggcgccccagaggcua

SEQ ID NO: 31960 - RNA, 20 nt, Artificial Sequence
  Synthetic
accaacugcccccuuaucua

SEQ ID NO: 31961 - RNA, 20 nt, Artificial Sequence
  Synthetic
ucgcuuuaggaacaacuuua

SEQ ID NO: 31962 - RNA, 20 nt, Artificial Sequence
  Synthetic
ugggagggggggaaaagaac

SEQ ID NO: 31963 - RNA, 20 nt, Artificial Sequence
  Synthetic
agagccaggcacaaaaacac

SEQ ID NO: 31964 - RNA, 20 nt, Artificial Sequence
  Synthetic
aggggggggacccaaacgac

SEQ ID NO: 31965 - RNA, 20 nt, Artificial Sequence
  Synthetic
aguggcgggugccgggggac

SEQ ID NO: 31966 - RNA, 20 nt, Artificial Sequence
  Synthetic
ccgcgugccagagaucaccc

SEQ ID NO: 31967 - RNA, 20 nt, Artificial Sequence
  Synthetic
cccccgcacucccccccccc

SEQ ID NO: 31968 - RNA, 20 nt, Artificial Sequence
  Synthetic
cagagaucaccccggucccc

SEQ ID NO: 31969 - RNA, 20 nt, Artificial Sequence
  Synthetic
agacccaagcauagagagcc

SEQ ID NO: 31970 - RNA, 20 nt, Artificial Sequence
  Synthetic
uaugcuugggucuuacugcc

SEQ ID NO: 31971 - RNA, 20 nt, Artificial Sequence
  Synthetic
acggaggaguggcgggugcc

SEQ ID NO: 31972 - RNA, 20 nt, Artificial Sequence
  Synthetic
ccccucuauuggggagaagc

SEQ ID NO: 31973 - RNA, 20 nt, Artificial Sequence
  Synthetic
cccccuggcggucuuccagc

SEQ ID NO: 31974 - RNA, 20 nt, Artificial Sequence
  Synthetic
cggggugaucucuggcacgc

SEQ ID NO: 31975 - RNA, 20 nt, Artificial Sequence
  Synthetic
ccaggcacaaaaacacaggc

SEQ ID NO: 31976 - RNA, 20 nt, Artificial Sequence
  Synthetic
ccccuuaucuaagggccggc

SEQ ID NO: 31977 - RNA, 20 nt, Artificial Sequence
  Synthetic
cugcccccuuaucuaagggc

SEQ ID NO: 31978 - RNA, 20 nt, Artificial Sequence
  Synthetic
agggggggaaaagaacgggc

SEQ ID NO: 31979 - RNA, 20 nt, Artificial Sequence
  Synthetic
ugccuggggggggggagugc

SEQ ID NO: 31980 - RNA, 20 nt, Artificial Sequence
  Synthetic
uacggaggaguggcgggugc

SEQ ID NO: 31981 - RNA, 20 nt, Artificial Sequence
  Synthetic
cgggggaccggggugaucuc

SEQ ID NO: 31982 - RNA, 20 nt, Artificial Sequence
  Synthetic
acgcgggggugggaaggguc

SEQ ID NO: 31983 - RNA, 20 nt, Artificial Sequence
  Synthetic
ccagccggcccuuagauaag

SEQ ID NO: 31984 - RNA, 20 nt, Artificial Sequence
  Synthetic
aacgacagggggcgccccag

SEQ ID NO: 31985 - RNA, 20 nt, Artificial Sequence
  Synthetic
ccugcuucuccccaauagag

SEQ ID NO: 31986 - RNA, 20 nt, Artificial Sequence
  Synthetic
aaagcgaggauacggaggag

SEQ ID NO: 31987 - RNA, 20 nt, Artificial Sequence
  Synthetic
agucugacuaagggugggag

SEQ ID NO: 31988 - RNA, 20 nt, Artificial Sequence
  Synthetic
caccugcuucuccccaauag

SEQ ID NO: 31989 - RNA, 20 nt, Artificial Sequence
  Synthetic
cgcuuuaggaacaacuuuag

SEQ ID NO: 31990 - RNA, 20 nt, Artificial Sequence
  Synthetic
ccggggugaucucuggcacg

SEQ ID NO: 31991 - RNA, 20 nt, Artificial Sequence
  Synthetic
acaugccuucuuggaguacg

SEQ ID NO: 31992 - RNA, 20 nt, Artificial Sequence
  Synthetic
uggcgggugccgggggaccg

SEQ ID NO: 31993 - RNA, 20 nt, Artificial Sequence
  Synthetic
cggaggaguggcgggugccg

SEQ ID NO: 31994 - RNA, 20 nt, Artificial Sequence
  Synthetic
cuaaaguuguuccuaaagcg

SEQ ID NO: 31995 - RNA, 20 nt, Artificial Sequence
  Synthetic
caggcacaaaaacacaggcg

SEQ ID NO: 31996 - RNA, 20 nt, Artificial Sequence
  Synthetic
cgcgggggugggaagggucg

SEQ ID NO: 31997 - RNA, 20 nt, Artificial Sequence
  Synthetic
cagccggcccuuagauaagg

SEQ ID NO: 31998 - RNA, 20 nt, Artificial Sequence
  Synthetic
cugcuucuccccaauagagg

SEQ ID NO: 31999 - RNA, 20 nt, Artificial Sequence
  Synthetic
ccuggggggggggagugcgg

SEQ ID NO: 32000 - RNA, 20 nt, Artificial Sequence
  Synthetic
ugcuucuccccaauagaggg

SEQ ID NO: 32001 - RNA, 20 nt, Artificial Sequence
  Synthetic
ugggaagggucgggggaggg

SEQ ID NO: 32002 - RNA, 20 nt, Artificial Sequence
  Synthetic
ucugacuaagggugggaggg

SEQ ID NO: 32003 - RNA, 20 nt, Artificial Sequence
  Synthetic
cuuuaggaacaacuuuaggg

SEQ ID NO: 32004 - RNA, 20 nt, Artificial Sequence
  Synthetic
cugacuaagggugggagggg

SEQ ID NO: 32005 - RNA, 20 nt, Artificial Sequence
  Synthetic
uuuaggaacaacuuuagggg

SEQ ID NO: 32006 - RNA, 20 nt, Artificial Sequence
  Synthetic
cuucuccccaauagaggggg

SEQ ID NO: 32007 - RNA, 20 nt, Artificial Sequence
  Synthetic
ugaucucuggcacgcggggg

SEQ ID NO: 32008 - RNA, 20 nt, Artificial Sequence
  Synthetic
ugggucuuacugccuggggg

SEQ ID NO: 32009 - RNA, 20 nt, Artificial Sequence
  Synthetic
cuugggucuuacugccuggg

SEQ ID NO: 32010 - RNA, 20 nt, Artificial Sequence
  Synthetic
uuagauaagggggcaguugg

SEQ ID NO: 32011 - RNA, 20 nt, Artificial Sequence
  Synthetic
ugcuugggucuuacugccug

SEQ ID NO: 32012 - RNA, 20 nt, Artificial Sequence
  Synthetic
cugccuggggggggggagug

SEQ ID NO: 32013 - RNA, 20 nt, Artificial Sequence
  Synthetic
agugcgggggagggggggug

SEQ ID NO: 32014 - RNA, 20 nt, Artificial Sequence
  Synthetic
uggguccccccccucuauug

SEQ ID NO: 32015 - RNA, 20 nt, Artificial Sequence
  Synthetic
ucuuggaguacgugggucau

SEQ ID NO: 32016 - RNA, 20 nt, Artificial Sequence
  Synthetic
uuuggguccccccccucuau

SEQ ID NO: 32017 - RNA, 20 nt, Artificial Sequence
  Synthetic
augcuugggucuuacugccu

SEQ ID NO: 32018 - RNA, 20 nt, Artificial Sequence
  Synthetic
ugugccuggcucucuaugcu

SEQ ID NO: 32019 - RNA, 20 nt, Artificial Sequence
  Synthetic
cguggccgaccuuagccucu

SEQ ID NO: 32020 - RNA, 20 nt, Artificial Sequence
  Synthetic
cacgcgggggugggaagggu

SEQ ID NO: 32021 - RNA, 20 nt, Artificial Sequence
  Synthetic
aacagagucugacuaagggu

SEQ ID NO: 32022 - RNA, 20 nt, Artificial Sequence
  Synthetic
cacaaaaacacaggcggggu

SEQ ID NO: 32023 - RNA, 20 nt, Artificial Sequence
  Synthetic
cuggaagaccgccagggggu

SEQ ID NO: 32024 - RNA, 20 nt, Artificial Sequence
  Synthetic
auaagggggcaguugguggu

SEQ ID NO: 32025 - RNA, 20 nt, Artificial Sequence
  Synthetic
cuggggcgcccccugucguu

SEQ ID NO: 32026 - RNA, 17 nt, Artificial Sequence
  Synthetic
ggacggggcgcccaaaa

SEQ ID NO: 32027 - RNA, 17 nt, Artificial Sequence
  Synthetic
ccucuggccgccacaaa

SEQ ID NO: 32028 - RNA, 17 nt, Artificial Sequence
  Synthetic
gggacggggcgcccaaa

SEQ ID NO: 32029 - RNA, 17 nt, Artificial Sequence
  Synthetic
acacuauagggcaacaa

SEQ ID NO: 32030 - RNA, 17 nt, Artificial Sequence
  Synthetic
gccucuggccgccacaa

SEQ ID NO: 32031 - RNA, 17 nt, Artificial Sequence
  Synthetic
gugggguuggugugcaa

SEQ ID NO: 32032 - RNA, 17 nt, Artificial Sequence
  Synthetic
ugucuguugggaaauaa

SEQ ID NO: 32033 - RNA, 17 nt, Artificial Sequence
  Synthetic
acgagggaaaacaauaa

SEQ ID NO: 32034 - RNA, 17 nt, Artificial Sequence
  Synthetic
cccccuccccacaaaca

SEQ ID NO: 32035 - RNA, 17 nt, Artificial Sequence
  Synthetic
ggaccagacgggaaaca

SEQ ID NO: 32036 - RNA, 17 nt, Artificial Sequence
  Synthetic
ccagagccugcccaaca

SEQ ID NO: 32037 - RNA, 17 nt, Artificial Sequence
  Synthetic
gggaaaagugaaagaca

SEQ ID NO: 32038 - RNA, 17 nt, Artificial Sequence
  Synthetic
uacauccaacacagaca

SEQ ID NO: 32039 - RNA, 17 nt, Artificial Sequence
  Synthetic
uuuuccccuccccgaca

SEQ ID NO: 32040 - RNA, 17 nt, Artificial Sequence
  Synthetic
guucacguaaggcgaca

SEQ ID NO: 32041 - RNA, 17 nt, Artificial Sequence
  Synthetic
ccugcccauccuggaca

SEQ ID NO: 32042 - RNA, 17 nt, Artificial Sequence
  Synthetic
aacaugcuguucgacca

SEQ ID NO: 32043 - RNA, 17 nt, Artificial Sequence
  Synthetic
cccugcuccccggacca

SEQ ID NO: 32044 - RNA, 17 nt, Artificial Sequence
  Synthetic
gaacagcauguucccca

SEQ ID NO: 32045 - RNA, 17 nt, Artificial Sequence
  Synthetic
caggcugcggaagucca

SEQ ID NO: 32046 - RNA, 17 nt, Artificial Sequence
  Synthetic
ccgugguccggggagca

SEQ ID NO: 32047 - RNA, 17 nt, Artificial Sequence
  Synthetic
cgcggucucggggagca

SEQ ID NO: 32048 - RNA, 17 nt, Artificial Sequence
  Synthetic
gcauccugccacuggca

SEQ ID NO: 32049 - RNA, 17 nt, Artificial Sequence
  Synthetic
cgugaacaagacuauca

SEQ ID NO: 32050 - RNA, 17 nt, Artificial Sequence
  Synthetic
uaauaaaaaaaaacuca

SEQ ID NO: 32051 - RNA, 17 nt, Artificial Sequence
  Synthetic
gguccugguggaccaga

SEQ ID NO: 32052 - RNA, 17 nt, Artificial Sequence
  Synthetic
gcuagagacccccgaga

SEQ ID NO: 32053 - RNA, 17 nt, Artificial Sequence
  Synthetic
cauccuggacauggaga

SEQ ID NO: 32054 - RNA, 17 nt, Artificial Sequence
  Synthetic
agaaucacaggagacga

SEQ ID NO: 32055 - RNA, 17 nt, Artificial Sequence
  Synthetic
gcgucgacccgggacga

SEQ ID NO: 32056 - RNA, 17 nt, Artificial Sequence
  Synthetic
gccccccgaguacccga

SEQ ID NO: 32057 - RNA, 17 nt, Artificial Sequence
  Synthetic
agcagcgcgggggccga

SEQ ID NO: 32058 - RNA, 17 nt, Artificial Sequence
  Synthetic
uauagggcaacaaagga

SEQ ID NO: 32059 - RNA, 17 nt, Artificial Sequence
  Synthetic
cucggugguaugaagga

SEQ ID NO: 32060 - RNA, 17 nt, Artificial Sequence
  Synthetic
cgucuccauguccagga

SEQ ID NO: 32061 - RNA, 17 nt, Artificial Sequence
  Synthetic
uugggggguggggcgga

SEQ ID NO: 32062 - RNA, 17 nt, Artificial Sequence
  Synthetic
gggguggcggggcggga

SEQ ID NO: 32063 - RNA, 17 nt, Artificial Sequence
  Synthetic
cacaggagacgagggga

SEQ ID NO: 32064 - RNA, 17 nt, Artificial Sequence
  Synthetic
gaggccgcccgcgggga

SEQ ID NO: 32065 - RNA, 17 nt, Artificial Sequence
  Synthetic
ccaauccgugucgggga

SEQ ID NO: 32066 - RNA, 17 nt, Artificial Sequence
  Synthetic
ccccguguuugugggga

SEQ ID NO: 32067 - RNA, 17 nt, Artificial Sequence
  Synthetic
ggcaacaaaggauggga

SEQ ID NO: 32068 - RNA, 17 nt, Artificial Sequence
  Synthetic
caugcucggugguauga

SEQ ID NO: 32069 - RNA, 17 nt, Artificial Sequence
  Synthetic
gacgagggaaaacaaua

SEQ ID NO: 32070 - RNA, 17 nt, Artificial Sequence
  Synthetic
ggguuaacuacacuaua

SEQ ID NO: 32071 - RNA, 17 nt, Artificial Sequence
  Synthetic
guccagggcgcccacua

SEQ ID NO: 32072 - RNA, 17 nt, Artificial Sequence
  Synthetic
auagucuuguucacgua

SEQ ID NO: 32073 - RNA, 17 nt, Artificial Sequence
  Synthetic
ugaguuuuuuuuuauua

SEQ ID NO: 32074 - RNA, 17 nt, Artificial Sequence
  Synthetic
gggggggagacagaaac

SEQ ID NO: 32075 - RNA, 17 nt, Artificial Sequence
  Synthetic
ccccuccccacaaacac

SEQ ID NO: 32076 - RNA, 17 nt, Artificial Sequence
  Synthetic
ggaaaagugaaagacac

SEQ ID NO: 32077 - RNA, 17 nt, Artificial Sequence
  Synthetic
ccugcuccccggaccac

SEQ ID NO: 32078 - RNA, 17 nt, Artificial Sequence
  Synthetic
aacagcauguuccccac

SEQ ID NO: 32079 - RNA, 17 nt, Artificial Sequence
  Synthetic
cgaaagcauccugccac

SEQ ID NO: 32080 - RNA, 17 nt, Artificial Sequence
  Synthetic
ugcagccagagaaucac

SEQ ID NO: 32081 - RNA, 17 nt, Artificial Sequence
  Synthetic
gugaacaagacuaucac

SEQ ID NO: 32082 - RNA, 17 nt, Artificial Sequence
  Synthetic
auacauccaacacagac

SEQ ID NO: 32083 - RNA, 17 nt, Artificial Sequence
  Synthetic
guccugguggaccagac

SEQ ID NO: 32084 - RNA, 17 nt, Artificial Sequence
  Synthetic
auccuggacauggagac

SEQ ID NO: 32085 - RNA, 17 nt, Artificial Sequence
  Synthetic
uguucacguaaggcgac

SEQ ID NO: 32086 - RNA, 17 nt, Artificial Sequence
  Synthetic
ggguggcggggcgggac

SEQ ID NO: 32087 - RNA, 17 nt, Artificial Sequence
  Synthetic
uggaguaccggcccacc

SEQ ID NO: 32088 - RNA, 17 nt, Artificial Sequence
  Synthetic
uucccgucugguccacc

SEQ ID NO: 32089 - RNA, 17 nt, Artificial Sequence
  Synthetic
cgggaaacauggcgacc

SEQ ID NO: 32090 - RNA, 17 nt, Artificial Sequence
  Synthetic
agcagggggcgucgacc

SEQ ID NO: 32091 - RNA, 17 nt, Artificial Sequence
  Synthetic
gaacaugcuguucgacc

SEQ ID NO: 32092 - RNA, 17 nt, Artificial Sequence
  Synthetic
gcccgcccggacugacc

SEQ ID NO: 32093 - RNA, 17 nt, Artificial Sequence
  Synthetic
guuaccaacccacaccc

SEQ ID NO: 32094 - RNA, 17 nt, Artificial Sequence
  Synthetic
gcagggggcgucgaccc

SEQ ID NO: 32095 - RNA, 17 nt, Artificial Sequence
  Synthetic
accaaccccacgucccc

SEQ ID NO: 32096 - RNA, 17 nt, Artificial Sequence
  Synthetic
cgguggucaggcagccc

SEQ ID NO: 32097 - RNA, 17 nt, Artificial Sequence
  Synthetic
cacccuagugggcgccc

SEQ ID NO: 32098 - RNA, 17 nt, Artificial Sequence
  Synthetic
gcccgcggggacggccc

SEQ ID NO: 32099 - RNA, 17 nt, Artificial Sequence
  Synthetic
ccacagagccgcggccc

SEQ ID NO: 32100 - RNA, 17 nt, Artificial Sequence
  Synthetic
cgcccacuagggugccc

SEQ ID NO: 32101 - RNA, 17 nt, Artificial Sequence
  Synthetic
cgacgcccccugcuccc

SEQ ID NO: 32102 - RNA, 17 nt, Artificial Sequence
  Synthetic
uuguuuucccucguccc

SEQ ID NO: 32103 - RNA, 17 nt, Artificial Sequence
  Synthetic
cugcgggccgcgguccc

SEQ ID NO: 32104 - RNA, 17 nt, Artificial Sequence
  Synthetic
gugcggcggcuccagcc

SEQ ID NO: 32105 - RNA, 17 nt, Artificial Sequence
  Synthetic
gaccgcggcccgcagcc

SEQ ID NO: 32106 - RNA, 17 nt, Artificial Sequence
  Synthetic
ucgguggucaggcagcc

SEQ ID NO: 32107 - RNA, 17 nt, Artificial Sequence
  Synthetic
gcuucuuagagaccgcc

SEQ ID NO: 32108 - RNA, 17 nt, Artificial Sequence
  Synthetic
gcgagcgccugcccgcc

SEQ ID NO: 32109 - RNA, 17 nt, Artificial Sequence
  Synthetic
uguggcggccagaggcc

SEQ ID NO: 32110 - RNA, 17 nt, Artificial Sequence
  Synthetic
accacagagccgcggcc

SEQ ID NO: 32111 - RNA, 17 nt, Artificial Sequence
  Synthetic
cgcgcacccgcgcggcc

SEQ ID NO: 32112 - RNA, 17 nt, Artificial Sequence
  Synthetic
auaccaccgagcaugcc

SEQ ID NO: 32113 - RNA, 17 nt, Artificial Sequence
  Synthetic
ggccgaggaagugugcc

SEQ ID NO: 32114 - RNA, 17 nt, Artificial Sequence
  Synthetic
ggacugccugcccaucc

SEQ ID NO: 32115 - RNA, 17 nt, Artificial Sequence
  Synthetic
gcaggcugcggaagucc

SEQ ID NO: 32116 - RNA, 17 nt, Artificial Sequence
  Synthetic
agaggccaggucagucc

SEQ ID NO: 32117 - RNA, 17 nt, Artificial Sequence
  Synthetic
auuguuuucccucgucc

SEQ ID NO: 32118 - RNA, 17 nt, Artificial Sequence
  Synthetic
cggggcguacguggucc

SEQ ID NO: 32119 - RNA, 17 nt, Artificial Sequence
  Synthetic
cucggcacccguggucc

SEQ ID NO: 32120 - RNA, 17 nt, Artificial Sequence
  Synthetic
uccccgucuccaugucc

SEQ ID NO: 32121 - RNA, 17 nt, Artificial Sequence
  Synthetic
gccacgcggagacuucc

SEQ ID NO: 32122 - RNA, 17 nt, Artificial Sequence
  Synthetic
cgcguggcgcgucuucc

SEQ ID NO: 32123 - RNA, 17 nt, Artificial Sequence
  Synthetic
gggcaccacacaccagc

SEQ ID NO: 32124 - RNA, 17 nt, Artificial Sequence
  Synthetic
ggugcggcggcuccagc

SEQ ID NO: 32125 - RNA, 17 nt, Artificial Sequence
  Synthetic
ggaccgcggcccgcagc

SEQ ID NO: 32126 - RNA, 17 nt, Artificial Sequence
  Synthetic
cccgugguccggggagc

SEQ ID NO: 32127 - RNA, 17 nt, Artificial Sequence
  Synthetic
ccgcggucucggggagc

SEQ ID NO: 32128 - RNA, 17 nt, Artificial Sequence
  Synthetic
cuguuccacuccgacgc

SEQ ID NO: 32129 - RNA, 17 nt, Artificial Sequence
  Synthetic
ugcuucuuagagaccgc

SEQ ID NO: 32130 - RNA, 17 nt, Artificial Sequence
  Synthetic
cugcuccccgagaccgc

SEQ ID NO: 32131 - RNA, 17 nt, Artificial Sequence
  Synthetic
acgggugccgagaccgc

SEQ ID NO: 32132 - RNA, 17 nt, Artificial Sequence
  Synthetic
caacacaaaagacccgc

SEQ ID NO: 32133 - RNA, 17 nt, Artificial Sequence
  Synthetic
uccggggccguccccgc

SEQ ID NO: 32134 - RNA, 17 nt, Artificial Sequence
  Synthetic
cgcgugaggccgcccgc

SEQ ID NO: 32135 - RNA, 17 nt, Artificial Sequence
  Synthetic
cgcugcuucugggccgc

SEQ ID NO: 32136 - RNA, 17 nt, Artificial Sequence
  Synthetic
cggcccagaagcagcgc

SEQ ID NO: 32137 - RNA, 17 nt, Artificial Sequence
  Synthetic
ggcccaccuggccgcgc

SEQ ID NO: 32138 - RNA, 17 nt, Artificial Sequence
  Synthetic
aggggggggucgggcgc

SEQ ID NO: 32139 - RNA, 17 nt, Artificial Sequence
  Synthetic
uguguuggauguaucgc

SEQ ID NO: 32140 - RNA, 17 nt, Artificial Sequence
  Synthetic
gggccgcgguccccggc

SEQ ID NO: 32141 - RNA, 17 nt, Artificial Sequence
  Synthetic
uggccgccacaaagggc

SEQ ID NO: 32142 - RNA, 17 nt, Artificial Sequence
  Synthetic
gccaggucaguccgggc

SEQ ID NO: 32143 - RNA, 17 nt, Artificial Sequence
  Synthetic
ggucaguccgggcgggc

SEQ ID NO: 32144 - RNA, 17 nt, Artificial Sequence
  Synthetic
gggagggguggcggggc

SEQ ID NO: 32145 - RNA, 17 nt, Artificial Sequence
  Synthetic
agacccccgagaugggc

SEQ ID NO: 32146 - RNA, 17 nt, Artificial Sequence
  Synthetic
ccauguccaggaugggc

SEQ ID NO: 32147 - RNA, 17 nt, Artificial Sequence
  Synthetic
cgcgcggccaggugggc

SEQ ID NO: 32148 - RNA, 17 nt, Artificial Sequence
  Synthetic
ggggugccauguugggc

SEQ ID NO: 32149 - RNA, 17 nt, Artificial Sequence
  Synthetic
ggcuccaugccaguggc

SEQ ID NO: 32150 - RNA, 17 nt, Artificial Sequence
  Synthetic
aggaugggagggguggc

SEQ ID NO: 32151 - RNA, 17 nt, Artificial Sequence
  Synthetic
ccccgacacggauuggc

SEQ ID NO: 32152 - RNA, 17 nt, Artificial Sequence
  Synthetic
cauggcgacccggcugc

SEQ ID NO: 32153 - RNA, 17 nt, Artificial Sequence
  Synthetic
uggagacggggaacauc

SEQ ID NO: 32154 - RNA, 17 nt, Artificial Sequence
  Synthetic
cuaauaaaaaaaaacuc

SEQ ID NO: 32155 - RNA, 17 nt, Artificial Sequence
  Synthetic
ggggccgucggguacuc

SEQ ID NO: 32156 - RNA, 17 nt, Artificial Sequence
  Synthetic
cggaguggaacagccuc

SEQ ID NO: 32157 - RNA, 17 nt, Artificial Sequence
  Synthetic
cggacugaccuggccuc

SEQ ID NO: 32158 - RNA, 17 nt, Artificial Sequence
  Synthetic
ccauguugggcaggcuc

SEQ ID NO: 32159 - RNA, 17 nt, Artificial Sequence
  Synthetic
cgcuaccugcccaucuc

SEQ ID NO: 32160 - RNA, 17 nt, Artificial Sequence
  Synthetic
ugguuacccgcggucuc

SEQ ID NO: 32161 - RNA, 17 nt, Artificial Sequence
  Synthetic
gggcgcuggguggucuc

SEQ ID NO: 32162 - RNA, 17 nt, Artificial Sequence
  Synthetic
cgucuccugugauucuc

SEQ ID NO: 32163 - RNA, 17 nt, Artificial Sequence
  Synthetic
cagaggccaggucaguc

SEQ ID NO: 32164 - RNA, 17 nt, Artificial Sequence
  Synthetic
ucgccauguuucccguc

SEQ ID NO: 32165 - RNA, 17 nt, Artificial Sequence
  Synthetic
ccgacgcgggggccguc

SEQ ID NO: 32166 - RNA, 17 nt, Artificial Sequence
  Synthetic
guggggagggggggguc

SEQ ID NO: 32167 - RNA, 17 nt, Artificial Sequence
  Synthetic
ucucggcacccgugguc

SEQ ID NO: 32168 - RNA, 17 nt, Artificial Sequence
  Synthetic
uucggggaucggugguc

SEQ ID NO: 32169 - RNA, 17 nt, Artificial Sequence
  Synthetic
accagccaauccguguc

SEQ ID NO: 32170 - RNA, 17 nt, Artificial Sequence
  Synthetic
cgccacgcggagacuuc

SEQ ID NO: 32171 - RNA, 17 nt, Artificial Sequence
  Synthetic
ggcccccgcgcugcuuc

SEQ ID NO: 32172 - RNA, 17 nt, Artificial Sequence
  Synthetic
ccgcguggcgcgucuuc

SEQ ID NO: 32173 - RNA, 17 nt, Artificial Sequence
  Synthetic
ccaacccacugugguuc

SEQ ID NO: 32174 - RNA, 17 nt, Artificial Sequence
  Synthetic
aguggcaggaugcuuuc

SEQ ID NO: 32175 - RNA, 17 nt, Artificial Sequence
  Synthetic
gacggggcgcccaaaag

SEQ ID NO: 32176 - RNA, 17 nt, Artificial Sequence
  Synthetic
uggagccagaaccacag

SEQ ID NO: 32177 - RNA, 17 nt, Artificial Sequence
  Synthetic
cgggcaccacacaccag

SEQ ID NO: 32178 - RNA, 17 nt, Artificial Sequence
  Synthetic
cccuuuguggcggccag

SEQ ID NO: 32179 - RNA, 17 nt, Artificial Sequence
  Synthetic
uucuggcuccaugccag

SEQ ID NO: 32180 - RNA, 17 nt, Artificial Sequence
  Synthetic
ccacgggggucauccag

SEQ ID NO: 32181 - RNA, 17 nt, Artificial Sequence
  Synthetic
cgugguccggggagcag

SEQ ID NO: 32182 - RNA, 17 nt, Artificial Sequence
  Synthetic
aauaaaaaaaaacucag

SEQ ID NO: 32183 - RNA, 17 nt, Artificial Sequence
  Synthetic
gaaucacaggagacgag

SEQ ID NO: 32184 - RNA, 17 nt, Artificial Sequence
  Synthetic
ucggugguaugaaggag

SEQ ID NO: 32185 - RNA, 17 nt, Artificial Sequence
  Synthetic
ugggggguggggcggag

SEQ ID NO: 32186 - RNA, 17 nt, Artificial Sequence
  Synthetic
cggcccccgcgucggag

SEQ ID NO: 32187 - RNA, 17 nt, Artificial Sequence
  Synthetic
caauccgugucggggag

SEQ ID NO: 32188 - RNA, 17 nt, Artificial Sequence
  Synthetic
cccguguuuguggggag

SEQ ID NO: 32189 - RNA, 17 nt, Artificial Sequence
  Synthetic
gcaacaaaggaugggag

SEQ ID NO: 32190 - RNA, 17 nt, Artificial Sequence
  Synthetic
gcggggaugcgugggag

SEQ ID NO: 32191 - RNA, 17 nt, Artificial Sequence
  Synthetic
gugggggugcgugggag

SEQ ID NO: 32192 - RNA, 17 nt, Artificial Sequence
  Synthetic
cgaccagggcacccuag

SEQ ID NO: 32193 - RNA, 17 nt, Artificial Sequence
  Synthetic
cggauuggcugguguag

SEQ ID NO: 32194 - RNA, 17 nt, Artificial Sequence
  Synthetic
cccuccccacaaacacg

SEQ ID NO: 32195 - RNA, 17 nt, Artificial Sequence
  Synthetic
acagcauguuccccacg

SEQ ID NO: 32196 - RNA, 17 nt, Artificial Sequence
  Synthetic
ccggaagacgcgccacg

SEQ ID NO: 32197 - RNA, 17 nt, Artificial Sequence
  Synthetic
acucggggggcaucacg

SEQ ID NO: 32198 - RNA, 17 nt, Artificial Sequence
  Synthetic
ugaacaagacuaucacg

SEQ ID NO: 32199 - RNA, 17 nt, Artificial Sequence
  Synthetic
cggccacaccacagacg

SEQ ID NO: 32200 - RNA, 17 nt, Artificial Sequence
  Synthetic
gagaaucacaggagacg

SEQ ID NO: 32201 - RNA, 17 nt, Artificial Sequence
  Synthetic
uccuggacauggagacg

SEQ ID NO: 32202 - RNA, 17 nt, Artificial Sequence
  Synthetic
gcuguuccacuccgacg

SEQ ID NO: 32203 - RNA, 17 nt, Artificial Sequence
  Synthetic
ggcgucgacccgggacg

SEQ ID NO: 32204 - RNA, 17 nt, Artificial Sequence
  Synthetic
gguggcggggcgggacg

SEQ ID NO: 32205 - RNA, 17 nt, Artificial Sequence
  Synthetic
gagaccgccgggggacg

SEQ ID NO: 32206 - RNA, 17 nt, Artificial Sequence
  Synthetic
gaacaucggggcguacg

SEQ ID NO: 32207 - RNA, 17 nt, Artificial Sequence
  Synthetic
ccugcuccccgagaccg

SEQ ID NO: 32208 - RNA, 17 nt, Artificial Sequence
  Synthetic
gcuccagccggggaccg

SEQ ID NO: 32209 - RNA, 17 nt, Artificial Sequence
  Synthetic
ugcggucucggcacccg

SEQ ID NO: 32210 - RNA, 17 nt, Artificial Sequence
  Synthetic
caucacgugguuacccg

SEQ ID NO: 32211 - RNA, 17 nt, Artificial Sequence
  Synthetic
ccucuggaugacccccg

SEQ ID NO: 32212 - RNA, 17 nt, Artificial Sequence
  Synthetic
cacuuccucggcccccg

SEQ ID NO: 32213 - RNA, 17 nt, Artificial Sequence
  Synthetic
uuccggggccguccccg

SEQ ID NO: 32214 - RNA, 17 nt, Artificial Sequence
  Synthetic
gcgcgugaggccgcccg

SEQ ID NO: 32215 - RNA, 17 nt, Artificial Sequence
  Synthetic
ugcggcggcuccagccg

SEQ ID NO: 32216 - RNA, 17 nt, Artificial Sequence
  Synthetic
uguuaaccacagagccg

SEQ ID NO: 32217 - RNA, 17 nt, Artificial Sequence
  Synthetic
cuucuuagagaccgccg

SEQ ID NO: 32218 - RNA, 17 nt, Artificial Sequence
  Synthetic
ucaggcagcccgggccg

SEQ ID NO: 32219 - RNA, 17 nt, Artificial Sequence
  Synthetic
gacccggcugcgggccg

SEQ ID NO: 32220 - RNA, 17 nt, Artificial Sequence
  Synthetic
cugggccgcgggggccg

SEQ ID NO: 32221 - RNA, 17 nt, Artificial Sequence
  Synthetic
aagcagcgcgggggccg

SEQ ID NO: 32222 - RNA, 17 nt, Artificial Sequence
  Synthetic
gcgcugcuucugggccg

SEQ ID NO: 32223 - RNA, 17 nt, Artificial Sequence
  Synthetic
ucggcacccgugguccg

SEQ ID NO: 32224 - RNA, 17 nt, Artificial Sequence
  Synthetic
ccacgcggagacuuccg

SEQ ID NO: 32225 - RNA, 17 nt, Artificial Sequence
  Synthetic
gcggcccagaagcagcg

SEQ ID NO: 32226 - RNA, 17 nt, Artificial Sequence
  Synthetic
cucgggggucucuagcg

SEQ ID NO: 32227 - RNA, 17 nt, Artificial Sequence
  Synthetic
uguuccacuccgacgcg

SEQ ID NO: 32228 - RNA, 17 nt, Artificial Sequence
  Synthetic
aggcacgcgcacccgcg

SEQ ID NO: 32229 - RNA, 17 nt, Artificial Sequence
  Synthetic
gcgugaggccgcccgcg

SEQ ID NO: 32230 - RNA, 17 nt, Artificial Sequence
  Synthetic
gcugcuucugggccgcg

SEQ ID NO: 32231 - RNA, 17 nt, Artificial Sequence
  Synthetic
cggcccaccuggccgcg

SEQ ID NO: 32232 - RNA, 17 nt, Artificial Sequence
  Synthetic
ccccggaagucuccgcg

SEQ ID NO: 32233 - RNA, 17 nt, Artificial Sequence
  Synthetic
ggcccagaagcagcgcg

SEQ ID NO: 32234 - RNA, 17 nt, Artificial Sequence
  Synthetic
guguuggauguaucgcg

SEQ ID NO: 32235 - RNA, 17 nt, Artificial Sequence
  Synthetic
ggccgccacaaagggcg

SEQ ID NO: 32236 - RNA, 17 nt, Artificial Sequence
  Synthetic
ggcugguguagugggcg

SEQ ID NO: 32237 - RNA, 17 nt, Artificial Sequence
  Synthetic
ggaugggagggguggcg

SEQ ID NO: 32238 - RNA, 17 nt, Artificial Sequence
  Synthetic
uguaucgcggggaugcg

SEQ ID NO: 32239 - RNA, 17 nt, Artificial Sequence
  Synthetic
gugggagugggggugcg

SEQ ID NO: 32240 - RNA, 17 nt, Artificial Sequence
  Synthetic
ggagacggggaacaucg

SEQ ID NO: 32241 - RNA, 17 nt, Artificial Sequence
  Synthetic
cuguguuggauguaucg

SEQ ID NO: 32242 - RNA, 17 nt, Artificial Sequence
  Synthetic
gggccgucggguacucg

SEQ ID NO: 32243 - RNA, 17 nt, Artificial Sequence
  Synthetic
gggcgggcaggcgcucg

SEQ ID NO: 32244 - RNA, 17 nt, Artificial Sequence
  Synthetic
gcuaccugcccaucucg

SEQ ID NO: 32245 - RNA, 17 nt, Artificial Sequence
  Synthetic
gguuacccgcggucucg

SEQ ID NO: 32246 - RNA, 17 nt, Artificial Sequence
  Synthetic
ccagccaauccgugucg

SEQ ID NO: 32247 - RNA, 17 nt, Artificial Sequence
  Synthetic
guggcaggaugcuuucg

SEQ ID NO: 32248 - RNA, 17 nt, Artificial Sequence
  Synthetic
acggggcgcccaaaagg

SEQ ID NO: 32249 - RNA, 17 nt, Artificial Sequence
  Synthetic
gcucggugguaugaagg

SEQ ID NO: 32250 - RNA, 17 nt, Artificial Sequence
  Synthetic
gcacccgcgcggccagg

SEQ ID NO: 32251 - RNA, 17 nt, Artificial Sequence
  Synthetic
gugguccggggagcagg

SEQ ID NO: 32252 - RNA, 17 nt, Artificial Sequence
  Synthetic
cggugguaugaaggagg

SEQ ID NO: 32253 - RNA, 17 nt, Artificial Sequence
  Synthetic
ccguguuuguggggagg

SEQ ID NO: 32254 - RNA, 17 nt, Artificial Sequence
  Synthetic
ccuccccacaaacacgg

SEQ ID NO: 32255 - RNA, 17 nt, Artificial Sequence
  Synthetic
cagcauguuccccacgg

SEQ ID NO: 32256 - RNA, 17 nt, Artificial Sequence
  Synthetic
gaacaagacuaucacgg

SEQ ID NO: 32257 - RNA, 17 nt, Artificial Sequence
  Synthetic
aaccccacgucccccgg

SEQ ID NO: 32258 - RNA, 17 nt, Artificial Sequence
  Synthetic
uucuuagagaccgccgg

SEQ ID NO: 32259 - RNA, 17 nt, Artificial Sequence
  Synthetic
guuccacuccgacgcgg

SEQ ID NO: 32260 - RNA, 17 nt, Artificial Sequence
  Synthetic
cugcuucugggccgcgg

SEQ ID NO: 32261 - RNA, 17 nt, Artificial Sequence
  Synthetic
gcccagaagcagcgcgg

SEQ ID NO: 32262 - RNA, 17 nt, Artificial Sequence
  Synthetic
gccgccacaaagggcgg

SEQ ID NO: 32263 - RNA, 17 nt, Artificial Sequence
  Synthetic
guugggggguggggcgg

SEQ ID NO: 32264 - RNA, 17 nt, Artificial Sequence
  Synthetic
cggggagcagggugcgg

SEQ ID NO: 32265 - RNA, 17 nt, Artificial Sequence
  Synthetic
augcuuucggggaucgg

SEQ ID NO: 32266 - RNA, 17 nt, Artificial Sequence
  Synthetic
ggccgucggguacucgg

SEQ ID NO: 32267 - RNA, 17 nt, Artificial Sequence
  Synthetic
cacccaggcaugcucgg

SEQ ID NO: 32268 - RNA, 17 nt, Artificial Sequence
  Synthetic
cuaccugcccaucucgg

SEQ ID NO: 32269 - RNA, 17 nt, Artificial Sequence
  Synthetic
cuggccgccacaaaggg

SEQ ID NO: 32270 - RNA, 17 nt, Artificial Sequence
  Synthetic
agcgcgggggccgaggg

SEQ ID NO: 32271 - RNA, 17 nt, Artificial Sequence
  Synthetic
ggugguaugaaggaggg

SEQ ID NO: 32272 - RNA, 17 nt, Artificial Sequence
  Synthetic
cguguuuguggggaggg

SEQ ID NO: 32273 - RNA, 17 nt, Artificial Sequence
  Synthetic
cuccccacaaacacggg

SEQ ID NO: 32274 - RNA, 17 nt, Artificial Sequence
  Synthetic
ggccaggucaguccggg

SEQ ID NO: 32275 - RNA, 17 nt, Artificial Sequence
  Synthetic
ggggccguccccgcggg

SEQ ID NO: 32276 - RNA, 17 nt, Artificial Sequence
  Synthetic
ccgccacaaagggcggg

SEQ ID NO: 32277 - RNA, 17 nt, Artificial Sequence
  Synthetic
gccgucggguacucggg

SEQ ID NO: 32278 - RNA, 17 nt, Artificial Sequence
  Synthetic
gugguaugaaggagggg

SEQ ID NO: 32279 - RNA, 17 nt, Artificial Sequence
  Synthetic
gggguggggcggagggg

SEQ ID NO: 32280 - RNA, 17 nt, Artificial Sequence
  Synthetic
guguuuguggggagggg

SEQ ID NO: 32281 - RNA, 17 nt, Artificial Sequence
  Synthetic
acaaaggaugggagggg

SEQ ID NO: 32282 - RNA, 17 nt, Artificial Sequence
  Synthetic
cgccacaaagggcgggg

SEQ ID NO: 32283 - RNA, 17 nt, Artificial Sequence
  Synthetic
ugggagggguggcgggg

SEQ ID NO: 32284 - RNA, 17 nt, Artificial Sequence
  Synthetic
gccaauccgugucgggg

SEQ ID NO: 32285 - RNA, 17 nt, Artificial Sequence
  Synthetic
uguuuguggggaggggg

SEQ ID NO: 32286 - RNA, 17 nt, Artificial Sequence
  Synthetic
gccacaaagggcggggg

SEQ ID NO: 32287 - RNA, 17 nt, Artificial Sequence
  Synthetic
guaugaaggaggggggg

SEQ ID NO: 32288 - RNA, 17 nt, Artificial Sequence
  Synthetic
cggaggggugggggggg

SEQ ID NO: 32289 - RNA, 17 nt, Artificial Sequence
  Synthetic
gcggagggguggggggg

SEQ ID NO: 32290 - RNA, 17 nt, Artificial Sequence
  Synthetic
ggcggaggggugggggg

SEQ ID NO: 32291 - RNA, 17 nt, Artificial Sequence
  Synthetic
acguggguguugggggg

SEQ ID NO: 32292 - RNA, 17 nt, Artificial Sequence
  Synthetic
gggcggagggguggggg

SEQ ID NO: 32293 - RNA, 17 nt, Artificial Sequence
  Synthetic
ggggcggaggggugggg

SEQ ID NO: 32294 - RNA, 17 nt, Artificial Sequence
  Synthetic
gguguuggggggugggg

SEQ ID NO: 32295 - RNA, 17 nt, Artificial Sequence
  Synthetic
cccccguguuugugggg

SEQ ID NO: 32296 - RNA, 17 nt, Artificial Sequence
  Synthetic
gggcaacaaaggauggg

SEQ ID NO: 32297 - RNA, 17 nt, Artificial Sequence
  Synthetic
gggggucgggcgcuggg

SEQ ID NO: 32298 - RNA, 17 nt, Artificial Sequence
  Synthetic
uggggcggagggguggg

SEQ ID NO: 32299 - RNA, 17 nt, Artificial Sequence
  Synthetic
cagacguggguguuggg

SEQ ID NO: 32300 - RNA, 17 nt, Artificial Sequence
  Synthetic
ggcguacgugguccugg

SEQ ID NO: 32301 - RNA, 17 nt, Artificial Sequence
  Synthetic
gggaugcgugggagugg

SEQ ID NO: 32302 - RNA, 17 nt, Artificial Sequence
  Synthetic
ggggugcgugggagugg

SEQ ID NO: 32303 - RNA, 17 nt, Artificial Sequence
  Synthetic
guggggcggaggggugg

SEQ ID NO: 32304 - RNA, 17 nt, Artificial Sequence
  Synthetic
aaggaugggaggggugg

SEQ ID NO: 32305 - RNA, 17 nt, Artificial Sequence
  Synthetic
ccccccgcccuuugugg

SEQ ID NO: 32306 - RNA, 17 nt, Artificial Sequence
  Synthetic
acagacguggguguugg

SEQ ID NO: 32307 - RNA, 17 nt, Artificial Sequence
  Synthetic
guuagaaaacaagaaug

SEQ ID NO: 32308 - RNA, 17 nt, Artificial Sequence
  Synthetic
ccacacccaacccacug

SEQ ID NO: 32309 - RNA, 17 nt, Artificial Sequence
  Synthetic
uggacuuccgcagccug

SEQ ID NO: 32310 - RNA, 17 nt, Artificial Sequence
  Synthetic
gccgagaccgcaggcug

SEQ ID NO: 32311 - RNA, 17 nt, Artificial Sequence
  Synthetic
acauggcgacccggcug

SEQ ID NO: 32312 - RNA, 17 nt, Artificial Sequence
  Synthetic
cccgggccgcggcucug

SEQ ID NO: 32313 - RNA, 17 nt, Artificial Sequence
  Synthetic
cccaacacccacgucug

SEQ ID NO: 32314 - RNA, 17 nt, Artificial Sequence
  Synthetic
ggggaugcgugggagug

SEQ ID NO: 32315 - RNA, 17 nt, Artificial Sequence
  Synthetic
gggggugcgugggagug

SEQ ID NO: 32316 - RNA, 17 nt, Artificial Sequence
  Synthetic
gaccgccgggggacgug

SEQ ID NO: 32317 - RNA, 17 nt, Artificial Sequence
  Synthetic
ucuggaugacccccgug

SEQ ID NO: 32318 - RNA, 17 nt, Artificial Sequence
  Synthetic
ugggcagguagcgcgug

SEQ ID NO: 32319 - RNA, 17 nt, Artificial Sequence
  Synthetic
ucucggggagcagggug

SEQ ID NO: 32320 - RNA, 17 nt, Artificial Sequence
  Synthetic
gguggggcggaggggug

SEQ ID NO: 32321 - RNA, 17 nt, Artificial Sequence
  Synthetic
guggguguuggggggug

SEQ ID NO: 32322 - RNA, 17 nt, Artificial Sequence
  Synthetic
ccgagcaugccugggug

SEQ ID NO: 32323 - RNA, 17 nt, Artificial Sequence
  Synthetic
ccacaguggguugggug

SEQ ID NO: 32324 - RNA, 17 nt, Artificial Sequence
  Synthetic
cacccacgucuguggug

SEQ ID NO: 32325 - RNA, 17 nt, Artificial Sequence
  Synthetic
aaagacccgcuggugug

SEQ ID NO: 32326 - RNA, 17 nt, Artificial Sequence
  Synthetic
cgccccccguguuugug

SEQ ID NO: 32327 - RNA, 17 nt, Artificial Sequence
  Synthetic
cacagacguggguguug

SEQ ID NO: 32328 - RNA, 17 nt, Artificial Sequence
  Synthetic
accccccccgcccuuug

SEQ ID NO: 32329 - RNA, 17 nt, Artificial Sequence
  Synthetic
gacgccccccguguuug

SEQ ID NO: 32330 - RNA, 17 nt, Artificial Sequence
  Synthetic
auggagacggggaacau

SEQ ID NO: 32331 - RNA, 17 nt, Artificial Sequence
  Synthetic
cuagagacccccgagau

SEQ ID NO: 32332 - RNA, 17 nt, Artificial Sequence
  Synthetic
auagggcaacaaaggau

SEQ ID NO: 32333 - RNA, 17 nt, Artificial Sequence
  Synthetic
gucuccauguccaggau

SEQ ID NO: 32334 - RNA, 17 nt, Artificial Sequence
  Synthetic
cccuccccgacacggau

SEQ ID NO: 32335 - RNA, 17 nt, Artificial Sequence
  Synthetic
acaggagacgaggggau

SEQ ID NO: 32336 - RNA, 17 nt, Artificial Sequence
  Synthetic
aggaugcuuucggggau

SEQ ID NO: 32337 - RNA, 17 nt, Artificial Sequence
  Synthetic
gggguuaacuacacuau

SEQ ID NO: 32338 - RNA, 17 nt, Artificial Sequence
  Synthetic
aguccagggcgcccacu

SEQ ID NO: 32339 - RNA, 17 nt, Artificial Sequence
  Synthetic
gggggccgucggguacu

SEQ ID NO: 32340 - RNA, 17 nt, Artificial Sequence
  Synthetic
caagaggaaaccucccu

SEQ ID NO: 32341 - RNA, 17 nt, Artificial Sequence
  Synthetic
uaccaccgagcaugccu

SEQ ID NO: 32342 - RNA, 17 nt, Artificial Sequence
  Synthetic
uuccgggcacacuuccu

SEQ ID NO: 32343 - RNA, 17 nt, Artificial Sequence
  Synthetic
ggggggggucgggcgcu

SEQ ID NO: 32344 - RNA, 17 nt, Artificial Sequence
  Synthetic
ccacacccaggcaugcu

SEQ ID NO: 32345 - RNA, 17 nt, Artificial Sequence
  Synthetic
gcgcuaccugcccaucu

SEQ ID NO: 32346 - RNA, 17 nt, Artificial Sequence
  Synthetic
gugguuacccgcggucu

SEQ ID NO: 32347 - RNA, 17 nt, Artificial Sequence
  Synthetic
uccgcagccugcggucu

SEQ ID NO: 32348 - RNA, 17 nt, Artificial Sequence
  Synthetic
gcccccgcgcugcuucu

SEQ ID NO: 32349 - RNA, 17 nt, Artificial Sequence
  Synthetic
ggagccagaaccacagu

SEQ ID NO: 32350 - RNA, 17 nt, Artificial Sequence
  Synthetic
cggggaugcgugggagu

SEQ ID NO: 32351 - RNA, 17 nt, Artificial Sequence
  Synthetic
ugggggugcgugggagu

SEQ ID NO: 32352 - RNA, 17 nt, Artificial Sequence
  Synthetic
gaccagggcacccuagu

SEQ ID NO: 32353 - RNA, 17 nt, Artificial Sequence
  Synthetic
ggauuggcugguguagu

SEQ ID NO: 32354 - RNA, 17 nt, Artificial Sequence
  Synthetic
ggccacaccacagacgu

SEQ ID NO: 32355 - RNA, 17 nt, Artificial Sequence
  Synthetic
agaccgccgggggacgu

SEQ ID NO: 32356 - RNA, 17 nt, Artificial Sequence
  Synthetic
cucuggaugacccccgu

SEQ ID NO: 32357 - RNA, 17 nt, Artificial Sequence
  Synthetic
uccgacgcgggggccgu

SEQ ID NO: 32358 - RNA, 17 nt, Artificial Sequence
  Synthetic
cccgacggcccccgcgu

SEQ ID NO: 32359 - RNA, 17 nt, Artificial Sequence
  Synthetic
guaucgcggggaugcgu

SEQ ID NO: 32360 - RNA, 17 nt, Artificial Sequence
  Synthetic
ugggagugggggugcgu

SEQ ID NO: 32361 - RNA, 17 nt, Artificial Sequence
  Synthetic
cacccgcgcggccaggu

SEQ ID NO: 32362 - RNA, 17 nt, Artificial Sequence
  Synthetic
ggguggggcggaggggu

SEQ ID NO: 32363 - RNA, 17 nt, Artificial Sequence
  Synthetic
ggcgcccaaaagggggu

SEQ ID NO: 32364 - RNA, 17 nt, Artificial Sequence
  Synthetic
uguggggaggggggggu

SEQ ID NO: 32365 - RNA, 17 nt, Artificial Sequence
  Synthetic
cguggguguuggggggu

SEQ ID NO: 32366 - RNA, 17 nt, Artificial Sequence
  Synthetic
gccgggggacguggggu

SEQ ID NO: 32367 - RNA, 17 nt, Artificial Sequence
  Synthetic
ccagaaccacagugggu

SEQ ID NO: 32368 - RNA, 17 nt, Artificial Sequence
  Synthetic
caugccugggugugggu

SEQ ID NO: 32369 - RNA, 17 nt, Artificial Sequence
  Synthetic
gagugggggugccaugu

SEQ ID NO: 32370 - RNA, 17 nt, Artificial Sequence
  Synthetic
ggauuuuugcugucugu

SEQ ID NO: 32371 - RNA, 17 nt, Artificial Sequence
  Synthetic
caccagccaauccgugu

SEQ ID NO: 32372 - RNA, 17 nt, Artificial Sequence
  Synthetic
cgaggggaugggcgugu

SEQ ID NO: 32373 - RNA, 17 nt, Artificial Sequence
  Synthetic
cgagcaugccugggugu

SEQ ID NO: 32374 - RNA, 17 nt, Artificial Sequence
  Synthetic
accacagacgugggugu

SEQ ID NO: 32375 - RNA, 17 nt, Artificial Sequence
  Synthetic
cacaguggguugggugu

SEQ ID NO: 32376 - RNA, 17 nt, Artificial Sequence
  Synthetic
cuuuucccugucugugu

SEQ ID NO: 32377 - RNA, 17 nt, Artificial Sequence
  Synthetic
cagcgggucuuuugugu

SEQ ID NO: 32378 - RNA, 17 nt, Artificial Sequence
  Synthetic
acgccccccguguuugu

SEQ ID NO: 32379 - RNA, 17 nt, Artificial Sequence
  Synthetic
cugaguuuuuuuuuauu

SEQ ID NO: 32380 - RNA, 17 nt, Artificial Sequence
  Synthetic
cagaaccacaguggguu

SEQ ID NO: 32381 - RNA, 17 nt, Artificial Sequence
  Synthetic
agugggggugccauguu

SEQ ID NO: 32382 - RNA, 17 nt, Artificial Sequence
  Synthetic
gauuuuugcugucuguu

SEQ ID NO: 32383 - RNA, 17 nt, Artificial Sequence
  Synthetic
ccacagacguggguguu

SEQ ID NO: 32384 - RNA, 17 nt, Artificial Sequence
  Synthetic
uguggccgacccccuuu

SEQ ID NO: 32385 - RNA, 17 nt, Artificial Sequence
  Synthetic
caguggcaggaugcuuu

SEQ ID NO: 32386 - RNA, 17 nt, Artificial Sequence
  Synthetic
guggccgacccccuuuu

SEQ ID NO: 32387 - RNA, 20 nt, Artificial Sequence
  Synthetic
gcgggacggggcgcccaaaa

SEQ ID NO: 32388 - RNA, 20 nt, Artificial Sequence
  Synthetic
uggccucuggccgccacaaa

SEQ ID NO: 32389 - RNA, 20 nt, Artificial Sequence
  Synthetic
ggcgggacggggcgcccaaa

SEQ ID NO: 32390 - RNA, 20 nt, Artificial Sequence
  Synthetic
acuacacuauagggcaacaa

SEQ ID NO: 32391 - RNA, 20 nt, Artificial Sequence
  Synthetic
cuggccucuggccgccacaa

SEQ ID NO: 32392 - RNA, 20 nt, Artificial Sequence
  Synthetic
gacgugggguuggugugcaa

SEQ ID NO: 32393 - RNA, 20 nt, Artificial Sequence
  Synthetic
ugcugucuguugggaaauaa

SEQ ID NO: 32394 - RNA, 20 nt, Artificial Sequence
  Synthetic
gggacgagggaaaacaauaa

SEQ ID NO: 32395 - RNA, 20 nt, Artificial Sequence
  Synthetic
ccccccccuccccacaaaca

SEQ ID NO: 32396 - RNA, 20 nt, Artificial Sequence
  Synthetic
gguggaccagacgggaaaca

SEQ ID NO: 32397 - RNA, 20 nt, Artificial Sequence
  Synthetic
acaccagagccugcccaaca

SEQ ID NO: 32398 - RNA, 20 nt, Artificial Sequence
  Synthetic
gaggggaaaagugaaagaca

SEQ ID NO: 32399 - RNA, 20 nt, Artificial Sequence
  Synthetic
cgauacauccaacacagaca

SEQ ID NO: 32400 - RNA, 20 nt, Artificial Sequence
  Synthetic
cacuuuuccccuccccgaca

SEQ ID NO: 32401 - RNA, 20 nt, Artificial Sequence
  Synthetic
cuuguucacguaaggcgaca

SEQ ID NO: 32402 - RNA, 20 nt, Artificial Sequence
  Synthetic
cugccugcccauccuggaca

SEQ ID NO: 32403 - RNA, 20 nt, Artificial Sequence
  Synthetic
gggaacaugcuguucgacca

SEQ ID NO: 32404 - RNA, 20 nt, Artificial Sequence
  Synthetic
gcccccugcuccccggacca

SEQ ID NO: 32405 - RNA, 20 nt, Artificial Sequence
  Synthetic
gucgaacagcauguucccca

SEQ ID NO: 32406 - RNA, 20 nt, Artificial Sequence
  Synthetic
ccgcaggcugcggaagucca

SEQ ID NO: 32407 - RNA, 20 nt, Artificial Sequence
  Synthetic
cacccgugguccggggagca

SEQ ID NO: 32408 - RNA, 20 nt, Artificial Sequence
  Synthetic
acccgcggucucggggagca

SEQ ID NO: 32409 - RNA, 20 nt, Artificial Sequence
  Synthetic
aaagcauccugccacuggca

SEQ ID NO: 32410 - RNA, 20 nt, Artificial Sequence
  Synthetic
uuacgugaacaagacuauca

SEQ ID NO: 32411 - RNA, 20 nt, Artificial Sequence
  Synthetic
cccuaauaaaaaaaaacuca

SEQ ID NO: 32412 - RNA, 20 nt, Artificial Sequence
  Synthetic
cgugguccugguggaccaga

SEQ ID NO: 32413 - RNA, 20 nt, Artificial Sequence
  Synthetic
cacgcuagagacccccgaga

SEQ ID NO: 32414 - RNA, 20 nt, Artificial Sequence
  Synthetic
gcccauccuggacauggaga

SEQ ID NO: 32415 - RNA, 20 nt, Artificial Sequence
  Synthetic
cagagaaucacaggagacga

SEQ ID NO: 32416 - RNA, 20 nt, Artificial Sequence
  Synthetic
ggggcgucgacccgggacga

SEQ ID NO: 32417 - RNA, 20 nt, Artificial Sequence
  Synthetic
gaugccccccgaguacccga

SEQ ID NO: 32418 - RNA, 20 nt, Artificial Sequence
  Synthetic
agaagcagcgcgggggccga

SEQ ID NO: 32419 - RNA, 20 nt, Artificial Sequence
  Synthetic
cacuauagggcaacaaagga

SEQ ID NO: 32420 - RNA, 20 nt, Artificial Sequence
  Synthetic
augcucggugguaugaagga

SEQ ID NO: 32421 - RNA, 20 nt, Artificial Sequence
  Synthetic
ccccgucuccauguccagga

SEQ ID NO: 32422 - RNA, 20 nt, Artificial Sequence
  Synthetic
guguugggggguggggcgga

SEQ ID NO: 32423 - RNA, 20 nt, Artificial Sequence
  Synthetic
ggagggguggcggggcggga

SEQ ID NO: 32424 - RNA, 20 nt, Artificial Sequence
  Synthetic
aaucacaggagacgagggga

SEQ ID NO: 32425 - RNA, 20 nt, Artificial Sequence
  Synthetic
cgugaggccgcccgcgggga

SEQ ID NO: 32426 - RNA, 20 nt, Artificial Sequence
  Synthetic
cagccaauccgugucgggga

SEQ ID NO: 32427 - RNA, 20 nt, Artificial Sequence
  Synthetic
gccccccguguuugugggga

SEQ ID NO: 32428 - RNA, 20 nt, Artificial Sequence
  Synthetic
uagggcaacaaaggauggga

SEQ ID NO: 32429 - RNA, 20 nt, Artificial Sequence
  Synthetic
aggcaugcucggugguauga

SEQ ID NO: 32430 - RNA, 20 nt, Artificial Sequence
  Synthetic
cgggacgagggaaaacaaua

SEQ ID NO: 32431 - RNA, 20 nt, Artificial Sequence
  Synthetic
gggggguuaacuacacuaua

SEQ ID NO: 32432 - RNA, 20 nt, Artificial Sequence
  Synthetic
gaaguccagggcgcccacua

SEQ ID NO: 32433 - RNA, 20 nt, Artificial Sequence
  Synthetic
gugauagucuuguucacgua

SEQ ID NO: 32434 - RNA, 20 nt, Artificial Sequence
  Synthetic
cccugaguuuuuuuuuauua

SEQ ID NO: 32435 - RNA, 20 nt, Artificial Sequence
  Synthetic
ggggggggggagacagaaac

SEQ ID NO: 32436 - RNA, 20 nt, Artificial Sequence
  Synthetic
cccccccuccccacaaacac

SEQ ID NO: 32437 - RNA, 20 nt, Artificial Sequence
  Synthetic
aggggaaaagugaaagacac

SEQ ID NO: 32438 - RNA, 20 nt, Artificial Sequence
  Synthetic
cccccugcuccccggaccac

SEQ ID NO: 32439 - RNA, 20 nt, Artificial Sequence
  Synthetic
ucgaacagcauguuccccac

SEQ ID NO: 32440 - RNA, 20 nt, Artificial Sequence
  Synthetic
ccccgaaagcauccugccac

SEQ ID NO: 32441 - RNA, 20 nt, Artificial Sequence
  Synthetic
cggugcagccagagaaucac

SEQ ID NO: 32442 - RNA, 20 nt, Artificial Sequence
  Synthetic
uacgugaacaagacuaucac

SEQ ID NO: 32443 - RNA, 20 nt, Artificial Sequence
  Synthetic
gcgauacauccaacacagac

SEQ ID NO: 32444 - RNA, 20 nt, Artificial Sequence
  Synthetic
gugguccugguggaccagac

SEQ ID NO: 32445 - RNA, 20 nt, Artificial Sequence
  Synthetic
cccauccuggacauggagac

SEQ ID NO: 32446 - RNA, 20 nt, Artificial Sequence
  Synthetic
ucuuguucacguaaggcgac

SEQ ID NO: 32447 - RNA, 20 nt, Artificial Sequence
  Synthetic
gagggguggcggggcgggac

SEQ ID NO: 32448 - RNA, 20 nt, Artificial Sequence
  Synthetic
uguuucccgucugguccacc

SEQ ID NO: 32449 - RNA, 20 nt, Artificial Sequence
  Synthetic
agacgggaaacauggcgacc

SEQ ID NO: 32450 - RNA, 20 nt, Artificial Sequence
  Synthetic
gggagcagggggcgucgacc

SEQ ID NO: 32451 - RNA, 20 nt, Artificial Sequence
  Synthetic
ggggaacaugcuguucgacc

SEQ ID NO: 32452 - RNA, 20 nt, Artificial Sequence
  Synthetic
ccugcccgcccggacugacc

SEQ ID NO: 32453 - RNA, 20 nt, Artificial Sequence
  Synthetic
uugguuaccaacccacaccc

SEQ ID NO: 32454 - RNA, 20 nt, Artificial Sequence
  Synthetic
ggagcagggggcgucgaccc

SEQ ID NO: 32455 - RNA, 20 nt, Artificial Sequence
  Synthetic
cacaccaaccccacgucccc

SEQ ID NO: 32456 - RNA, 20 nt, Artificial Sequence
  Synthetic
gaucgguggucaggcagccc

SEQ ID NO: 32457 - RNA, 20 nt, Artificial Sequence
  Synthetic
gggcacccuagugggcgccc

SEQ ID NO: 32458 - RNA, 20 nt, Artificial Sequence
  Synthetic
gccgcccgcggggacggccc

SEQ ID NO: 32459 - RNA, 20 nt, Artificial Sequence
  Synthetic
uaaccacagagccgcggccc

SEQ ID NO: 32460 - RNA, 20 nt, Artificial Sequence
  Synthetic
gggcgcccacuagggugccc

SEQ ID NO: 32461 - RNA, 20 nt, Artificial Sequence
  Synthetic
ggucgacgcccccugcuccc

SEQ ID NO: 32462 - RNA, 20 nt, Artificial Sequence
  Synthetic
uuauuguuuucccucguccc

SEQ ID NO: 32463 - RNA, 20 nt, Artificial Sequence
  Synthetic
cggcugcgggccgcgguccc

SEQ ID NO: 32464 - RNA, 20 nt, Artificial Sequence
  Synthetic
agggugcggcggcuccagcc

SEQ ID NO: 32465 - RNA, 20 nt, Artificial Sequence
  Synthetic
ggggaccgcggcccgcagcc

SEQ ID NO: 32466 - RNA, 20 nt, Artificial Sequence
  Synthetic
ggaucgguggucaggcagcc

SEQ ID NO: 32467 - RNA, 20 nt, Artificial Sequence
  Synthetic
ggugcuucuuagagaccgcc

SEQ ID NO: 32468 - RNA, 20 nt, Artificial Sequence
  Synthetic
uccgcgagcgccugcccgcc

SEQ ID NO: 32469 - RNA, 20 nt, Artificial Sequence
  Synthetic
cuuuguggcggccagaggcc

SEQ ID NO: 32470 - RNA, 20 nt, Artificial Sequence
  Synthetic
uuaaccacagagccgcggcc

SEQ ID NO: 32471 - RNA, 20 nt, Artificial Sequence
  Synthetic
gcacgcgcacccgcgcggcc

SEQ ID NO: 32472 - RNA, 20 nt, Artificial Sequence
  Synthetic
uucauaccaccgagcaugcc

SEQ ID NO: 32473 - RNA, 20 nt, Artificial Sequence
  Synthetic
gggggccgaggaagugugcc

SEQ ID NO: 32474 - RNA, 20 nt, Artificial Sequence
  Synthetic
gggggacugccugcccaucc

SEQ ID NO: 32475 - RNA, 20 nt, Artificial Sequence
  Synthetic
accgcaggcugcggaagucc

SEQ ID NO: 32476 - RNA, 20 nt, Artificial Sequence
  Synthetic
gccagaggccaggucagucc

SEQ ID NO: 32477 - RNA, 20 nt, Artificial Sequence
  Synthetic
cuuauuguuuucccucgucc

SEQ ID NO: 32478 - RNA, 20 nt, Artificial Sequence
  Synthetic
caucggggcguacguggucc

SEQ ID NO: 32479 - RNA, 20 nt, Artificial Sequence
  Synthetic
ggucucggcacccguggucc

SEQ ID NO: 32480 - RNA, 20 nt, Artificial Sequence
  Synthetic
uguuccccgucuccaugucc

SEQ ID NO: 32481 - RNA, 20 nt, Artificial Sequence
  Synthetic
cgcgccacgcggagacuucc

SEQ ID NO: 32482 - RNA, 20 nt, Artificial Sequence
  Synthetic
cuccgcguggcgcgucuucc

SEQ ID NO: 32483 - RNA, 20 nt, Artificial Sequence
  Synthetic
cacgggcaccacacaccagc

SEQ ID NO: 32484 - RNA, 20 nt, Artificial Sequence
  Synthetic
cagggugcggcggcuccagc

SEQ ID NO: 32485 - RNA, 20 nt, Artificial Sequence
  Synthetic
cggggaccgcggcccgcagc

SEQ ID NO: 32486 - RNA, 20 nt, Artificial Sequence
  Synthetic
gcacccgugguccggggagc

SEQ ID NO: 32487 - RNA, 20 nt, Artificial Sequence
  Synthetic
uacccgcggucucggggagc

SEQ ID NO: 32488 - RNA, 20 nt, Artificial Sequence
  Synthetic
aggcuguuccacuccgacgc

SEQ ID NO: 32489 - RNA, 20 nt, Artificial Sequence
  Synthetic
cggugcuucuuagagaccgc

SEQ ID NO: 32490 - RNA, 20 nt, Artificial Sequence
  Synthetic
acccugcuccccgagaccgc

SEQ ID NO: 32491 - RNA, 20 nt, Artificial Sequence
  Synthetic
accacgggugccgagaccgc

SEQ ID NO: 32492 - RNA, 20 nt, Artificial Sequence
  Synthetic
ggccaacacaaaagacccgc

SEQ ID NO: 32493 - RNA, 20 nt, Artificial Sequence
  Synthetic
acuuccggggccguccccgc

SEQ ID NO: 32494 - RNA, 20 nt, Artificial Sequence
  Synthetic
uagcgcgugaggccgcccgc

SEQ ID NO: 32495 - RNA, 20 nt, Artificial Sequence
  Synthetic
ccgcgcugcuucugggccgc

SEQ ID NO: 32496 - RNA, 20 nt, Artificial Sequence
  Synthetic
ccgcggcccagaagcagcgc

SEQ ID NO: 32497 - RNA, 20 nt, Artificial Sequence
  Synthetic
accggcccaccuggccgcgc

SEQ ID NO: 32498 - RNA, 20 nt, Artificial Sequence
  Synthetic
gggaggggggggucgggcgc

SEQ ID NO: 32499 - RNA, 20 nt, Artificial Sequence
  Synthetic
gucuguguuggauguaucgc

SEQ ID NO: 32500 - RNA, 20 nt, Artificial Sequence
  Synthetic
ugcgggccgcgguccccggc

SEQ ID NO: 32501 - RNA, 20 nt, Artificial Sequence
  Synthetic
cucuggccgccacaaagggc

SEQ ID NO: 32502 - RNA, 20 nt, Artificial Sequence
  Synthetic
gaggccaggucaguccgggc

SEQ ID NO: 32503 - RNA, 20 nt, Artificial Sequence
  Synthetic
ccaggucaguccgggcgggc

SEQ ID NO: 32504 - RNA, 20 nt, Artificial Sequence
  Synthetic
gaugggagggguggcggggc

SEQ ID NO: 32505 - RNA, 20 nt, Artificial Sequence
  Synthetic
uagagacccccgagaugggc

SEQ ID NO: 32506 - RNA, 20 nt, Artificial Sequence
  Synthetic
ucuccauguccaggaugggc

SEQ ID NO: 32507 - RNA, 20 nt, Artificial Sequence
  Synthetic
acccgcgcggccaggugggc

SEQ ID NO: 32508 - RNA, 20 nt, Artificial Sequence
  Synthetic
gugggggugccauguugggc

SEQ ID NO: 32509 - RNA, 20 nt, Artificial Sequence
  Synthetic
ucuggcuccaugccaguggc

SEQ ID NO: 32510 - RNA, 20 nt, Artificial Sequence
  Synthetic
caaaggaugggagggguggc

SEQ ID NO: 32511 - RNA, 20 nt, Artificial Sequence
  Synthetic
ccuccccgacacggauuggc

SEQ ID NO: 32512 - RNA, 20 nt, Artificial Sequence
  Synthetic
aaacauggcgacccggcugc

SEQ ID NO: 32513 - RNA, 20 nt, Artificial Sequence
  Synthetic
acauggagacggggaacauc

SEQ ID NO: 32514 - RNA, 20 nt, Artificial Sequence
  Synthetic
gcccuaauaaaaaaaaacuc

SEQ ID NO: 32515 - RNA, 20 nt, Artificial Sequence
  Synthetic
gcgggggccgucggguacuc

SEQ ID NO: 32516 - RNA, 20 nt, Artificial Sequence
  Synthetic
cgucggaguggaacagccuc

SEQ ID NO: 32517 - RNA, 20 nt, Artificial Sequence
  Synthetic
gcccggacugaccuggccuc

SEQ ID NO: 32518 - RNA, 20 nt, Artificial Sequence
  Synthetic
gugccauguugggcaggcuc

SEQ ID NO: 32519 - RNA, 20 nt, Artificial Sequence
  Synthetic
acgcgcuaccugcccaucuc

SEQ ID NO: 32520 - RNA, 20 nt, Artificial Sequence
  Synthetic
acgugguuacccgcggucuc

SEQ ID NO: 32521 - RNA, 20 nt, Artificial Sequence
  Synthetic
gucgggcgcuggguggucuc

SEQ ID NO: 32522 - RNA, 20 nt, Artificial Sequence
  Synthetic
ccucgucuccugugauucuc

SEQ ID NO: 32523 - RNA, 20 nt, Artificial Sequence
  Synthetic
ggccagaggccaggucaguc

SEQ ID NO: 32524 - RNA, 20 nt, Artificial Sequence
  Synthetic
gggucgccauguuucccguc

SEQ ID NO: 32525 - RNA, 20 nt, Artificial Sequence
  Synthetic
acuccgacgcgggggccguc

SEQ ID NO: 32526 - RNA, 20 nt, Artificial Sequence
  Synthetic
uuuguggggagggggggguc

SEQ ID NO: 32527 - RNA, 20 nt, Artificial Sequence
  Synthetic
cggucucggcacccgugguc

SEQ ID NO: 32528 - RNA, 20 nt, Artificial Sequence
  Synthetic
gcuuucggggaucggugguc

SEQ ID NO: 32529 - RNA, 20 nt, Artificial Sequence
  Synthetic
uacaccagccaauccguguc

SEQ ID NO: 32530 - RNA, 20 nt, Artificial Sequence
  Synthetic
acgcgccacgcggagacuuc

SEQ ID NO: 32531 - RNA, 20 nt, Artificial Sequence
  Synthetic
cucggcccccgcgcugcuuc

SEQ ID NO: 32532 - RNA, 20 nt, Artificial Sequence
  Synthetic
ucuccgcguggcgcgucuuc

SEQ ID NO: 32533 - RNA, 20 nt, Artificial Sequence
  Synthetic
cacccaacccacugugguuc

SEQ ID NO: 32534 - RNA, 20 nt, Artificial Sequence
  Synthetic
gccaguggcaggaugcuuuc

SEQ ID NO: 32535 - RNA, 20 nt, Artificial Sequence
  Synthetic
cgggacggggcgcccaaaag

SEQ ID NO: 32536 - RNA, 20 nt, Artificial Sequence
  Synthetic
gcauggagccagaaccacag

SEQ ID NO: 32537 - RNA, 20 nt, Artificial Sequence
  Synthetic
acacgggcaccacacaccag

SEQ ID NO: 32538 - RNA, 20 nt, Artificial Sequence
  Synthetic
ccgcccuuuguggcggccag

SEQ ID NO: 32539 - RNA, 20 nt, Artificial Sequence
  Synthetic
ugguucuggcuccaugccag

SEQ ID NO: 32540 - RNA, 20 nt, Artificial Sequence
  Synthetic
uccccacgggggucauccag

SEQ ID NO: 32541 - RNA, 20 nt, Artificial Sequence
  Synthetic
acccgugguccggggagcag

SEQ ID NO: 32542 - RNA, 20 nt, Artificial Sequence
  Synthetic
ccuaauaaaaaaaaacucag

SEQ ID NO: 32543 - RNA, 20 nt, Artificial Sequence
  Synthetic
agagaaucacaggagacgag

SEQ ID NO: 32544 - RNA, 20 nt, Artificial Sequence
  Synthetic
ugcucggugguaugaaggag

SEQ ID NO: 32545 - RNA, 20 nt, Artificial Sequence
  Synthetic
uguugggggguggggcggag

SEQ ID NO: 32546 - RNA, 20 nt, Artificial Sequence
  Synthetic
cgacggcccccgcgucggag

SEQ ID NO: 32547 - RNA, 20 nt, Artificial Sequence
  Synthetic
agccaauccgugucggggag

SEQ ID NO: 32548 - RNA, 20 nt, Artificial Sequence
  Synthetic
ccccccguguuuguggggag

SEQ ID NO: 32549 - RNA, 20 nt, Artificial Sequence
  Synthetic
agggcaacaaaggaugggag

SEQ ID NO: 32550 - RNA, 20 nt, Artificial Sequence
  Synthetic
aucgcggggaugcgugggag

SEQ ID NO: 32551 - RNA, 20 nt, Artificial Sequence
  Synthetic
ggagugggggugcgugggag

SEQ ID NO: 32552 - RNA, 20 nt, Artificial Sequence
  Synthetic
guucgaccagggcacccuag

SEQ ID NO: 32553 - RNA, 20 nt, Artificial Sequence
  Synthetic
acacggauuggcugguguag

SEQ ID NO: 32554 - RNA, 20 nt, Artificial Sequence
  Synthetic
ccccccuccccacaaacacg

SEQ ID NO: 32555 - RNA, 20 nt, Artificial Sequence
  Synthetic
cgaacagcauguuccccacg

SEQ ID NO: 32556 - RNA, 20 nt, Artificial Sequence
  Synthetic
ugcccggaagacgcgccacg

SEQ ID NO: 32557 - RNA, 20 nt, Artificial Sequence
  Synthetic
gguacucggggggcaucacg

SEQ ID NO: 32558 - RNA, 20 nt, Artificial Sequence
  Synthetic
acgugaacaagacuaucacg

SEQ ID NO: 32559 - RNA, 20 nt, Artificial Sequence
  Synthetic
ggucggccacaccacagacg

SEQ ID NO: 32560 - RNA, 20 nt, Artificial Sequence
  Synthetic
ccagagaaucacaggagacg

SEQ ID NO: 32561 - RNA, 20 nt, Artificial Sequence
  Synthetic
ccauccuggacauggagacg

SEQ ID NO: 32562 - RNA, 20 nt, Artificial Sequence
  Synthetic
gaggcuguuccacuccgacg

SEQ ID NO: 32563 - RNA, 20 nt, Artificial Sequence
  Synthetic
gggggcgucgacccgggacg

SEQ ID NO: 32564 - RNA, 20 nt, Artificial Sequence
  Synthetic
agggguggcggggcgggacg

SEQ ID NO: 32565 - RNA, 20 nt, Artificial Sequence
  Synthetic
uuagagaccgccgggggacg

SEQ ID NO: 32566 - RNA, 20 nt, Artificial Sequence
  Synthetic
ggggaacaucggggcguacg

SEQ ID NO: 32567 - RNA, 20 nt, Artificial Sequence
  Synthetic
cacccugcuccccgagaccg

SEQ ID NO: 32568 - RNA, 20 nt, Artificial Sequence
  Synthetic
gcggcuccagccggggaccg

SEQ ID NO: 32569 - RNA, 20 nt, Artificial Sequence
  Synthetic
gccugcggucucggcacccg

SEQ ID NO: 32570 - RNA, 20 nt, Artificial Sequence
  Synthetic
gggcaucacgugguuacccg

SEQ ID NO: 32571 - RNA, 20 nt, Artificial Sequence
  Synthetic
cagccucuggaugacccccg

SEQ ID NO: 32572 - RNA, 20 nt, Artificial Sequence
  Synthetic
gcacacuuccucggcccccg

SEQ ID NO: 32573 - RNA, 20 nt, Artificial Sequence
  Synthetic
gacuuccggggccguccccg

SEQ ID NO: 32574 - RNA, 20 nt, Artificial Sequence
  Synthetic
guagcgcgugaggccgcccg

SEQ ID NO: 32575 - RNA, 20 nt, Artificial Sequence
  Synthetic
gggugcggcggcuccagccg

SEQ ID NO: 32576 - RNA, 20 nt, Artificial Sequence
  Synthetic
ugguguuaaccacagagccg

SEQ ID NO: 32577 - RNA, 20 nt, Artificial Sequence
  Synthetic
gugcuucuuagagaccgccg

SEQ ID NO: 32578 - RNA, 20 nt, Artificial Sequence
  Synthetic
uggucaggcagcccgggccg

SEQ ID NO: 32579 - RNA, 20 nt, Artificial Sequence
  Synthetic
ggcgacccggcugcgggccg

SEQ ID NO: 32580 - RNA, 20 nt, Artificial Sequence
  Synthetic
cuucugggccgcgggggccg

SEQ ID NO: 32581 - RNA, 20 nt, Artificial Sequence
  Synthetic
cagaagcagcgcgggggccg

SEQ ID NO: 32582 - RNA, 20 nt, Artificial Sequence
  Synthetic
cccgcgcugcuucugggccg

SEQ ID NO: 32583 - RNA, 20 nt, Artificial Sequence
  Synthetic
gucucggcacccgugguccg

SEQ ID NO: 32584 - RNA, 20 nt, Artificial Sequence
  Synthetic
gcgccacgcggagacuuccg

SEQ ID NO: 32585 - RNA, 20 nt, Artificial Sequence
  Synthetic
cccgcggcccagaagcagcg

SEQ ID NO: 32586 - RNA, 20 nt, Artificial Sequence
  Synthetic
caucucgggggucucuagcg

SEQ ID NO: 32587 - RNA, 20 nt, Artificial Sequence
  Synthetic
ggcuguuccacuccgacgcg

SEQ ID NO: 32588 - RNA, 20 nt, Artificial Sequence
  Synthetic
caaaggcacgcgcacccgcg

SEQ ID NO: 32589 - RNA, 20 nt, Artificial Sequence
  Synthetic
agcgcgugaggccgcccgcg

SEQ ID NO: 32590 - RNA, 20 nt, Artificial Sequence
  Synthetic
cgcgcugcuucugggccgcg

SEQ ID NO: 32591 - RNA, 20 nt, Artificial Sequence
  Synthetic
uaccggcccaccuggccgcg

SEQ ID NO: 32592 - RNA, 20 nt, Artificial Sequence
  Synthetic
cggccccggaagucuccgcg

SEQ ID NO: 32593 - RNA, 20 nt, Artificial Sequence
  Synthetic
cgcggcccagaagcagcgcg

SEQ ID NO: 32594 - RNA, 20 nt, Artificial Sequence
  Synthetic
ucuguguuggauguaucgcg

SEQ ID NO: 32595 - RNA, 20 nt, Artificial Sequence
  Synthetic
ucuggccgccacaaagggcg

SEQ ID NO: 32596 - RNA, 20 nt, Artificial Sequence
  Synthetic
auuggcugguguagugggcg

SEQ ID NO: 32597 - RNA, 20 nt, Artificial Sequence
  Synthetic
aaaggaugggagggguggcg

SEQ ID NO: 32598 - RNA, 20 nt, Artificial Sequence
  Synthetic
ggauguaucgcggggaugcg

SEQ ID NO: 32599 - RNA, 20 nt, Artificial Sequence
  Synthetic
ugcgugggagugggggugcg

SEQ ID NO: 32600 - RNA, 20 nt, Artificial Sequence
  Synthetic
cauggagacggggaacaucg

SEQ ID NO: 32601 - RNA, 20 nt, Artificial Sequence
  Synthetic
ugucuguguuggauguaucg

SEQ ID NO: 32602 - RNA, 20 nt, Artificial Sequence
  Synthetic
cgggggccgucggguacucg

SEQ ID NO: 32603 - RNA, 20 nt, Artificial Sequence
  Synthetic
uccgggcgggcaggcgcucg

SEQ ID NO: 32604 - RNA, 20 nt, Artificial Sequence
  Synthetic
cgcgcuaccugcccaucucg

SEQ ID NO: 32605 - RNA, 20 nt, Artificial Sequence
  Synthetic
cgugguuacccgcggucucg

SEQ ID NO: 32606 - RNA, 20 nt, Artificial Sequence
  Synthetic
acaccagccaauccgugucg

SEQ ID NO: 32607 - RNA, 20 nt, Artificial Sequence
  Synthetic
ccaguggcaggaugcuuucg

SEQ ID NO: 32608 - RNA, 20 nt, Artificial Sequence
  Synthetic
gggacggggcgcccaaaagg

SEQ ID NO: 32609 - RNA, 20 nt, Artificial Sequence
  Synthetic
caugcucggugguaugaagg

SEQ ID NO: 32610 - RNA, 20 nt, Artificial Sequence
  Synthetic
cgcgcacccgcgcggccagg

SEQ ID NO: 32611 - RNA, 20 nt, Artificial Sequence
  Synthetic
cccgugguccggggagcagg

SEQ ID NO: 32612 - RNA, 20 nt, Artificial Sequence
  Synthetic
gcucggugguaugaaggagg

SEQ ID NO: 32613 - RNA, 20 nt, Artificial Sequence
  Synthetic
cccccguguuuguggggagg

SEQ ID NO: 32614 - RNA, 20 nt, Artificial Sequence
  Synthetic
cccccuccccacaaacacgg

SEQ ID NO: 32615 - RNA, 20 nt, Artificial Sequence
  Synthetic
gaacagcauguuccccacgg

SEQ ID NO: 32616 - RNA, 20 nt, Artificial Sequence
  Synthetic
cgugaacaagacuaucacgg

SEQ ID NO: 32617 - RNA, 20 nt, Artificial Sequence
  Synthetic
accaaccccacgucccccgg

SEQ ID NO: 32618 - RNA, 20 nt, Artificial Sequence
  Synthetic
ugcuucuuagagaccgccgg

SEQ ID NO: 32619 - RNA, 20 nt, Artificial Sequence
  Synthetic
gcuguuccacuccgacgcgg

SEQ ID NO: 32620 - RNA, 20 nt, Artificial Sequence
  Synthetic
gcgcugcuucugggccgcgg

SEQ ID NO: 32621 - RNA, 20 nt, Artificial Sequence
  Synthetic
gcggcccagaagcagcgcgg

SEQ ID NO: 32622 - RNA, 20 nt, Artificial Sequence
  Synthetic
cuggccgccacaaagggcgg

SEQ ID NO: 32623 - RNA, 20 nt, Artificial Sequence
  Synthetic
gguguugggggguggggcgg

SEQ ID NO: 32624 - RNA, 20 nt, Artificial Sequence
  Synthetic
ucucggggagcagggugcgg

SEQ ID NO: 32625 - RNA, 20 nt, Artificial Sequence
  Synthetic
aggaugcuuucggggaucgg

SEQ ID NO: 32626 - RNA, 20 nt, Artificial Sequence
  Synthetic
gggggccgucggguacucgg

SEQ ID NO: 32627 - RNA, 20 nt, Artificial Sequence
  Synthetic
ccacacccaggcaugcucgg

SEQ ID NO: 32628 - RNA, 20 nt, Artificial Sequence
  Synthetic
gcgcuaccugcccaucucgg

SEQ ID NO: 32629 - RNA, 20 nt, Artificial Sequence
  Synthetic
ccucuggccgccacaaaggg

SEQ ID NO: 32630 - RNA, 20 nt, Artificial Sequence
  Synthetic
agcagcgcgggggccgaggg

SEQ ID NO: 32631 - RNA, 20 nt, Artificial Sequence
  Synthetic
cucggugguaugaaggaggg

SEQ ID NO: 32632 - RNA, 20 nt, Artificial Sequence
  Synthetic
ccccguguuuguggggaggg

SEQ ID NO: 32633 - RNA, 20 nt, Artificial Sequence
  Synthetic
ccccuccccacaaacacggg

SEQ ID NO: 32634 - RNA, 20 nt, Artificial Sequence
  Synthetic
agaggccaggucaguccggg

SEQ ID NO: 32635 - RNA, 20 nt, Artificial Sequence
  Synthetic
uccggggccguccccgcggg

SEQ ID NO: 32636 - RNA, 20 nt, Artificial Sequence
  Synthetic
uggccgccacaaagggcggg

SEQ ID NO: 32637 - RNA, 20 nt, Artificial Sequence
  Synthetic
ggggccgucggguacucggg

SEQ ID NO: 32638 - RNA, 20 nt, Artificial Sequence
  Synthetic
ucggugguaugaaggagggg

SEQ ID NO: 32639 - RNA, 20 nt, Artificial Sequence
  Synthetic
ugggggguggggcggagggg

SEQ ID NO: 32640 - RNA, 20 nt, Artificial Sequence
  Synthetic
cccguguuuguggggagggg

SEQ ID NO: 32641 - RNA, 20 nt, Artificial Sequence
  Synthetic
gcaacaaaggaugggagggg

SEQ ID NO: 32642 - RNA, 20 nt, Artificial Sequence
  Synthetic
ggccgccacaaagggcgggg

SEQ ID NO: 32643 - RNA, 20 nt, Artificial Sequence
  Synthetic
ggaugggagggguggcgggg

SEQ ID NO: 32644 - RNA, 20 nt, Artificial Sequence
  Synthetic
ccagccaauccgugucgggg

SEQ ID NO: 32645 - RNA, 20 nt, Artificial Sequence
  Synthetic
ccguguuuguggggaggggg

SEQ ID NO: 32646 - RNA, 20 nt, Artificial Sequence
  Synthetic
gccgccacaaagggcggggg

SEQ ID NO: 32647 - RNA, 20 nt, Artificial Sequence
  Synthetic
gugguaugaaggaggggggg

SEQ ID NO: 32648 - RNA, 20 nt, Artificial Sequence
  Synthetic
gggcggaggggugggggggg

SEQ ID NO: 32649 - RNA, 20 nt, Artificial Sequence
  Synthetic
ggggcggagggguggggggg

SEQ ID NO: 32650 - RNA, 20 nt, Artificial Sequence
  Synthetic
uggggcggaggggugggggg

SEQ ID NO: 32651 - RNA, 20 nt, Artificial Sequence
  Synthetic
cagacguggguguugggggg

SEQ ID NO: 32652 - RNA, 20 nt, Artificial Sequence
  Synthetic
guggggcggagggguggggg

SEQ ID NO: 32653 - RNA, 20 nt, Artificial Sequence
  Synthetic
gguggggcggaggggugggg

SEQ ID NO: 32654 - RNA, 20 nt, Artificial Sequence
  Synthetic
guggguguuggggggugggg

SEQ ID NO: 32655 - RNA, 20 nt, Artificial Sequence
  Synthetic
cgccccccguguuugugggg

SEQ ID NO: 32656 - RNA, 20 nt, Artificial Sequence
  Synthetic
auagggcaacaaaggauggg

SEQ ID NO: 32657 - RNA, 20 nt, Artificial Sequence
  Synthetic
ggggggggucgggcgcuggg

SEQ ID NO: 32658 - RNA, 20 nt, Artificial Sequence
  Synthetic
ggguggggcggagggguggg

SEQ ID NO: 32659 - RNA, 20 nt, Artificial Sequence
  Synthetic
ccacagacguggguguuggg

SEQ ID NO: 32660 - RNA, 20 nt, Artificial Sequence
  Synthetic
cggggcguacgugguccugg

SEQ ID NO: 32661 - RNA, 20 nt, Artificial Sequence
  Synthetic
gcggggaugcgugggagugg

SEQ ID NO: 32662 - RNA, 20 nt, Artificial Sequence
  Synthetic
gugggggugcgugggagugg

SEQ ID NO: 32663 - RNA, 20 nt, Artificial Sequence
  Synthetic
gggguggggcggaggggugg

SEQ ID NO: 32664 - RNA, 20 nt, Artificial Sequence
  Synthetic
acaaaggaugggaggggugg

SEQ ID NO: 32665 - RNA, 20 nt, Artificial Sequence
  Synthetic
accccccccgcccuuugugg

SEQ ID NO: 32666 - RNA, 20 nt, Artificial Sequence
  Synthetic
accacagacguggguguugg

SEQ ID NO: 32667 - RNA, 20 nt, Artificial Sequence
  Synthetic
auaguuagaaaacaagaaug

SEQ ID NO: 32668 - RNA, 20 nt, Artificial Sequence
  Synthetic
cacccacacccaacccacug

SEQ ID NO: 32669 - RNA, 20 nt, Artificial Sequence
  Synthetic
cccuggacuuccgcagccug

SEQ ID NO: 32670 - RNA, 20 nt, Artificial Sequence
  Synthetic
ggugccgagaccgcaggcug

SEQ ID NO: 32671 - RNA, 20 nt, Artificial Sequence
  Synthetic
gaaacauggcgacccggcug

SEQ ID NO: 32672 - RNA, 20 nt, Artificial Sequence
  Synthetic
cagcccgggccgcggcucug

SEQ ID NO: 32673 - RNA, 20 nt, Artificial Sequence
  Synthetic
ccccccaacacccacgucug

SEQ ID NO: 32674 - RNA, 20 nt, Artificial Sequence
  Synthetic
cgcggggaugcgugggagug

SEQ ID NO: 32675 - RNA, 20 nt, Artificial Sequence
  Synthetic
agugggggugcgugggagug

SEQ ID NO: 32676 - RNA, 20 nt, Artificial Sequence
  Synthetic
agagaccgccgggggacgug

SEQ ID NO: 32677 - RNA, 20 nt, Artificial Sequence
  Synthetic
gccucuggaugacccccgug

SEQ ID NO: 32678 - RNA, 20 nt, Artificial Sequence
  Synthetic
agaugggcagguagcgcgug

SEQ ID NO: 32679 - RNA, 20 nt, Artificial Sequence
  Synthetic
cggucucggggagcagggug

SEQ ID NO: 32680 - RNA, 20 nt, Artificial Sequence
  Synthetic
ggggguggggcggaggggug

SEQ ID NO: 32681 - RNA, 20 nt, Artificial Sequence
  Synthetic
gacguggguguuggggggug

SEQ ID NO: 32682 - RNA, 20 nt, Artificial Sequence
  Synthetic
ccaccgagcaugccugggug

SEQ ID NO: 32683 - RNA, 20 nt, Artificial Sequence
  Synthetic
gaaccacaguggguugggug

SEQ ID NO: 32684 - RNA, 20 nt, Artificial Sequence
  Synthetic
caacacccacgucuguggug

SEQ ID NO: 32685 - RNA, 20 nt, Artificial Sequence
  Synthetic
acaaaagacccgcuggugug

SEQ ID NO: 32686 - RNA, 20 nt, Artificial Sequence
  Synthetic
ggacgccccccguguuugug

SEQ ID NO: 32687 - RNA, 20 nt, Artificial Sequence
  Synthetic
caccacagacguggguguug

SEQ ID NO: 32688 - RNA, 20 nt, Artificial Sequence
  Synthetic
uuaaccccccccgcccuuug

SEQ ID NO: 32689 - RNA, 20 nt, Artificial Sequence
  Synthetic
agggacgccccccguguuug

SEQ ID NO: 32690 - RNA, 20 nt, Artificial Sequence
  Synthetic
gacauggagacggggaacau

SEQ ID NO: 32691 - RNA, 20 nt, Artificial Sequence
  Synthetic
acgcuagagacccccgagau

SEQ ID NO: 32692 - RNA, 20 nt, Artificial Sequence
  Synthetic
acuauagggcaacaaaggau

SEQ ID NO: 32693 - RNA, 20 nt, Artificial Sequence
  Synthetic
cccgucuccauguccaggau

SEQ ID NO: 32694 - RNA, 20 nt, Artificial Sequence
  Synthetic
uuccccuccccgacacggau

SEQ ID NO: 32695 - RNA, 20 nt, Artificial Sequence
  Synthetic
aucacaggagacgaggggau

SEQ ID NO: 32696 - RNA, 20 nt, Artificial Sequence
  Synthetic
ggcaggaugcuuucggggau

SEQ ID NO: 32697 - RNA, 20 nt, Artificial Sequence
  Synthetic
ggggggguuaacuacacuau

SEQ ID NO: 32698 - RNA, 20 nt, Artificial Sequence
  Synthetic
ggaaguccagggcgcccacu

SEQ ID NO: 32699 - RNA, 20 nt, Artificial Sequence
  Synthetic
cgcgggggccgucggguacu

SEQ ID NO: 32700 - RNA, 20 nt, Artificial Sequence
  Synthetic
agacaagaggaaaccucccu

SEQ ID NO: 32701 - RNA, 20 nt, Artificial Sequence
  Synthetic
ucauaccaccgagcaugccu

SEQ ID NO: 32702 - RNA, 20 nt, Artificial Sequence
  Synthetic
gucuuccgggcacacuuccu

SEQ ID NO: 32703 - RNA, 20 nt, Artificial Sequence
  Synthetic
ggaggggggggucgggcgcu

SEQ ID NO: 32704 - RNA, 20 nt, Artificial Sequence
  Synthetic
aacccacacccaggcaugcu

SEQ ID NO: 32705 - RNA, 20 nt, Artificial Sequence
  Synthetic
cacgcgcuaccugcccaucu

SEQ ID NO: 32706 - RNA, 20 nt, Artificial Sequence
  Synthetic
cacgugguuacccgcggucu

SEQ ID NO: 32707 - RNA, 20 nt, Artificial Sequence
  Synthetic
acuuccgcagccugcggucu

SEQ ID NO: 32708 - RNA, 20 nt, Artificial Sequence
  Synthetic
ucggcccccgcgcugcuucu

SEQ ID NO: 32709 - RNA, 20 nt, Artificial Sequence
  Synthetic
cauggagccagaaccacagu

SEQ ID NO: 32710 - RNA, 20 nt, Artificial Sequence
  Synthetic
ucgcggggaugcgugggagu

SEQ ID NO: 32711 - RNA, 20 nt, Artificial Sequence
  Synthetic
gagugggggugcgugggagu

SEQ ID NO: 32712 - RNA, 20 nt, Artificial Sequence
  Synthetic
uucgaccagggcacccuagu

SEQ ID NO: 32713 - RNA, 20 nt, Artificial Sequence
  Synthetic
cacggauuggcugguguagu

SEQ ID NO: 32714 - RNA, 20 nt, Artificial Sequence
  Synthetic
gucggccacaccacagacgu

SEQ ID NO: 32715 - RNA, 20 nt, Artificial Sequence
  Synthetic
uagagaccgccgggggacgu

SEQ ID NO: 32716 - RNA, 20 nt, Artificial Sequence
  Synthetic
agccucuggaugacccccgu

SEQ ID NO: 32717 - RNA, 20 nt, Artificial Sequence
  Synthetic
cacuccgacgcgggggccgu

SEQ ID NO: 32718 - RNA, 20 nt, Artificial Sequence
  Synthetic
guacccgacggcccccgcgu

SEQ ID NO: 32719 - RNA, 20 nt, Artificial Sequence
  Synthetic
gauguaucgcggggaugcgu

SEQ ID NO: 32720 - RNA, 20 nt, Artificial Sequence
  Synthetic
gcgugggagugggggugcgu

SEQ ID NO: 32721 - RNA, 20 nt, Artificial Sequence
  Synthetic
gcgcacccgcgcggccaggu

SEQ ID NO: 32722 - RNA, 20 nt, Artificial Sequence
  Synthetic
gggggguggggcggaggggu

SEQ ID NO: 32723 - RNA, 20 nt, Artificial Sequence
  Synthetic
cggggcgcccaaaagggggu

SEQ ID NO: 32724 - RNA, 20 nt, Artificial Sequence
  Synthetic
guuuguggggaggggggggu

SEQ ID NO: 32725 - RNA, 20 nt, Artificial Sequence
  Synthetic
agacguggguguuggggggu

SEQ ID NO: 32726 - RNA, 20 nt, Artificial Sequence
  Synthetic
accgccgggggacguggggu

SEQ ID NO: 32727 - RNA, 20 nt, Artificial Sequence
  Synthetic
gagccagaaccacagugggu

SEQ ID NO: 32728 - RNA, 20 nt, Artificial Sequence
  Synthetic
gagcaugccugggugugggu

SEQ ID NO: 32729 - RNA, 20 nt, Artificial Sequence
  Synthetic
ugggagugggggugccaugu

SEQ ID NO: 32730 - RNA, 20 nt, Artificial Sequence
  Synthetic
aggggauuuuugcugucugu

SEQ ID NO: 32731 - RNA, 20 nt, Artificial Sequence
  Synthetic
cuacaccagccaauccgugu

SEQ ID NO: 32732 - RNA, 20 nt, Artificial Sequence
  Synthetic
agacgaggggaugggcgugu

SEQ ID NO: 32733 - RNA, 20 nt, Artificial Sequence
  Synthetic
caccgagcaugccugggugu

SEQ ID NO: 32734 - RNA, 20 nt, Artificial Sequence
  Synthetic
cacaccacagacgugggugu

SEQ ID NO: 32735 - RNA, 20 nt, Artificial Sequence
  Synthetic
aaccacaguggguugggugu

SEQ ID NO: 32736 - RNA, 20 nt, Artificial Sequence
  Synthetic
uaucuuuucccugucugugu

SEQ ID NO: 32737 - RNA, 20 nt, Artificial Sequence
  Synthetic
caccagcgggucuuuugugu

SEQ ID NO: 32738 - RNA, 20 nt, Artificial Sequence
  Synthetic
gggacgccccccguguuugu

SEQ ID NO: 32739 - RNA, 20 nt, Artificial Sequence
  Synthetic
ccccugaguuuuuuuuuauu

SEQ ID NO: 32740 - RNA, 20 nt, Artificial Sequence
  Synthetic
agccagaaccacaguggguu

SEQ ID NO: 32741 - RNA, 20 nt, Artificial Sequence
  Synthetic
gggagugggggugccauguu

SEQ ID NO: 32742 - RNA, 20 nt, Artificial Sequence
  Synthetic
ggggauuuuugcugucuguu

SEQ ID NO: 32743 - RNA, 20 nt, Artificial Sequence
  Synthetic
acaccacagacguggguguu

SEQ ID NO: 32744 - RNA, 20 nt, Artificial Sequence
  Synthetic
ugguguggccgacccccuuu

SEQ ID NO: 32745 - RNA, 20 nt, Artificial Sequence
  Synthetic
ugccaguggcaggaugcuuu

SEQ ID NO: 32746 - RNA, 20 nt, Artificial Sequence
  Synthetic
gguguggccgacccccuuuu

SEQ ID NO: 32747 - RNA, 18 nt, Artificial Sequence
  Synthetic
ggucggacggguaaguaa

SEQ ID NO: 32748 - RNA, 20 nt, Artificial Sequence
  Synthetic
guggucggacggguaaguaa

SEQ ID NO: 32749 - RNA, 21 nt, Artificial Sequence
  Synthetic
gguggucggacggguaaguaa

SEQ ID NO: 32750 - RNA, 24 nt, Artificial Sequence
  Synthetic
guugguggucggacggguaaguaa

SEQ ID NO: 32751 - RNA, 22 nt, Artificial Sequence
  Synthetic
gacacaugccuucuuggaguac

SEQ ID NO: 32752 - RNA, 23 nt, Artificial Sequence
  Synthetic
ggacacaugccuucuuggaguac

SEQ ID NO: 32753 - RNA, 24 nt, Artificial Sequence
  Synthetic
gggacacaugccuucuuggaguac

SEQ ID NO: 32754 - RNA, 20 nt, Artificial Sequence
  Synthetic
gcuguaacacgagcccaccc

SEQ ID NO: 32755 - RNA, 22 nt, Artificial Sequence
  Synthetic
gugcuguaacacgagcccaccc

SEQ ID NO: 32756 - RNA, 24 nt, Artificial Sequence
  Synthetic
gugugcuguaacacgagcccaccc

SEQ ID NO: 32757 - RNA, 24 nt, Artificial Sequence
  Synthetic
gauaagggggcaguugguggucgg

SEQ ID NO: 32758 - RNA, 20 nt, Artificial Sequence
  Synthetic
guacgugggucauuggcgug

SEQ ID NO: 32759 - RNA, 22 nt, Artificial Sequence
  Synthetic
gaguacgugggucauuggcgug

SEQ ID NO: 32760 - RNA, 23 nt, Artificial Sequence
  Synthetic
ggaguacgugggucauuggcgug

SEQ ID NO: 32761 - RNA, 21 nt, Artificial Sequence
  Synthetic
gguaaguaacagagucugacu

SEQ ID NO: 32762 - RNA, 22 nt, Artificial Sequence
  Synthetic
ggguaaguaacagagucugacu

SEQ ID NO: 32763 - RNA, 18 nt, Artificial Sequence
  Synthetic
gugggacacaugccuucu

SEQ ID NO: 32764 - RNA, 19 nt, Artificial Sequence
  Synthetic
ggugggacacaugccuucu

SEQ ID NO: 32765 - RNA, 20 nt, Artificial Sequence
  Synthetic
gggugggacacaugccuucu

SEQ ID NO: 32766 - RNA, 21 nt, Artificial Sequence
  Synthetic
ggggugggacacaugccuucu

SEQ ID NO: 32767 - RNA, 23 nt, Artificial Sequence
  Synthetic
gcggggugggacacaugccuucu

SEQ ID NO: 32768 - RNA, 24 nt, Artificial Sequence
  Synthetic
ggcggggugggacacaugccuucu

SEQ ID NO: 32769 - RNA, 23 nt, Artificial Sequence
  Synthetic
gccucuggggcgcccccugucgu

SEQ ID NO: 32770 - RNA, 19 nt, Artificial Sequence
  Synthetic
gccggcuggaagaccgcca

SEQ ID NO: 32771 - RNA, 20 nt, Artificial Sequence
  Synthetic
ggccggcuggaagaccgcca

SEQ ID NO: 32772 - RNA, 21 nt, Artificial Sequence
  Synthetic
gggccggcuggaagaccgcca

SEQ ID NO: 32773 - RNA, 23 nt, Artificial Sequence
  Synthetic
gaccggggugaucucuggcacgc

SEQ ID NO: 32774 - RNA, 24 nt, Artificial Sequence
  Synthetic
ggaccggggugaucucuggcacgc

SEQ ID NO: 32775 - RNA, 24 nt, Artificial Sequence
  Synthetic
guuuuugugccuggcucucuaugc

SEQ ID NO: 32776 - RNA, 22 nt, Artificial Sequence
  Synthetic
gcuaaggucggccacgccacuc

SEQ ID NO: 32777 - RNA, 23 nt, Artificial Sequence
  Synthetic
ggcuaaggucggccacgccacuc

SEQ ID NO: 32778 - RNA, 21 nt, Artificial Sequence
  Synthetic
guuccuaaagcgaggauacgg

SEQ ID NO: 32779 - RNA, 24 nt, Artificial Sequence
  Synthetic
guuguuccuaaagcgaggauacgg

SEQ ID NO: 32780 - RNA, 21 nt, Artificial Sequence
  Synthetic
gggucuuacugccuggggggg

SEQ ID NO: 32781 - RNA, 23 nt, Artificial Sequence
  Synthetic
gaucucuggcacgcggggguggg

SEQ ID NO: 32782 - RNA, 19 nt, Artificial Sequence
  Synthetic
gcgaggauacggaggagug

SEQ ID NO: 32783 - RNA, 19 nt, Artificial Sequence
  Synthetic
uggucggacggguaaguaa

SEQ ID NO: 32784 - RNA, 22 nt, Artificial Sequence
  Synthetic
ugguggucggacggguaaguaa

SEQ ID NO: 32785 - RNA, 23 nt, Artificial Sequence
  Synthetic
uugguggucggacggguaaguaa

SEQ ID NO: 32786 - RNA, 21 nt, Artificial Sequence
  Synthetic
acacaugccuucuuggaguac

SEQ ID NO: 32787 - RNA, 18 nt, Artificial Sequence
  Synthetic
uguaacacgagcccaccc

SEQ ID NO: 32788 - RNA, 19 nt, Artificial Sequence
  Synthetic
cuguaacacgagcccaccc

SEQ ID NO: 32789 - RNA, 21 nt, Artificial Sequence
  Synthetic
ugcuguaacacgagcccaccc

SEQ ID NO: 32790 - RNA, 23 nt, Artificial Sequence
  Synthetic
ugugcuguaacacgagcccaccc

SEQ ID NO: 32791 - RNA, 21 nt, Artificial Sequence
  Synthetic
aagggggcaguugguggucgg

SEQ ID NO: 32792 - RNA, 22 nt, Artificial Sequence
  Synthetic
uaagggggcaguugguggucgg

SEQ ID NO: 32793 - RNA, 23 nt, Artificial Sequence
  Synthetic
auaagggggcaguugguggucgg

SEQ ID NO: 32794 - RNA, 18 nt, Artificial Sequence
  Synthetic
acgugggucauuggcgug

SEQ ID NO: 32795 - RNA, 19 nt, Artificial Sequence
  Synthetic
uacgugggucauuggcgug

SEQ ID NO: 32796 - RNA, 21 nt, Artificial Sequence
  Synthetic
aguacgugggucauuggcgug

SEQ ID NO: 32797 - RNA, 24 nt, Artificial Sequence
  Synthetic
uggaguacgugggucauuggcgug

SEQ ID NO: 32798 - RNA, 23 nt, Artificial Sequence
  Synthetic
cggguaaguaacagagucugacu

SEQ ID NO: 32799 - RNA, 24 nt, Artificial Sequence
  Synthetic
acggguaaguaacagagucugacu

SEQ ID NO: 32800 - RNA, 22 nt, Artificial Sequence
  Synthetic
cggggugggacacaugccuucu

SEQ ID NO: 32801 - RNA, 18 nt, Artificial Sequence
  Synthetic
uggggcgcccccugucgu

SEQ ID NO: 32802 - RNA, 19 nt, Artificial Sequence
  Synthetic
cuggggcgcccccugucgu

SEQ ID NO: 32803 - RNA, 20 nt, Artificial Sequence
  Synthetic
ucuggggcgcccccugucgu

SEQ ID NO: 32804 - RNA, 21 nt, Artificial Sequence
  Synthetic
cucuggggcgcccccugucgu

SEQ ID NO: 32805 - RNA, 22 nt, Artificial Sequence
  Synthetic
ccucuggggcgcccccugucgu

SEQ ID NO: 32806 - RNA, 24 nt, Artificial Sequence
  Synthetic
agccucuggggcgcccccugucgu

SEQ ID NO: 32807 - RNA, 18 nt, Artificial Sequence
  Synthetic
ccggcuggaagaccgcca

SEQ ID NO: 32808 - RNA, 22 nt, Artificial Sequence
  Synthetic
agggccggcuggaagaccgcca

SEQ ID NO: 32809 - RNA, 23 nt, Artificial Sequence
  Synthetic
aagggccggcuggaagaccgcca

SEQ ID NO: 32810 - RNA, 24 nt, Artificial Sequence
  Synthetic
uaagggccggcuggaagaccgcca

SEQ ID NO: 32811 - RNA, 21 nt, Artificial Sequence
  Synthetic
cccuaaaguuguuccuaaagc

SEQ ID NO: 32812 - RNA, 22 nt, Artificial Sequence
  Synthetic
ccccuaaaguuguuccuaaagc

SEQ ID NO: 32813 - RNA, 23 nt, Artificial Sequence
  Synthetic
cccccuaaaguuguuccuaaagc

SEQ ID NO: 32814 - RNA, 24 nt, Artificial Sequence
  Synthetic
ccccccuaaaguuguuccuaaagc

SEQ ID NO: 32815 - RNA, 21 nt, Artificial Sequence
  Synthetic
ccggggugaucucuggcacgc

SEQ ID NO: 32816 - RNA, 22 nt, Artificial Sequence
  Synthetic
accggggugaucucuggcacgc

SEQ ID NO: 32817 - RNA, 21 nt, Artificial Sequence
  Synthetic
uuugugccuggcucucuaugc

SEQ ID NO: 32818 - RNA, 22 nt, Artificial Sequence
  Synthetic
uuuugugccuggcucucuaugc

SEQ ID NO: 32819 - RNA, 23 nt, Artificial Sequence
  Synthetic
uuuuugugccuggcucucuaugc

SEQ ID NO: 32820 - RNA, 18 nt, Artificial Sequence
  Synthetic
aggucggccacgccacuc

SEQ ID NO: 32821 - RNA, 19 nt, Artificial Sequence
  Synthetic
aaggucggccacgccacuc

SEQ ID NO: 32822 - RNA, 20 nt, Artificial Sequence
  Synthetic
uaaggucggccacgccacuc

SEQ ID NO: 32823 - RNA, 21 nt, Artificial Sequence
  Synthetic
cuaaggucggccacgccacuc

SEQ ID NO: 32824 - RNA, 24 nt, Artificial Sequence
  Synthetic
aggcuaaggucggccacgccacuc

SEQ ID NO: 32825 - RNA, 18 nt, Artificial Sequence
  Synthetic
ccuaaagcgaggauacgg

SEQ ID NO: 32826 - RNA, 19 nt, Artificial Sequence
  Synthetic
uccuaaagcgaggauacgg

SEQ ID NO: 32827 - RNA, 20 nt, Artificial Sequence
  Synthetic
uuccuaaagcgaggauacgg

SEQ ID NO: 32828 - RNA, 22 nt, Artificial Sequence
  Synthetic
uguuccuaaagcgaggauacgg

SEQ ID NO: 32829 - RNA, 23 nt, Artificial Sequence
  Synthetic
uuguuccuaaagcgaggauacgg

SEQ ID NO: 32830 - RNA, 22 nt, Artificial Sequence
  Synthetic
ugggucuuacugccuggggggg

SEQ ID NO: 32831 - RNA, 23 nt, Artificial Sequence
  Synthetic
uugggucuuacugccuggggggg

SEQ ID NO: 32832 - RNA, 24 nt, Artificial Sequence
  Synthetic
cuugggucuuacugccuggggggg

SEQ ID NO: 32833 - RNA, 21 nt, Artificial Sequence
  Synthetic
ucucuggcacgcggggguggg

SEQ ID NO: 32834 - RNA, 22 nt, Artificial Sequence
  Synthetic
aucucuggcacgcggggguggg

SEQ ID NO: 32835 - RNA, 24 nt, Artificial Sequence
  Synthetic
ugaucucuggcacgcggggguggg

SEQ ID NO: 32836 - RNA, 18 nt, Artificial Sequence
  Synthetic
cgaggauacggaggagug

SEQ ID NO: 32837 - RNA, 20 nt, Artificial Sequence
  Synthetic
agcgaggauacggaggagug

SEQ ID NO: 32838 - RNA, 21 nt, Artificial Sequence
  Synthetic
aagcgaggauacggaggagug

SEQ ID NO: 32839 - RNA, 22 nt, Artificial Sequence
  Synthetic
aaagcgaggauacggaggagug

SEQ ID NO: 32840 - RNA, 23 nt, Artificial Sequence
  Synthetic
uaaagcgaggauacggaggagug

SEQ ID NO: 32841 - RNA, 24 nt, Artificial Sequence
  Synthetic
cuaaagcgaggauacggaggagug

SEQ ID NO: 32842 - RNA, 18 nt, Artificial Sequence
  Synthetic
caugccuucuuggaguac

SEQ ID NO: 32843 - RNA, 19 nt, Artificial Sequence
  Synthetic
acaugccuucuuggaguac

SEQ ID NO: 32844 - RNA, 20 nt, Artificial Sequence
  Synthetic
cacaugccuucuuggaguac

SEQ ID NO: 32845 - RNA, 18 nt, Artificial Sequence
  Synthetic
caggcacaaaaacacagg

SEQ ID NO: 32846 - RNA, 19 nt, Artificial Sequence
  Synthetic
ccaggcacaaaaacacagg

SEQ ID NO: 32847 - RNA, 20 nt, Artificial Sequence
  Synthetic
gccaggcacaaaaacacagg

SEQ ID NO: 32848 - RNA, 21 nt, Artificial Sequence
  Synthetic
agccaggcacaaaaacacagg

SEQ ID NO: 32849 - RNA, 22 nt, Artificial Sequence
  Synthetic
gagccaggcacaaaaacacagg

SEQ ID NO: 32850 - RNA, 23 nt, Artificial Sequence
  Synthetic
agagccaggcacaaaaacacagg

SEQ ID NO: 32851 - RNA, 24 nt, Artificial Sequence
  Synthetic
gagagccaggcacaaaaacacagg

SEQ ID NO: 32852 - RNA, 18 nt, Artificial Sequence
  Synthetic
uuuaggaacaacuuuagg

SEQ ID NO: 32853 - RNA, 19 nt, Artificial Sequence
  Synthetic
cuuuaggaacaacuuuagg

SEQ ID NO: 32854 - RNA, 20 nt, Artificial Sequence
  Synthetic
gcuuuaggaacaacuuuagg

SEQ ID NO: 32855 - RNA, 21 nt, Artificial Sequence
  Synthetic
cgcuuuaggaacaacuuuagg

SEQ ID NO: 32856 - RNA, 22 nt, Artificial Sequence
  Synthetic
ucgcuuuaggaacaacuuuagg

SEQ ID NO: 32857 - RNA, 23 nt, Artificial Sequence
  Synthetic
cucgcuuuaggaacaacuuuagg

SEQ ID NO: 32858 - RNA, 24 nt, Artificial Sequence
  Synthetic
ccucgcuuuaggaacaacuuuagg

SEQ ID NO: 32859 - RNA, 18 nt, Artificial Sequence
  Synthetic
ggggcaguugguggucgg

SEQ ID NO: 32860 - RNA, 19 nt, Artificial Sequence
  Synthetic
gggggcaguugguggucgg

SEQ ID NO: 32861 - RNA, 20 nt, Artificial Sequence
  Synthetic
agggggcaguugguggucgg

SEQ ID NO: 32862 - RNA, 18 nt, Artificial Sequence
  Synthetic
aaguaacagagucugacu

SEQ ID NO: 32863 - RNA, 19 nt, Artificial Sequence
  Synthetic
uaaguaacagagucugacu

SEQ ID NO: 32864 - RNA, 20 nt, Artificial Sequence
  Synthetic
guaaguaacagagucugacu

SEQ ID NO: 32865 - RNA, 18 nt, Artificial Sequence
  Synthetic
uggcgggugccgggggac

SEQ ID NO: 32866 - RNA, 19 nt, Artificial Sequence
  Synthetic
guggcgggugccgggggac

SEQ ID NO: 32867 - RNA, 20 nt, Artificial Sequence
  Synthetic
aguggcgggugccgggggac

SEQ ID NO: 32868 - RNA, 21 nt, Artificial Sequence
  Synthetic
gaguggcgggugccgggggac

SEQ ID NO: 32869 - RNA, 22 nt, Artificial Sequence
  Synthetic
ggaguggcgggugccgggggac

SEQ ID NO: 32870 - RNA, 23 nt, Artificial Sequence
  Synthetic
aggaguggcgggugccgggggac

SEQ ID NO: 32871 - RNA, 24 nt, Artificial Sequence
  Synthetic
gaggaguggcgggugccgggggac

SEQ ID NO: 32872 - RNA, 18 nt, Artificial Sequence
  Synthetic
uaaaguuguuccuaaagc

SEQ ID NO: 32873 - RNA, 19 nt, Artificial Sequence
  Synthetic
cuaaaguuguuccuaaagc

SEQ ID NO: 32874 - RNA, 20 nt, Artificial Sequence
  Synthetic
ccuaaaguuguuccuaaagc

SEQ ID NO: 32875 - RNA, 18 nt, Artificial Sequence
  Synthetic
gggugaucucuggcacgc

SEQ ID NO: 32876 - RNA, 19 nt, Artificial Sequence
  Synthetic
ggggugaucucuggcacgc

SEQ ID NO: 32877 - RNA, 20 nt, Artificial Sequence
  Synthetic
cggggugaucucuggcacgc

SEQ ID NO: 32878 - RNA, 18 nt, Artificial Sequence
  Synthetic
gugccuggcucucuaugc

SEQ ID NO: 32879 - RNA, 19 nt, Artificial Sequence
  Synthetic
ugugccuggcucucuaugc

SEQ ID NO: 32880 - RNA, 20 nt, Artificial Sequence
  Synthetic
uugugccuggcucucuaugc

SEQ ID NO: 32881 - RNA, 18 nt, Artificial Sequence
  Synthetic
gggggagugcgggggagg

SEQ ID NO: 32882 - RNA, 19 nt, Artificial Sequence
  Synthetic
ggggggagugcgggggagg

SEQ ID NO: 32883 - RNA, 20 nt, Artificial Sequence
  Synthetic
gggggggagugcgggggagg

SEQ ID NO: 32884 - RNA, 21 nt, Artificial Sequence
  Synthetic
ggggggggagugcgggggagg

SEQ ID NO: 32885 - RNA, 22 nt, Artificial Sequence
  Synthetic
gggggggggagugcgggggagg

SEQ ID NO: 32886 - RNA, 23 nt, Artificial Sequence
  Synthetic
ggggggggggagugcgggggagg

SEQ ID NO: 32887 - RNA, 24 nt, Artificial Sequence
  Synthetic
uggggggggggagugcgggggagg

SEQ ID NO: 32888 - RNA, 18 nt, Artificial Sequence
  Synthetic
ucuuacugccuggggggg

SEQ ID NO: 32889 - RNA, 19 nt, Artificial Sequence
  Synthetic
gucuuacugccuggggggg

SEQ ID NO: 32890 - RNA, 20 nt, Artificial Sequence
  Synthetic
ggucuuacugccuggggggg

SEQ ID NO: 32891 - RNA, 18 nt, Artificial Sequence
  Synthetic
cuggcacgcggggguggg

SEQ ID NO: 32892 - RNA, 19 nt, Artificial Sequence
  Synthetic
ucuggcacgcggggguggg

SEQ ID NO: 32893 - RNA, 20 nt, Artificial Sequence
  Synthetic
cucuggcacgcggggguggg

SEQ ID NO: 32894 - RNA, 18 nt, Artificial Sequence
  Synthetic
agggugggagggggggaa

SEQ ID NO: 32895 - RNA, 19 nt, Artificial Sequence
  Synthetic
aagggugggagggggggaa

SEQ ID NO: 32896 - RNA, 20 nt, Artificial Sequence
  Synthetic
uaagggugggagggggggaa

SEQ ID NO: 32897 - RNA, 21 nt, Artificial Sequence
  Synthetic
cuaagggugggagggggggaa

SEQ ID NO: 32898 - RNA, 22 nt, Artificial Sequence
  Synthetic
acuaagggugggagggggggaa

SEQ ID NO: 32899 - RNA, 23 nt, Artificial Sequence
  Synthetic
gacuaagggugggagggggggaa

SEQ ID NO: 32900 - RNA, 24 nt, Artificial Sequence
  Synthetic
ugacuaagggugggagggggggaa

SEQ ID NO: 32901 - RNA, 18 nt, Artificial Sequence
  Synthetic
cagccggcccuuagauaa

SEQ ID NO: 32902 - RNA, 19 nt, Artificial Sequence
  Synthetic
ccagccggcccuuagauaa

SEQ ID NO: 32903 - RNA, 20 nt, Artificial Sequence
  Synthetic
uccagccggcccuuagauaa

SEQ ID NO: 32904 - RNA, 21 nt, Artificial Sequence
  Synthetic
uuccagccggcccuuagauaa

SEQ ID NO: 32905 - RNA, 22 nt, Artificial Sequence
  Synthetic
cuuccagccggcccuuagauaa

SEQ ID NO: 32906 - RNA, 23 nt, Artificial Sequence
  Synthetic
ucuuccagccggcccuuagauaa

SEQ ID NO: 32907 - RNA, 24 nt, Artificial Sequence
  Synthetic
gucuuccagccggcccuuagauaa

SEQ ID NO: 32908 - RNA, 18 nt, Artificial Sequence
  Synthetic
ggcaguaagacccaagca

SEQ ID NO: 32909 - RNA, 19 nt, Artificial Sequence
  Synthetic
aggcaguaagacccaagca

SEQ ID NO: 32910 - RNA, 20 nt, Artificial Sequence
  Synthetic
caggcaguaagacccaagca

SEQ ID NO: 32911 - RNA, 21 nt, Artificial Sequence
  Synthetic
ccaggcaguaagacccaagca

SEQ ID NO: 32912 - RNA, 22 nt, Artificial Sequence
  Synthetic
cccaggcaguaagacccaagca

SEQ ID NO: 32913 - RNA, 23 nt, Artificial Sequence
  Synthetic
ccccaggcaguaagacccaagca

SEQ ID NO: 32914 - RNA, 24 nt, Artificial Sequence
  Synthetic
cccccaggcaguaagacccaagca

SEQ ID NO: 32915 - RNA, 18 nt, Artificial Sequence
  Synthetic
ugggagggggggaaaaga

SEQ ID NO: 32916 - RNA, 19 nt, Artificial Sequence
  Synthetic
gugggagggggggaaaaga

SEQ ID NO: 32917 - RNA, 20 nt, Artificial Sequence
  Synthetic
ggugggagggggggaaaaga

SEQ ID NO: 32918 - RNA, 21 nt, Artificial Sequence
  Synthetic
gggugggagggggggaaaaga

SEQ ID NO: 32919 - RNA, 22 nt, Artificial Sequence
  Synthetic
agggugggagggggggaaaaga

SEQ ID NO: 32920 - RNA, 23 nt, Artificial Sequence
  Synthetic
aagggugggagggggggaaaaga

SEQ ID NO: 32921 - RNA, 24 nt, Artificial Sequence
  Synthetic
uaagggugggagggggggaaaaga

SEQ ID NO: 32922 - RNA, 18 nt, Artificial Sequence
  Synthetic
gucugacuaaggguggga

SEQ ID NO: 32923 - RNA, 19 nt, Artificial Sequence
  Synthetic
agucugacuaaggguggga

SEQ ID NO: 32924 - RNA, 20 nt, Artificial Sequence
  Synthetic
gagucugacuaaggguggga

SEQ ID NO: 32925 - RNA, 21 nt, Artificial Sequence
  Synthetic
agagucugacuaaggguggga

SEQ ID NO: 32926 - RNA, 22 nt, Artificial Sequence
  Synthetic
cagagucugacuaaggguggga

SEQ ID NO: 32927 - RNA, 23 nt, Artificial Sequence
  Synthetic
acagagucugacuaaggguggga

SEQ ID NO: 32928 - RNA, 24 nt, Artificial Sequence
  Synthetic
aacagagucugacuaaggguggga

SEQ ID NO: 32929 - RNA, 18 nt, Artificial Sequence
  Synthetic
caguaagacccaagcaua

SEQ ID NO: 32930 - RNA, 19 nt, Artificial Sequence
  Synthetic
gcaguaagacccaagcaua

SEQ ID NO: 32931 - RNA, 20 nt, Artificial Sequence
  Synthetic
ggcaguaagacccaagcaua

SEQ ID NO: 32932 - RNA, 21 nt, Artificial Sequence
  Synthetic
aggcaguaagacccaagcaua

SEQ ID NO: 32933 - RNA, 22 nt, Artificial Sequence
  Synthetic
caggcaguaagacccaagcaua

SEQ ID NO: 32934 - RNA, 23 nt, Artificial Sequence
  Synthetic
ccaggcaguaagacccaagcaua

SEQ ID NO: 32935 - RNA, 24 nt, Artificial Sequence
  Synthetic
cccaggcaguaagacccaagcaua

SEQ ID NO: 32936 - RNA, 18 nt, Artificial Sequence
  Synthetic
ccagccggcccuuagaua

SEQ ID NO: 32937 - RNA, 19 nt, Artificial Sequence
  Synthetic
uccagccggcccuuagaua

SEQ ID NO: 32938 - RNA, 20 nt, Artificial Sequence
  Synthetic
uuccagccggcccuuagaua

SEQ ID NO: 32939 - RNA, 21 nt, Artificial Sequence
  Synthetic
cuuccagccggcccuuagaua

SEQ ID NO: 32940 - RNA, 22 nt, Artificial Sequence
  Synthetic
ucuuccagccggcccuuagaua

SEQ ID NO: 32941 - RNA, 23 nt, Artificial Sequence
  Synthetic
gucuuccagccggcccuuagaua

SEQ ID NO: 32942 - RNA, 24 nt, Artificial Sequence
  Synthetic
ggucuuccagccggcccuuagaua

SEQ ID NO: 32943 - RNA, 18 nt, Artificial Sequence
  Synthetic
uuggguccccccccucua

SEQ ID NO: 32944 - RNA, 19 nt, Artificial Sequence
  Synthetic
uuuggguccccccccucua

SEQ ID NO: 32945 - RNA, 20 nt, Artificial Sequence
  Synthetic
guuuggguccccccccucua

SEQ ID NO: 32946 - RNA, 21 nt, Artificial Sequence
  Synthetic
cguuuggguccccccccucua

SEQ ID NO: 32947 - RNA, 22 nt, Artificial Sequence
  Synthetic
ucguuuggguccccccccucua

SEQ ID NO: 32948 - RNA, 23 nt, Artificial Sequence
  Synthetic
gucguuuggguccccccccucua

SEQ ID NO: 32949 - RNA, 24 nt, Artificial Sequence
  Synthetic
ugucguuuggguccccccccucua

SEQ ID NO: 32950 - RNA, 18 nt, Artificial Sequence
  Synthetic
gcuuuaggaacaacuuua

SEQ ID NO: 32951 - RNA, 19 nt, Artificial Sequence
  Synthetic
cgcuuuaggaacaacuuua

SEQ ID NO: 32952 - RNA, 20 nt, Artificial Sequence
  Synthetic
ucgcuuuaggaacaacuuua

SEQ ID NO: 32953 - RNA, 21 nt, Artificial Sequence
  Synthetic
cucgcuuuaggaacaacuuua

SEQ ID NO: 32954 - RNA, 22 nt, Artificial Sequence
  Synthetic
ccucgcuuuaggaacaacuuua

SEQ ID NO: 32955 - RNA, 23 nt, Artificial Sequence
  Synthetic
uccucgcuuuaggaacaacuuua

SEQ ID NO: 32956 - RNA, 24 nt, Artificial Sequence
  Synthetic
auccucgcuuuaggaacaacuuua

SEQ ID NO: 32957 - RNA, 18 nt, Artificial Sequence
  Synthetic
gggcuggugugcuguaac

SEQ ID NO: 32958 - RNA, 19 nt, Artificial Sequence
  Synthetic
cgggcuggugugcuguaac

SEQ ID NO: 32959 - RNA, 20 nt, Artificial Sequence
  Synthetic
acgggcuggugugcuguaac

SEQ ID NO: 32960 - RNA, 21 nt, Artificial Sequence
  Synthetic
aacgggcuggugugcuguaac

SEQ ID NO: 32961 - RNA, 22 nt, Artificial Sequence
  Synthetic
gaacgggcuggugugcuguaac

SEQ ID NO: 32962 - RNA, 23 nt, Artificial Sequence
  Synthetic
agaacgggcuggugugcuguaac

SEQ ID NO: 32963 - RNA, 24 nt, Artificial Sequence
  Synthetic
aagaacgggcuggugugcuguaac

SEQ ID NO: 32964 - RNA, 18 nt, Artificial Sequence
  Synthetic
aguacgugggucauuggc

SEQ ID NO: 32965 - RNA, 19 nt, Artificial Sequence
  Synthetic
gaguacgugggucauuggc

SEQ ID NO: 32966 - RNA, 20 nt, Artificial Sequence
  Synthetic
ggaguacgugggucauuggc

SEQ ID NO: 32967 - RNA, 21 nt, Artificial Sequence
  Synthetic
uggaguacgugggucauuggc

SEQ ID NO: 32968 - RNA, 22 nt, Artificial Sequence
  Synthetic
uuggaguacgugggucauuggc

SEQ ID NO: 32969 - RNA, 23 nt, Artificial Sequence
  Synthetic
cuuggaguacgugggucauuggc

SEQ ID NO: 32970 - RNA, 24 nt, Artificial Sequence
  Synthetic
ucuuggaguacgugggucauuggc

SEQ ID NO: 32971 - RNA, 18 nt, Artificial Sequence
  Synthetic
cuucccacccccgcgugc

SEQ ID NO: 32972 - RNA, 19 nt, Artificial Sequence
  Synthetic
ccuucccacccccgcgugc

SEQ ID NO: 32973 - RNA, 20 nt, Artificial Sequence
  Synthetic
cccuucccacccccgcgugc

SEQ ID NO: 32974 - RNA, 21 nt, Artificial Sequence
  Synthetic
acccuucccacccccgcgugc

SEQ ID NO: 32975 - RNA, 22 nt, Artificial Sequence
  Synthetic
gacccuucccacccccgcgugc

SEQ ID NO: 32976 - RNA, 23 nt, Artificial Sequence
  Synthetic
cgacccuucccacccccgcgugc

SEQ ID NO: 32977 - RNA, 24 nt, Artificial Sequence
  Synthetic
ccgacccuucccacccccgcgugc

SEQ ID NO: 32978 - RNA, 18 nt, Artificial Sequence
  Synthetic
guggccgaccuuagccuc

SEQ ID NO: 32979 - RNA, 19 nt, Artificial Sequence
  Synthetic
cguggccgaccuuagccuc

SEQ ID NO: 32980 - RNA, 20 nt, Artificial Sequence
  Synthetic
gcguggccgaccuuagccuc

SEQ ID NO: 32981 - RNA, 21 nt, Artificial Sequence
  Synthetic
ggcguggccgaccuuagccuc

SEQ ID NO: 32982 - RNA, 22 nt, Artificial Sequence
  Synthetic
uggcguggccgaccuuagccuc

SEQ ID NO: 32983 - RNA, 23 nt, Artificial Sequence
  Synthetic
guggcguggccgaccuuagccuc

SEQ ID NO: 32984 - RNA, 24 nt, Artificial Sequence
  Synthetic
aguggcguggccgaccuuagccuc

SEQ ID NO: 32985 - RNA, 18 nt, Artificial Sequence
  Synthetic
ggugggacacaugccuuc

SEQ ID NO: 32986 - RNA, 19 nt, Artificial Sequence
  Synthetic
gggugggacacaugccuuc

SEQ ID NO: 32987 - RNA, 20 nt, Artificial Sequence
  Synthetic
ggggugggacacaugccuuc

SEQ ID NO: 32988 - RNA, 21 nt, Artificial Sequence
  Synthetic
cggggugggacacaugccuuc

SEQ ID NO: 32989 - RNA, 22 nt, Artificial Sequence
  Synthetic
gcggggugggacacaugccuuc

SEQ ID NO: 32990 - RNA, 23 nt, Artificial Sequence
  Synthetic
ggcggggugggacacaugccuuc

SEQ ID NO: 32991 - RNA, 24 nt, Artificial Sequence
  Synthetic
aggcggggugggacacaugccuuc

SEQ ID NO: 32992 - RNA, 18 nt, Artificial Sequence
  Synthetic
ccaggcacaaaaacacag

SEQ ID NO: 32993 - RNA, 19 nt, Artificial Sequence
  Synthetic
gccaggcacaaaaacacag

SEQ ID NO: 32994 - RNA, 20 nt, Artificial Sequence
  Synthetic
agccaggcacaaaaacacag

SEQ ID NO: 32995 - RNA, 21 nt, Artificial Sequence
  Synthetic
gagccaggcacaaaaacacag

SEQ ID NO: 32996 - RNA, 22 nt, Artificial Sequence
  Synthetic
agagccaggcacaaaaacacag

SEQ ID NO: 32997 - RNA, 23 nt, Artificial Sequence
  Synthetic
gagagccaggcacaaaaacacag

SEQ ID NO: 32998 - RNA, 24 nt, Artificial Sequence
  Synthetic
agagagccaggcacaaaaacacag

SEQ ID NO: 32999 - RNA, 18 nt, Artificial Sequence
  Synthetic
ucugacuaagggugggag

SEQ ID NO: 33000 - RNA, 19 nt, Artificial Sequence
  Synthetic
gucugacuaagggugggag

SEQ ID NO: 33001 - RNA, 20 nt, Artificial Sequence
  Synthetic
agucugacuaagggugggag

SEQ ID NO: 33002 - RNA, 21 nt, Artificial Sequence
  Synthetic
gagucugacuaagggugggag

SEQ ID NO: 33003 - RNA, 22 nt, Artificial Sequence
  Synthetic
agagucugacuaagggugggag

SEQ ID NO: 33004 - RNA, 23 nt, Artificial Sequence
  Synthetic
cagagucugacuaagggugggag

SEQ ID NO: 33005 - RNA, 24 nt, Artificial Sequence
  Synthetic
acagagucugacuaagggugggag

SEQ ID NO: 33006 - RNA, 18 nt, Artificial Sequence
  Synthetic
cuuuaggaacaacuuuag

SEQ ID NO: 33007 - RNA, 19 nt, Artificial Sequence
  Synthetic
gcuuuaggaacaacuuuag

SEQ ID NO: 33008 - RNA, 20 nt, Artificial Sequence
  Synthetic
cgcuuuaggaacaacuuuag

SEQ ID NO: 33009 - RNA, 21 nt, Artificial Sequence
  Synthetic
ucgcuuuaggaacaacuuuag

SEQ ID NO: 33010 - RNA, 22 nt, Artificial Sequence
  Synthetic
cucgcuuuaggaacaacuuuag

SEQ ID NO: 33011 - RNA, 23 nt, Artificial Sequence
  Synthetic
ccucgcuuuaggaacaacuuuag

SEQ ID NO: 33012 - RNA, 24 nt, Artificial Sequence
  Synthetic
uccucgcuuuaggaacaacuuuag

SEQ ID NO: 33013 - RNA, 18 nt, Artificial Sequence
  Synthetic
guacgugggucauuggcg

SEQ ID NO: 33014 - RNA, 19 nt, Artificial Sequence
  Synthetic
aguacgugggucauuggcg

SEQ ID NO: 33015 - RNA, 20 nt, Artificial Sequence
  Synthetic
gaguacgugggucauuggcg

SEQ ID NO: 33016 - RNA, 21 nt, Artificial Sequence
  Synthetic
ggaguacgugggucauuggcg

SEQ ID NO: 33017 - RNA, 22 nt, Artificial Sequence
  Synthetic
uggaguacgugggucauuggcg

SEQ ID NO: 33018 - RNA, 23 nt, Artificial Sequence
  Synthetic
uuggaguacgugggucauuggcg

SEQ ID NO: 33019 - RNA, 24 nt, Artificial Sequence
  Synthetic
cuuggaguacgugggucauuggcg

SEQ ID NO: 33020 - RNA, 18 nt, Artificial Sequence
  Synthetic
aacagagucugacuaagg

SEQ ID NO: 33021 - RNA, 19 nt, Artificial Sequence
  Synthetic
uaacagagucugacuaagg

SEQ ID NO: 33022 - RNA, 20 nt, Artificial Sequence
  Synthetic
guaacagagucugacuaagg

SEQ ID NO: 33023 - RNA, 21 nt, Artificial Sequence
  Synthetic
aguaacagagucugacuaagg

SEQ ID NO: 33024 - RNA, 22 nt, Artificial Sequence
  Synthetic
aaguaacagagucugacuaagg

SEQ ID NO: 33025 - RNA, 23 nt, Artificial Sequence
  Synthetic
uaaguaacagagucugacuaagg

SEQ ID NO: 33026 - RNA, 24 nt, Artificial Sequence
  Synthetic
guaaguaacagagucugacuaagg

SEQ ID NO: 33027 - RNA, 18 nt, Artificial Sequence
  Synthetic
cugacuaagggugggagg

SEQ ID NO: 33028 - RNA, 19 nt, Artificial Sequence
  Synthetic
ucugacuaagggugggagg

SEQ ID NO: 33029 - RNA, 20 nt, Artificial Sequence
  Synthetic
gucugacuaagggugggagg

SEQ ID NO: 33030 - RNA, 21 nt, Artificial Sequence
  Synthetic
agucugacuaagggugggagg

SEQ ID NO: 33031 - RNA, 22 nt, Artificial Sequence
  Synthetic
gagucugacuaagggugggagg

SEQ ID NO: 33032 - RNA, 23 nt, Artificial Sequence
  Synthetic
agagucugacuaagggugggagg

SEQ ID NO: 33033 - RNA, 24 nt, Artificial Sequence
  Synthetic
cagagucugacuaagggugggagg

SEQ ID NO: 33034 - RNA, 18 nt, Artificial Sequence
  Synthetic
acagagucugacuaaggg

SEQ ID NO: 33035 - RNA, 19 nt, Artificial Sequence
  Synthetic
aacagagucugacuaaggg

SEQ ID NO: 33036 - RNA, 20 nt, Artificial Sequence
  Synthetic
uaacagagucugacuaaggg

SEQ ID NO: 33037 - RNA, 21 nt, Artificial Sequence
  Synthetic
guaacagagucugacuaaggg

SEQ ID NO: 33038 - RNA, 22 nt, Artificial Sequence
  Synthetic
aguaacagagucugacuaaggg

SEQ ID NO: 33039 - RNA, 23 nt, Artificial Sequence
  Synthetic
aaguaacagagucugacuaaggg

SEQ ID NO: 33040 - RNA, 24 nt, Artificial Sequence
  Synthetic
uaaguaacagagucugacuaaggg

SEQ ID NO: 33041 - RNA, 18 nt, Artificial Sequence
  Synthetic
ugacuaagggugggaggg

SEQ ID NO: 33042 - RNA, 19 nt, Artificial Sequence
  Synthetic
cugacuaagggugggaggg

SEQ ID NO: 33043 - RNA, 20 nt, Artificial Sequence
  Synthetic
ucugacuaagggugggaggg

SEQ ID NO: 33044 - RNA, 21 nt, Artificial Sequence
  Synthetic
gucugacuaagggugggaggg

SEQ ID NO: 33045 - RNA, 22 nt, Artificial Sequence
  Synthetic
agucugacuaagggugggaggg

SEQ ID NO: 33046 - RNA, 23 nt, Artificial Sequence
  Synthetic
gagucugacuaagggugggaggg

SEQ ID NO: 33047 - RNA, 24 nt, Artificial Sequence
  Synthetic
agagucugacuaagggugggaggg

SEQ ID NO: 33048 - RNA, 18 nt, Artificial Sequence
  Synthetic
cacaaaaacacaggcggg

SEQ ID NO: 33049 - RNA, 19 nt, Artificial Sequence
  Synthetic
gcacaaaaacacaggcggg

SEQ ID NO: 33050 - RNA, 20 nt, Artificial Sequence
  Synthetic
ggcacaaaaacacaggcggg

SEQ ID NO: 33051 - RNA, 21 nt, Artificial Sequence
  Synthetic
aggcacaaaaacacaggcggg

SEQ ID NO: 33052 - RNA, 22 nt, Artificial Sequence
  Synthetic
caggcacaaaaacacaggcggg

SEQ ID NO: 33053 - RNA, 23 nt, Artificial Sequence
  Synthetic
ccaggcacaaaaacacaggcggg

SEQ ID NO: 33054 - RNA, 24 nt, Artificial Sequence
  Synthetic
gccaggcacaaaaacacaggcggg

SEQ ID NO: 33055 - RNA, 18 nt, Artificial Sequence
  Synthetic
gacuaagggugggagggg

SEQ ID NO: 33056 - RNA, 19 nt, Artificial Sequence
  Synthetic
ugacuaagggugggagggg

SEQ ID NO: 33057 - RNA, 20 nt, Artificial Sequence
  Synthetic
cugacuaagggugggagggg

SEQ ID NO: 33058 - RNA, 21 nt, Artificial Sequence
  Synthetic
ucugacuaagggugggagggg

SEQ ID NO: 33059 - RNA, 22 nt, Artificial Sequence
  Synthetic
gucugacuaagggugggagggg

SEQ ID NO: 33060 - RNA, 23 nt, Artificial Sequence
  Synthetic
agucugacuaagggugggagggg

SEQ ID NO: 33061 - RNA, 24 nt, Artificial Sequence
  Synthetic
gagucugacuaagggugggagggg

SEQ ID NO: 33062 - RNA, 18 nt, Artificial Sequence
  Synthetic
acaaaaacacaggcgggg

SEQ ID NO: 33063 - RNA, 19 nt, Artificial Sequence
  Synthetic
cacaaaaacacaggcgggg

SEQ ID NO: 33064 - RNA, 20 nt, Artificial Sequence
  Synthetic
gcacaaaaacacaggcgggg

SEQ ID NO: 33065 - RNA, 21 nt, Artificial Sequence
  Synthetic
ggcacaaaaacacaggcgggg

SEQ ID NO: 33066 - RNA, 22 nt, Artificial Sequence
  Synthetic
aggcacaaaaacacaggcgggg

SEQ ID NO: 33067 - RNA, 23 nt, Artificial Sequence
  Synthetic
caggcacaaaaacacaggcgggg

SEQ ID NO: 33068 - RNA, 24 nt, Artificial Sequence
  Synthetic
ccaggcacaaaaacacaggcgggg

SEQ ID NO: 33069 - RNA, 18 nt, Artificial Sequence
  Synthetic
agucugacuaaggguggg

SEQ ID NO: 33070 - RNA, 19 nt, Artificial Sequence
  Synthetic
gagucugacuaaggguggg

SEQ ID NO: 33071 - RNA, 20 nt, Artificial Sequence
  Synthetic
agagucugacuaaggguggg

SEQ ID NO: 33072 - RNA, 21 nt, Artificial Sequence
  Synthetic
cagagucugacuaaggguggg

SEQ ID NO: 33073 - RNA, 22 nt, Artificial Sequence
  Synthetic
acagagucugacuaaggguggg

SEQ ID NO: 33074 - RNA, 23 nt, Artificial Sequence
  Synthetic
aacagagucugacuaaggguggg

SEQ ID NO: 33075 - RNA, 24 nt, Artificial Sequence
  Synthetic
uaacagagucugacuaaggguggg

SEQ ID NO: 33076 - RNA, 18 nt, Artificial Sequence
  Synthetic
uccccccccucuauuggg

SEQ ID NO: 33077 - RNA, 19 nt, Artificial Sequence
  Synthetic
guccccccccucuauuggg

SEQ ID NO: 33078 - RNA, 20 nt, Artificial Sequence
  Synthetic
gguccccccccucuauuggg

SEQ ID NO: 33079 - RNA, 21 nt, Artificial Sequence
  Synthetic
ggguccccccccucuauuggg

SEQ ID NO: 33080 - RNA, 22 nt, Artificial Sequence
  Synthetic
uggguccccccccucuauuggg

SEQ ID NO: 33081 - RNA, 23 nt, Artificial Sequence
  Synthetic
uuggguccccccccucuauuggg

SEQ ID NO: 33082 - RNA, 24 nt, Artificial Sequence
  Synthetic
uuuggguccccccccucuauuggg

SEQ ID NO: 33083 - RNA, 18 nt, Artificial Sequence
  Synthetic
gagucugacuaagggugg

SEQ ID NO: 33084 - RNA, 19 nt, Artificial Sequence
  Synthetic
agagucugacuaagggugg

SEQ ID NO: 33085 - RNA, 20 nt, Artificial Sequence
  Synthetic
cagagucugacuaagggugg

SEQ ID NO: 33086 - RNA, 21 nt, Artificial Sequence
  Synthetic
acagagucugacuaagggugg

SEQ ID NO: 33087 - RNA, 22 nt, Artificial Sequence
  Synthetic
aacagagucugacuaagggugg

SEQ ID NO: 33088 - RNA, 23 nt, Artificial Sequence
  Synthetic
uaacagagucugacuaagggugg

SEQ ID NO: 33089 - RNA, 24 nt, Artificial Sequence
  Synthetic
guaacagagucugacuaagggugg

SEQ ID NO: 33090 - RNA, 18 nt, Artificial Sequence
  Synthetic
uaagggggcaguuggugg

SEQ ID NO: 33091 - RNA, 19 nt, Artificial Sequence
  Synthetic
auaagggggcaguuggugg

SEQ ID NO: 33092 - RNA, 20 nt, Artificial Sequence
  Synthetic
gauaagggggcaguuggugg

SEQ ID NO: 33093 - RNA, 21 nt, Artificial Sequence
  Synthetic
agauaagggggcaguuggugg

SEQ ID NO: 33094 - RNA, 22 nt, Artificial Sequence
  Synthetic
uagauaagggggcaguuggugg

SEQ ID NO: 33095 - RNA, 23 nt, Artificial Sequence
  Synthetic
uuagauaagggggcaguuggugg

SEQ ID NO: 33096 - RNA, 24 nt, Artificial Sequence
  Synthetic
cuuagauaagggggcaguuggugg

SEQ ID NO: 33097 - RNA, 18 nt, Artificial Sequence
  Synthetic
gguccccccccucuauug

SEQ ID NO: 33098 - RNA, 19 nt, Artificial Sequence
  Synthetic
ggguccccccccucuauug

SEQ ID NO: 33099 - RNA, 20 nt, Artificial Sequence
  Synthetic
uggguccccccccucuauug

SEQ ID NO: 33100 - RNA, 21 nt, Artificial Sequence
  Synthetic
uuggguccccccccucuauug

SEQ ID NO: 33101 - RNA, 22 nt, Artificial Sequence
  Synthetic
uuuggguccccccccucuauug

SEQ ID NO: 33102 - RNA, 23 nt, Artificial Sequence
  Synthetic
guuuggguccccccccucuauug

SEQ ID NO: 33103 - RNA, 24 nt, Artificial Sequence
  Synthetic
cguuuggguccccccccucuauug

SEQ ID NO: 33104 - RNA, 18 nt, Artificial Sequence
  Synthetic
uccagccggcccuuagau

SEQ ID NO: 33105 - RNA, 19 nt, Artificial Sequence
  Synthetic
uuccagccggcccuuagau

SEQ ID NO: 33106 - RNA, 20 nt, Artificial Sequence
  Synthetic
cuuccagccggcccuuagau

SEQ ID NO: 33107 - RNA, 21 nt, Artificial Sequence
  Synthetic
ucuuccagccggcccuuagau

SEQ ID NO: 33108 - RNA, 22 nt, Artificial Sequence
  Synthetic
gucuuccagccggcccuuagau

SEQ ID NO: 33109 - RNA, 23 nt, Artificial Sequence
  Synthetic
ggucuuccagccggcccuuagau

SEQ ID NO: 33110 - RNA, 24 nt, Artificial Sequence
  Synthetic
cggucuuccagccggcccuuagau

SEQ ID NO: 33111 - RNA, 18 nt, Artificial Sequence
  Synthetic
uggguccccccccucuau

SEQ ID NO: 33112 - RNA, 19 nt, Artificial Sequence
  Synthetic
uuggguccccccccucuau

SEQ ID NO: 33113 - RNA, 20 nt, Artificial Sequence
  Synthetic
uuuggguccccccccucuau

SEQ ID NO: 33114 - RNA, 21 nt, Artificial Sequence
  Synthetic
guuuggguccccccccucuau

SEQ ID NO: 33115 - RNA, 22 nt, Artificial Sequence
  Synthetic
cguuuggguccccccccucuau

SEQ ID NO: 33116 - RNA, 23 nt, Artificial Sequence
  Synthetic
ucguuuggguccccccccucuau

SEQ ID NO: 33117 - RNA, 24 nt, Artificial Sequence
  Synthetic
gucguuuggguccccccccucuau

SEQ ID NO: 33118 - RNA, 18 nt, Artificial Sequence
  Synthetic
cguggccgaccuuagccu

SEQ ID NO: 33119 - RNA, 19 nt, Artificial Sequence
  Synthetic
gcguggccgaccuuagccu

SEQ ID NO: 33120 - RNA, 20 nt, Artificial Sequence
  Synthetic
ggcguggccgaccuuagccu

SEQ ID NO: 33121 - RNA, 21 nt, Artificial Sequence
  Synthetic
uggcguggccgaccuuagccu

SEQ ID NO: 33122 - RNA, 22 nt, Artificial Sequence
  Synthetic
guggcguggccgaccuuagccu

SEQ ID NO: 33123 - RNA, 23 nt, Artificial Sequence
  Synthetic
aguggcguggccgaccuuagccu

SEQ ID NO: 33124 - RNA, 24 nt, Artificial Sequence
  Synthetic
gaguggcguggccgaccuuagccu

SEQ ID NO: 33125 - RNA, 18 nt, Artificial Sequence
  Synthetic
uacgugggucauuggcgu

SEQ ID NO: 33126 - RNA, 19 nt, Artificial Sequence
  Synthetic
guacgugggucauuggcgu

SEQ ID NO: 33127 - RNA, 20 nt, Artificial Sequence
  Synthetic
aguacgugggucauuggcgu

SEQ ID NO: 33128 - RNA, 21 nt, Artificial Sequence
  Synthetic
gaguacgugggucauuggcgu

SEQ ID NO: 33129 - RNA, 22 nt, Artificial Sequence
  Synthetic
ggaguacgugggucauuggcgu

SEQ ID NO: 33130 - RNA, 23 nt, Artificial Sequence
  Synthetic
uggaguacgugggucauuggcgu

SEQ ID NO: 33131 - RNA, 24 nt, Artificial Sequence
  Synthetic
uuggaguacgugggucauuggcgu

SEQ ID NO: 33132 - RNA, 18 nt, Artificial Sequence
  Synthetic
cagagucugacuaagggu

SEQ ID NO: 33133 - RNA, 19 nt, Artificial Sequence
  Synthetic
acagagucugacuaagggu

SEQ ID NO: 33134 - RNA, 20 nt, Artificial Sequence
  Synthetic
aacagagucugacuaagggu

SEQ ID NO: 33135 - RNA, 21 nt, Artificial Sequence
  Synthetic
uaacagagucugacuaagggu

SEQ ID NO: 33136 - RNA, 22 nt, Artificial Sequence
  Synthetic
guaacagagucugacuaagggu

SEQ ID NO: 33137 - RNA, 23 nt, Artificial Sequence
  Synthetic
aguaacagagucugacuaagggu

SEQ ID NO: 33138 - RNA, 24 nt, Artificial Sequence
  Synthetic
aaguaacagagucugacuaagggu

SEQ ID NO: 33139 - RNA, 18 nt, Artificial Sequence
  Synthetic
ggguccccccccucuauu

SEQ ID NO: 33140 - RNA, 19 nt, Artificial Sequence
  Synthetic
uggguccccccccucuauu

SEQ ID NO: 33141 - RNA, 20 nt, Artificial Sequence
  Synthetic
uuggguccccccccucuauu

SEQ ID NO: 33142 - RNA, 21 nt, Artificial Sequence
  Synthetic
uuuggguccccccccucuauu

SEQ ID NO: 33143 - RNA, 22 nt, Artificial Sequence
  Synthetic
guuuggguccccccccucuauu

SEQ ID NO: 33144 - RNA, 23 nt, Artificial Sequence
  Synthetic
cguuuggguccccccccucuauu

SEQ ID NO: 33145 - RNA, 24 nt, Artificial Sequence
  Synthetic
ucguuuggguccccccccucuauu

SEQ ID NO: 33146 - RNA, 18 nt, Artificial Sequence
  Synthetic
ucgcuuuaggaacaacuu

SEQ ID NO: 33147 - RNA, 19 nt, Artificial Sequence
  Synthetic
cucgcuuuaggaacaacuu

SEQ ID NO: 33148 - RNA, 20 nt, Artificial Sequence
  Synthetic
ccucgcuuuaggaacaacuu

SEQ ID NO: 33149 - RNA, 21 nt, Artificial Sequence
  Synthetic
uccucgcuuuaggaacaacuu

SEQ ID NO: 33150 - RNA, 22 nt, Artificial Sequence
  Synthetic
auccucgcuuuaggaacaacuu

SEQ ID NO: 33151 - RNA, 23 nt, Artificial Sequence
  Synthetic
uauccucgcuuuaggaacaacuu

SEQ ID NO: 33152 - RNA, 24 nt, Artificial Sequence
  Synthetic
guauccucgcuuuaggaacaacuu

SEQ ID NO: 33153 - RNA, 18 nt, Artificial Sequence
  Synthetic
uccuccguauccucgcuu

SEQ ID NO: 33154 - RNA, 19 nt, Artificial Sequence
  Synthetic
cuccuccguauccucgcuu

SEQ ID NO: 33155 - RNA, 20 nt, Artificial Sequence
  Synthetic
acuccuccguauccucgcuu

SEQ ID NO: 33156 - RNA, 21 nt, Artificial Sequence
  Synthetic
cacuccuccguauccucgcuu

SEQ ID NO: 33157 - RNA, 22 nt, Artificial Sequence
  Synthetic
ccacuccuccguauccucgcuu

SEQ ID NO: 33158 - RNA, 23 nt, Artificial Sequence
  Synthetic
gccacuccuccguauccucgcuu

SEQ ID NO: 33159 - RNA, 24 nt, Artificial Sequence
  Synthetic
cgccacuccuccguauccucgcuu

SEQ ID NO: 33160 - RNA, 18 nt, Artificial Sequence
  Synthetic
cgcuuuaggaacaacuuu

SEQ ID NO: 33161 - RNA, 19 nt, Artificial Sequence
  Synthetic
ucgcuuuaggaacaacuuu

SEQ ID NO: 33162 - RNA, 20 nt, Artificial Sequence
  Synthetic
cucgcuuuaggaacaacuuu

SEQ ID NO: 33163 - RNA, 21 nt, Artificial Sequence
  Synthetic
ccucgcuuuaggaacaacuuu

SEQ ID NO: 33164 - RNA, 22 nt, Artificial Sequence
  Synthetic
uccucgcuuuaggaacaacuuu

SEQ ID NO: 33165 - RNA, 23 nt, Artificial Sequence
  Synthetic
auccucgcuuuaggaacaacuuu

SEQ ID NO: 33166 - RNA, 24 nt, Artificial Sequence
  Synthetic
uauccucgcuuuaggaacaacuuu

SEQ ID NO: 33167 - RNA, 18 nt, Artificial Sequence
  Synthetic
ccuccguauccucgcuuu

SEQ ID NO: 33168 - RNA, 19 nt, Artificial Sequence
  Synthetic
uccuccguauccucgcuuu

SEQ ID NO: 33169 - RNA, 20 nt, Artificial Sequence
  Synthetic
cuccuccguauccucgcuuu

SEQ ID NO: 33170 - RNA, 21 nt, Artificial Sequence
  Synthetic
acuccuccguauccucgcuuu

SEQ ID NO: 33171 - RNA, 22 nt, Artificial Sequence
  Synthetic
cacuccuccguauccucgcuuu

SEQ ID NO: 33172 - RNA, 23 nt, Artificial Sequence
  Synthetic
ccacuccuccguauccucgcuuu

SEQ ID NO: 33173 - RNA, 24 nt, Artificial Sequence
  Synthetic
gccacuccuccguauccucgcuuu

SEQ ID NO: 33174 - RNA, 18 nt, Artificial Sequence
  Synthetic
ccuaaaguuguuccuaaa

SEQ ID NO: 33175 - RNA, 19 nt, Artificial Sequence
  Synthetic
cccuaaaguuguuccuaaa

SEQ ID NO: 33176 - RNA, 20 nt, Artificial Sequence
  Synthetic
ccccuaaaguuguuccuaaa

SEQ ID NO: 33177 - RNA, 21 nt, Artificial Sequence
  Synthetic
cccccuaaaguuguuccuaaa

SEQ ID NO: 33178 - RNA, 22 nt, Artificial Sequence
  Synthetic
ccccccuaaaguuguuccuaaa

SEQ ID NO: 33179 - RNA, 23 nt, Artificial Sequence
  Synthetic
cccccccuaaaguuguuccuaaa

SEQ ID NO: 33180 - RNA, 24 nt, Artificial Sequence
  Synthetic
acccccccuaaaguuguuccuaaa

SEQ ID NO: 33181 - RNA, 18 nt, Artificial Sequence
  Synthetic
acaccugcuucuccccaa

SEQ ID NO: 33182 - RNA, 19 nt, Artificial Sequence
  Synthetic
gacaccugcuucuccccaa

SEQ ID NO: 33183 - RNA, 20 nt, Artificial Sequence
  Synthetic
agacaccugcuucuccccaa

SEQ ID NO: 33184 - RNA, 21 nt, Artificial Sequence
  Synthetic
uagacaccugcuucuccccaa

SEQ ID NO: 33185 - RNA, 22 nt, Artificial Sequence
  Synthetic
uuagacaccugcuucuccccaa

SEQ ID NO: 33186 - RNA, 23 nt, Artificial Sequence
  Synthetic
guuagacaccugcuucuccccaa

SEQ ID NO: 33187 - RNA, 24 nt, Artificial Sequence
  Synthetic
gguuagacaccugcuucuccccaa

SEQ ID NO: 33188 - RNA, 18 nt, Artificial Sequence
  Synthetic
ggggggacccaaacgaca

SEQ ID NO: 33189 - RNA, 19 nt, Artificial Sequence
  Synthetic
gggggggacccaaacgaca

SEQ ID NO: 33190 - RNA, 20 nt, Artificial Sequence
  Synthetic
ggggggggacccaaacgaca

SEQ ID NO: 33191 - RNA, 21 nt, Artificial Sequence
  Synthetic
aggggggggacccaaacgaca

SEQ ID NO: 33192 - RNA, 22 nt, Artificial Sequence
  Synthetic
gaggggggggacccaaacgaca

SEQ ID NO: 33193 - RNA, 23 nt, Artificial Sequence
  Synthetic
agaggggggggacccaaacgaca

SEQ ID NO: 33194 - RNA, 24 nt, Artificial Sequence
  Synthetic
uagaggggggggacccaaacgaca

SEQ ID NO: 33195 - RNA, 18 nt, Artificial Sequence
  Synthetic
cugcuucuccccaauaga

SEQ ID NO: 33196 - RNA, 19 nt, Artificial Sequence
  Synthetic
ccugcuucuccccaauaga

SEQ ID NO: 33197 - RNA, 20 nt, Artificial Sequence
  Synthetic
accugcuucuccccaauaga

SEQ ID NO: 33198 - RNA, 21 nt, Artificial Sequence
  Synthetic
caccugcuucuccccaauaga

SEQ ID NO: 33199 - RNA, 22 nt, Artificial Sequence
  Synthetic
acaccugcuucuccccaauaga

SEQ ID NO: 33200 - RNA, 23 nt, Artificial Sequence
  Synthetic
gacaccugcuucuccccaauaga

SEQ ID NO: 33201 - RNA, 24 nt, Artificial Sequence
  Synthetic
agacaccugcuucuccccaauaga

SEQ ID NO: 33202 - RNA, 18 nt, Artificial Sequence
  Synthetic
ggggggggacccaaacga

SEQ ID NO: 33203 - RNA, 19 nt, Artificial Sequence
  Synthetic
aggggggggacccaaacga

SEQ ID NO: 33204 - RNA, 20 nt, Artificial Sequence
  Synthetic
gaggggggggacccaaacga

SEQ ID NO: 33205 - RNA, 21 nt, Artificial Sequence
  Synthetic
agaggggggggacccaaacga

SEQ ID NO: 33206 - RNA, 22 nt, Artificial Sequence
  Synthetic
uagaggggggggacccaaacga

SEQ ID NO: 33207 - RNA, 23 nt, Artificial Sequence
  Synthetic
auagaggggggggacccaaacga

SEQ ID NO: 33208 - RNA, 24 nt, Artificial Sequence
  Synthetic
aauagaggggggggacccaaacga

SEQ ID NO: 33209 - RNA, 18 nt, Artificial Sequence
  Synthetic
guggcgggugccggggga

SEQ ID NO: 33210 - RNA, 19 nt, Artificial Sequence
  Synthetic
aguggcgggugccggggga

SEQ ID NO: 33211 - RNA, 20 nt, Artificial Sequence
  Synthetic
gaguggcgggugccggggga

SEQ ID NO: 33212 - RNA, 21 nt, Artificial Sequence
  Synthetic
ggaguggcgggugccggggga

SEQ ID NO: 33213 - RNA, 22 nt, Artificial Sequence
  Synthetic
aggaguggcgggugccggggga

SEQ ID NO: 33214 - RNA, 23 nt, Artificial Sequence
  Synthetic
gaggaguggcgggugccggggga

SEQ ID NO: 33215 - RNA, 24 nt, Artificial Sequence
  Synthetic
ggaggaguggcgggugccggggga

SEQ ID NO: 33216 - RNA, 18 nt, Artificial Sequence
  Synthetic
gggggggagugcggggga

SEQ ID NO: 33217 - RNA, 19 nt, Artificial Sequence
  Synthetic
ggggggggagugcggggga

SEQ ID NO: 33218 - RNA, 20 nt, Artificial Sequence
  Synthetic
gggggggggagugcggggga

SEQ ID NO: 33219 - RNA, 21 nt, Artificial Sequence
  Synthetic
ggggggggggagugcggggga

SEQ ID NO: 33220 - RNA, 22 nt, Artificial Sequence
  Synthetic
uggggggggggagugcggggga

SEQ ID NO: 33221 - RNA, 23 nt, Artificial Sequence
  Synthetic
cuggggggggggagugcggggga

SEQ ID NO: 33222 - RNA, 24 nt, Artificial Sequence
  Synthetic
ccuggggggggggagugcggggga

SEQ ID NO: 33223 - RNA, 18 nt, Artificial Sequence
  Synthetic
gugggaagggucggggga

SEQ ID NO: 33224 - RNA, 19 nt, Artificial Sequence
  Synthetic
ggugggaagggucggggga

SEQ ID NO: 33225 - RNA, 20 nt, Artificial Sequence
  Synthetic
gggugggaagggucggggga

SEQ ID NO: 33226 - RNA, 21 nt, Artificial Sequence
  Synthetic
ggggugggaagggucggggga

SEQ ID NO: 33227 - RNA, 22 nt, Artificial Sequence
  Synthetic
gggggugggaagggucggggga

SEQ ID NO: 33228 - RNA, 23 nt, Artificial Sequence
  Synthetic
cgggggugggaagggucggggga

SEQ ID NO: 33229 - RNA, 24 nt, Artificial Sequence
  Synthetic
gcgggggugggaagggucggggga

SEQ ID NO: 33230 - RNA, 18 nt, Artificial Sequence
  Synthetic
ggggagggggggugugga

SEQ ID NO: 33231 - RNA, 19 nt, Artificial Sequence
  Synthetic
gggggagggggggugugga

SEQ ID NO: 33232 - RNA, 20 nt, Artificial Sequence
  Synthetic
cgggggagggggggugugga

SEQ ID NO: 33233 - RNA, 21 nt, Artificial Sequence
  Synthetic
gcgggggagggggggugugga

SEQ ID NO: 33234 - RNA, 22 nt, Artificial Sequence
  Synthetic
ugcgggggagggggggugugga

SEQ ID NO: 33235 - RNA, 23 nt, Artificial Sequence
  Synthetic
gugcgggggagggggggugugga

SEQ ID NO: 33236 - RNA, 24 nt, Artificial Sequence
  Synthetic
agugcgggggagggggggugugga

SEQ ID NO: 33237 - RNA, 18 nt, Artificial Sequence
  Synthetic
accugcuucuccccaaua

SEQ ID NO: 33238 - RNA, 19 nt, Artificial Sequence
  Synthetic
caccugcuucuccccaaua

SEQ ID NO: 33239 - RNA, 20 nt, Artificial Sequence
  Synthetic
acaccugcuucuccccaaua

SEQ ID NO: 33240 - RNA, 21 nt, Artificial Sequence
  Synthetic
gacaccugcuucuccccaaua

SEQ ID NO: 33241 - RNA, 22 nt, Artificial Sequence
  Synthetic
agacaccugcuucuccccaaua

SEQ ID NO: 33242 - RNA, 23 nt, Artificial Sequence
  Synthetic
uagacaccugcuucuccccaaua

SEQ ID NO: 33243 - RNA, 24 nt, Artificial Sequence
  Synthetic
uuagacaccugcuucuccccaaua

SEQ ID NO: 33244 - RNA, 18 nt, Artificial Sequence
  Synthetic
guuccuaaagcgaggaua

SEQ ID NO: 33245 - RNA, 19 nt, Artificial Sequence
  Synthetic
uguuccuaaagcgaggaua

SEQ ID NO: 33246 - RNA, 20 nt, Artificial Sequence
  Synthetic
uuguuccuaaagcgaggaua

SEQ ID NO: 33247 - RNA, 21 nt, Artificial Sequence
  Synthetic
guuguuccuaaagcgaggaua

SEQ ID NO: 33248 - RNA, 22 nt, Artificial Sequence
  Synthetic
aguuguuccuaaagcgaggaua

SEQ ID NO: 33249 - RNA, 23 nt, Artificial Sequence
  Synthetic
aaguuguuccuaaagcgaggaua

SEQ ID NO: 33250 - RNA, 24 nt, Artificial Sequence
  Synthetic
aaaguuguuccuaaagcgaggaua

SEQ ID NO: 33251 - RNA, 18 nt, Artificial Sequence
  Synthetic
cggggugaucucuggcac

SEQ ID NO: 33252 - RNA, 19 nt, Artificial Sequence
  Synthetic
ccggggugaucucuggcac

SEQ ID NO: 33253 - RNA, 20 nt, Artificial Sequence
  Synthetic
accggggugaucucuggcac

SEQ ID NO: 33254 - RNA, 21 nt, Artificial Sequence
  Synthetic
gaccggggugaucucuggcac

SEQ ID NO: 33255 - RNA, 22 nt, Artificial Sequence
  Synthetic
ggaccggggugaucucuggcac

SEQ ID NO: 33256 - RNA, 23 nt, Artificial Sequence
  Synthetic
gggaccggggugaucucuggcac

SEQ ID NO: 33257 - RNA, 24 nt, Artificial Sequence
  Synthetic
ggggaccggggugaucucuggcac

SEQ ID NO: 33258 - RNA, 18 nt, Artificial Sequence
  Synthetic
gggggggacccaaacgac

SEQ ID NO: 33259 - RNA, 19 nt, Artificial Sequence
  Synthetic
ggggggggacccaaacgac

SEQ ID NO: 33260 - RNA, 20 nt, Artificial Sequence
  Synthetic
aggggggggacccaaacgac

SEQ ID NO: 33261 - RNA, 21 nt, Artificial Sequence
  Synthetic
gaggggggggacccaaacgac

SEQ ID NO: 33262 - RNA, 22 nt, Artificial Sequence
  Synthetic
agaggggggggacccaaacgac

SEQ ID NO: 33263 - RNA, 23 nt, Artificial Sequence
  Synthetic
uagaggggggggacccaaacgac

SEQ ID NO: 33264 - RNA, 24 nt, Artificial Sequence
  Synthetic
auagaggggggggacccaaacgac

SEQ ID NO: 33265 - RNA, 18 nt, Artificial Sequence
  Synthetic
aaacgacagggggcgccc

SEQ ID NO: 33266 - RNA, 19 nt, Artificial Sequence
  Synthetic
caaacgacagggggcgccc

SEQ ID NO: 33267 - RNA, 20 nt, Artificial Sequence
  Synthetic
ccaaacgacagggggcgccc

SEQ ID NO: 33268 - RNA, 21 nt, Artificial Sequence
  Synthetic
cccaaacgacagggggcgccc

SEQ ID NO: 33269 - RNA, 22 nt, Artificial Sequence
  Synthetic
acccaaacgacagggggcgccc

SEQ ID NO: 33270 - RNA, 23 nt, Artificial Sequence
  Synthetic
gacccaaacgacagggggcgccc

SEQ ID NO: 33271 - RNA, 24 nt, Artificial Sequence
  Synthetic
ggacccaaacgacagggggcgccc

SEQ ID NO: 33272 - RNA, 18 nt, Artificial Sequence
  Synthetic
gccggcuggaagaccgcc

SEQ ID NO: 33273 - RNA, 19 nt, Artificial Sequence
  Synthetic
ggccggcuggaagaccgcc

SEQ ID NO: 33274 - RNA, 20 nt, Artificial Sequence
  Synthetic
gggccggcuggaagaccgcc

SEQ ID NO: 33275 - RNA, 21 nt, Artificial Sequence
  Synthetic
agggccggcuggaagaccgcc

SEQ ID NO: 33276 - RNA, 22 nt, Artificial Sequence
  Synthetic
aagggccggcuggaagaccgcc

SEQ ID NO: 33277 - RNA, 23 nt, Artificial Sequence
  Synthetic
uaagggccggcuggaagaccgcc

SEQ ID NO: 33278 - RNA, 24 nt, Artificial Sequence
  Synthetic
cuaagggccggcuggaagaccgcc

SEQ ID NO: 33279 - RNA, 18 nt, Artificial Sequence
  Synthetic
ugcuugggucuuacugcc

SEQ ID NO: 33280 - RNA, 19 nt, Artificial Sequence
  Synthetic
augcuugggucuuacugcc

SEQ ID NO: 33281 - RNA, 20 nt, Artificial Sequence
  Synthetic
uaugcuugggucuuacugcc

SEQ ID NO: 33282 - RNA, 21 nt, Artificial Sequence
  Synthetic
cuaugcuugggucuuacugcc

SEQ ID NO: 33283 - RNA, 22 nt, Artificial Sequence
  Synthetic
ucuaugcuugggucuuacugcc

SEQ ID NO: 33284 - RNA, 23 nt, Artificial Sequence
  Synthetic
cucuaugcuugggucuuacugcc

SEQ ID NO: 33285 - RNA, 24 nt, Artificial Sequence
  Synthetic
ucucuaugcuugggucuuacugcc

SEQ ID NO: 33286 - RNA, 18 nt, Artificial Sequence
  Synthetic
ggaggaguggcgggugcc

SEQ ID NO: 33287 - RNA, 19 nt, Artificial Sequence
  Synthetic
cggaggaguggcgggugcc

SEQ ID NO: 33288 - RNA, 20 nt, Artificial Sequence
  Synthetic
acggaggaguggcgggugcc

SEQ ID NO: 33289 - RNA, 21 nt, Artificial Sequence
  Synthetic
uacggaggaguggcgggugcc

SEQ ID NO: 33290 - RNA, 22 nt, Artificial Sequence
  Synthetic
auacggaggaguggcgggugcc

SEQ ID NO: 33291 - RNA, 23 nt, Artificial Sequence
  Synthetic
gauacggaggaguggcgggugcc

SEQ ID NO: 33292 - RNA, 24 nt, Artificial Sequence
  Synthetic
ggauacggaggaguggcgggugcc

SEQ ID NO: 33293 - RNA, 18 nt, Artificial Sequence
  Synthetic
caaugacccacguacucc

SEQ ID NO: 33294 - RNA, 19 nt, Artificial Sequence
  Synthetic
ccaaugacccacguacucc

SEQ ID NO: 33295 - RNA, 20 nt, Artificial Sequence
  Synthetic
gccaaugacccacguacucc

SEQ ID NO: 33296 - RNA, 21 nt, Artificial Sequence
  Synthetic
cgccaaugacccacguacucc

SEQ ID NO: 33297 - RNA, 22 nt, Artificial Sequence
  Synthetic
acgccaaugacccacguacucc

SEQ ID NO: 33298 - RNA, 23 nt, Artificial Sequence
  Synthetic
cacgccaaugacccacguacucc

SEQ ID NO: 33299 - RNA, 24 nt, Artificial Sequence
  Synthetic
ccacgccaaugacccacguacucc

SEQ ID NO: 33300 - RNA, 18 nt, Artificial Sequence
  Synthetic
ggccggcuggaagaccgc

SEQ ID NO: 33301 - RNA, 19 nt, Artificial Sequence
  Synthetic
gggccggcuggaagaccgc

SEQ ID NO: 33302 - RNA, 20 nt, Artificial Sequence
  Synthetic
agggccggcuggaagaccgc

SEQ ID NO: 33303 - RNA, 21 nt, Artificial Sequence
  Synthetic
aagggccggcuggaagaccgc

SEQ ID NO: 33304 - RNA, 22 nt, Artificial Sequence
  Synthetic
uaagggccggcuggaagaccgc

SEQ ID NO: 33305 - RNA, 23 nt, Artificial Sequence
  Synthetic
cuaagggccggcuggaagaccgc

SEQ ID NO: 33306 - RNA, 24 nt, Artificial Sequence
  Synthetic
ucuaagggccggcuggaagaccgc

SEQ ID NO: 33307 - RNA, 18 nt, Artificial Sequence
  Synthetic
ccuuaucuaagggccggc

SEQ ID NO: 33308 - RNA, 19 nt, Artificial Sequence
  Synthetic
cccuuaucuaagggccggc

SEQ ID NO: 33309 - RNA, 20 nt, Artificial Sequence
  Synthetic
ccccuuaucuaagggccggc

SEQ ID NO: 33310 - RNA, 21 nt, Artificial Sequence
  Synthetic
cccccuuaucuaagggccggc

SEQ ID NO: 33311 - RNA, 22 nt, Artificial Sequence
  Synthetic
gcccccuuaucuaagggccggc

SEQ ID NO: 33312 - RNA, 23 nt, Artificial Sequence
  Synthetic
ugcccccuuaucuaagggccggc

SEQ ID NO: 33313 - RNA, 24 nt, Artificial Sequence
  Synthetic
cugcccccuuaucuaagggccggc

SEQ ID NO: 33314 - RNA, 18 nt, Artificial Sequence
  Synthetic
augcuugggucuuacugc

SEQ ID NO: 33315 - RNA, 19 nt, Artificial Sequence
  Synthetic
uaugcuugggucuuacugc

SEQ ID NO: 33316 - RNA, 20 nt, Artificial Sequence
  Synthetic
cuaugcuugggucuuacugc

SEQ ID NO: 33317 - RNA, 21 nt, Artificial Sequence
  Synthetic
ucuaugcuugggucuuacugc

SEQ ID NO: 33318 - RNA, 22 nt, Artificial Sequence
  Synthetic
cucuaugcuugggucuuacugc

SEQ ID NO: 33319 - RNA, 23 nt, Artificial Sequence
  Synthetic
ucucuaugcuugggucuuacugc

SEQ ID NO: 33320 - RNA, 24 nt, Artificial Sequence
  Synthetic
cucucuaugcuugggucuuacugc

SEQ ID NO: 33321 - RNA, 18 nt, Artificial Sequence
  Synthetic
ccuggggggggggagugc

SEQ ID NO: 33322 - RNA, 19 nt, Artificial Sequence
  Synthetic
gccuggggggggggagugc

SEQ ID NO: 33323 - RNA, 20 nt, Artificial Sequence
  Synthetic
ugccuggggggggggagugc

SEQ ID NO: 33324 - RNA, 21 nt, Artificial Sequence
  Synthetic
cugccuggggggggggagugc

SEQ ID NO: 33325 - RNA, 22 nt, Artificial Sequence
  Synthetic
acugccuggggggggggagugc

SEQ ID NO: 33326 - RNA, 23 nt, Artificial Sequence
  Synthetic
uacugccuggggggggggagugc

SEQ ID NO: 33327 - RNA, 24 nt, Artificial Sequence
  Synthetic
uuacugccuggggggggggagugc

SEQ ID NO: 33328 - RNA, 18 nt, Artificial Sequence
  Synthetic
cggaggaguggcgggugc

SEQ ID NO: 33329 - RNA, 19 nt, Artificial Sequence
  Synthetic
acggaggaguggcgggugc

SEQ ID NO: 33330 - RNA, 20 nt, Artificial Sequence
  Synthetic
uacggaggaguggcgggugc

SEQ ID NO: 33331 - RNA, 21 nt, Artificial Sequence
  Synthetic
auacggaggaguggcgggugc

SEQ ID NO: 33332 - RNA, 22 nt, Artificial Sequence
  Synthetic
gauacggaggaguggcgggugc

SEQ ID NO: 33333 - RNA, 23 nt, Artificial Sequence
  Synthetic
ggauacggaggaguggcgggugc

SEQ ID NO: 33334 - RNA, 24 nt, Artificial Sequence
  Synthetic
aggauacggaggaguggcgggugc

SEQ ID NO: 33335 - RNA, 18 nt, Artificial Sequence
  Synthetic
gcgggggugggaaggguc

SEQ ID NO: 33336 - RNA, 19 nt, Artificial Sequence
  Synthetic
cgcgggggugggaaggguc

SEQ ID NO: 33337 - RNA, 20 nt, Artificial Sequence
  Synthetic
acgcgggggugggaaggguc

SEQ ID NO: 33338 - RNA, 21 nt, Artificial Sequence
  Synthetic
cacgcgggggugggaaggguc

SEQ ID NO: 33339 - RNA, 22 nt, Artificial Sequence
  Synthetic
gcacgcgggggugggaaggguc

SEQ ID NO: 33340 - RNA, 23 nt, Artificial Sequence
  Synthetic
ggcacgcgggggugggaaggguc

SEQ ID NO: 33341 - RNA, 24 nt, Artificial Sequence
  Synthetic
uggcacgcgggggugggaaggguc

SEQ ID NO: 33342 - RNA, 18 nt, Artificial Sequence
  Synthetic
ugcuucuccccaauagag

SEQ ID NO: 33343 - RNA, 19 nt, Artificial Sequence
  Synthetic
cugcuucuccccaauagag

SEQ ID NO: 33344 - RNA, 20 nt, Artificial Sequence
  Synthetic
ccugcuucuccccaauagag

SEQ ID NO: 33345 - RNA, 21 nt, Artificial Sequence
  Synthetic
accugcuucuccccaauagag

SEQ ID NO: 33346 - RNA, 22 nt, Artificial Sequence
  Synthetic
caccugcuucuccccaauagag

SEQ ID NO: 33347 - RNA, 23 nt, Artificial Sequence
  Synthetic
acaccugcuucuccccaauagag

SEQ ID NO: 33348 - RNA, 24 nt, Artificial Sequence
  Synthetic
gacaccugcuucuccccaauagag

SEQ ID NO: 33349 - RNA, 18 nt, Artificial Sequence
  Synthetic
ggggggagugcgggggag

SEQ ID NO: 33350 - RNA, 19 nt, Artificial Sequence
  Synthetic
gggggggagugcgggggag

SEQ ID NO: 33351 - RNA, 20 nt, Artificial Sequence
  Synthetic
ggggggggagugcgggggag

SEQ ID NO: 33352 - RNA, 21 nt, Artificial Sequence
  Synthetic
gggggggggagugcgggggag

SEQ ID NO: 33353 - RNA, 22 nt, Artificial Sequence
  Synthetic
ggggggggggagugcgggggag

SEQ ID NO: 33354 - RNA, 23 nt, Artificial Sequence
  Synthetic
uggggggggggagugcgggggag

SEQ ID NO: 33355 - RNA, 24 nt, Artificial Sequence
  Synthetic
cuggggggggggagugcgggggag

SEQ ID NO: 33356 - RNA, 18 nt, Artificial Sequence
  Synthetic
ugggaagggucgggggag

SEQ ID NO: 33357 - RNA, 19 nt, Artificial Sequence
  Synthetic
gugggaagggucgggggag

SEQ ID NO: 33358 - RNA, 20 nt, Artificial Sequence
  Synthetic
ggugggaagggucgggggag

SEQ ID NO: 33359 - RNA, 21 nt, Artificial Sequence
  Synthetic
gggugggaagggucgggggag

SEQ ID NO: 33360 - RNA, 22 nt, Artificial Sequence
  Synthetic
ggggugggaagggucgggggag

SEQ ID NO: 33361 - RNA, 23 nt, Artificial Sequence
  Synthetic
gggggugggaagggucgggggag

SEQ ID NO: 33362 - RNA, 24 nt, Artificial Sequence
  Synthetic
cgggggugggaagggucgggggag

SEQ ID NO: 33363 - RNA, 18 nt, Artificial Sequence
  Synthetic
ccugcuucuccccaauag

SEQ ID NO: 33364 - RNA, 19 nt, Artificial Sequence
  Synthetic
accugcuucuccccaauag

SEQ ID NO: 33365 - RNA, 20 nt, Artificial Sequence
  Synthetic
caccugcuucuccccaauag

SEQ ID NO: 33366 - RNA, 21 nt, Artificial Sequence
  Synthetic
acaccugcuucuccccaauag

SEQ ID NO: 33367 - RNA, 22 nt, Artificial Sequence
  Synthetic
gacaccugcuucuccccaauag

SEQ ID NO: 33368 - RNA, 23 nt, Artificial Sequence
  Synthetic
agacaccugcuucuccccaauag

SEQ ID NO: 33369 - RNA, 24 nt, Artificial Sequence
  Synthetic
uagacaccugcuucuccccaauag

SEQ ID NO: 33370 - RNA, 18 nt, Artificial Sequence
  Synthetic
ggggugaucucuggcacg

SEQ ID NO: 33371 - RNA, 19 nt, Artificial Sequence
  Synthetic
cggggugaucucuggcacg

SEQ ID NO: 33372 - RNA, 20 nt, Artificial Sequence
  Synthetic
ccggggugaucucuggcacg

SEQ ID NO: 33373 - RNA, 21 nt, Artificial Sequence
  Synthetic
accggggugaucucuggcacg

SEQ ID NO: 33374 - RNA, 22 nt, Artificial Sequence
  Synthetic
gaccggggugaucucuggcacg

SEQ ID NO: 33375 - RNA, 23 nt, Artificial Sequence
  Synthetic
ggaccggggugaucucuggcacg

SEQ ID NO: 33376 - RNA, 24 nt, Artificial Sequence
  Synthetic
gggaccggggugaucucuggcacg

SEQ ID NO: 33377 - RNA, 18 nt, Artificial Sequence
  Synthetic
uccuaaagcgaggauacg

SEQ ID NO: 33378 - RNA, 19 nt, Artificial Sequence
  Synthetic
uuccuaaagcgaggauacg

SEQ ID NO: 33379 - RNA, 20 nt, Artificial Sequence
  Synthetic
guuccuaaagcgaggauacg

SEQ ID NO: 33380 - RNA, 21 nt, Artificial Sequence
  Synthetic
uguuccuaaagcgaggauacg

SEQ ID NO: 33381 - RNA, 22 nt, Artificial Sequence
  Synthetic
uuguuccuaaagcgaggauacg

SEQ ID NO: 33382 - RNA, 23 nt, Artificial Sequence
  Synthetic
guuguuccuaaagcgaggauacg

SEQ ID NO: 33383 - RNA, 24 nt, Artificial Sequence
  Synthetic
aguuguuccuaaagcgaggauacg

SEQ ID NO: 33384 - RNA, 18 nt, Artificial Sequence
  Synthetic
gaggaguggcgggugccg

SEQ ID NO: 33385 - RNA, 19 nt, Artificial Sequence
  Synthetic
ggaggaguggcgggugccg

SEQ ID NO: 33386 - RNA, 20 nt, Artificial Sequence
  Synthetic
cggaggaguggcgggugccg

SEQ ID NO: 33387 - RNA, 21 nt, Artificial Sequence
  Synthetic
acggaggaguggcgggugccg

SEQ ID NO: 33388 - RNA, 22 nt, Artificial Sequence
  Synthetic
uacggaggaguggcgggugccg

SEQ ID NO: 33389 - RNA, 23 nt, Artificial Sequence
  Synthetic
auacggaggaguggcgggugccg

SEQ ID NO: 33390 - RNA, 24 nt, Artificial Sequence
  Synthetic
gauacggaggaguggcgggugccg

SEQ ID NO: 33391 - RNA, 18 nt, Artificial Sequence
  Synthetic
cuggggggggggagugcg

SEQ ID NO: 33392 - RNA, 19 nt, Artificial Sequence
  Synthetic
ccuggggggggggagugcg

SEQ ID NO: 33393 - RNA, 20 nt, Artificial Sequence
  Synthetic
gccuggggggggggagugcg

SEQ ID NO: 33394 - RNA, 21 nt, Artificial Sequence
  Synthetic
ugccuggggggggggagugcg

SEQ ID NO: 33395 - RNA, 22 nt, Artificial Sequence
  Synthetic
cugccuggggggggggagugcg

SEQ ID NO: 33396 - RNA, 23 nt, Artificial Sequence
  Synthetic
acugccuggggggggggagugcg

SEQ ID NO: 33397 - RNA, 24 nt, Artificial Sequence
  Synthetic
uacugccuggggggggggagugcg

SEQ ID NO: 33398 - RNA, 18 nt, Artificial Sequence
  Synthetic
cgggggugggaagggucg

SEQ ID NO: 33399 - RNA, 19 nt, Artificial Sequence
  Synthetic
gcgggggugggaagggucg

SEQ ID NO: 33400 - RNA, 20 nt, Artificial Sequence
  Synthetic
cgcgggggugggaagggucg

SEQ ID NO: 33401 - RNA, 21 nt, Artificial Sequence
  Synthetic
acgcgggggugggaagggucg

SEQ ID NO: 33402 - RNA, 22 nt, Artificial Sequence
  Synthetic
cacgcgggggugggaagggucg

SEQ ID NO: 33403 - RNA, 23 nt, Artificial Sequence
  Synthetic
gcacgcgggggugggaagggucg

SEQ ID NO: 33404 - RNA, 24 nt, Artificial Sequence
  Synthetic
ggcacgcgggggugggaagggucg

SEQ ID NO: 33405 - RNA, 18 nt, Artificial Sequence
  Synthetic
gcuucuccccaauagagg

SEQ ID NO: 33406 - RNA, 19 nt, Artificial Sequence
  Synthetic
ugcuucuccccaauagagg

SEQ ID NO: 33407 - RNA, 20 nt, Artificial Sequence
  Synthetic
cugcuucuccccaauagagg

SEQ ID NO: 33408 - RNA, 21 nt, Artificial Sequence
  Synthetic
ccugcuucuccccaauagagg

SEQ ID NO: 33409 - RNA, 22 nt, Artificial Sequence
  Synthetic
accugcuucuccccaauagagg

SEQ ID NO: 33410 - RNA, 23 nt, Artificial Sequence
  Synthetic
caccugcuucuccccaauagagg

SEQ ID NO: 33411 - RNA, 24 nt, Artificial Sequence
  Synthetic
acaccugcuucuccccaauagagg

SEQ ID NO: 33412 - RNA, 18 nt, Artificial Sequence
  Synthetic
cccuuaucuaagggccgg

SEQ ID NO: 33413 - RNA, 19 nt, Artificial Sequence
  Synthetic
ccccuuaucuaagggccgg

SEQ ID NO: 33414 - RNA, 20 nt, Artificial Sequence
  Synthetic
cccccuuaucuaagggccgg

SEQ ID NO: 33415 - RNA, 21 nt, Artificial Sequence
  Synthetic
gcccccuuaucuaagggccgg

SEQ ID NO: 33416 - RNA, 22 nt, Artificial Sequence
  Synthetic
ugcccccuuaucuaagggccgg

SEQ ID NO: 33417 - RNA, 23 nt, Artificial Sequence
  Synthetic
cugcccccuuaucuaagggccgg

SEQ ID NO: 33418 - RNA, 24 nt, Artificial Sequence
  Synthetic
acugcccccuuaucuaagggccgg

SEQ ID NO: 33419 - RNA, 18 nt, Artificial Sequence
  Synthetic
cggccacgccacucgcgg

SEQ ID NO: 33420 - RNA, 19 nt, Artificial Sequence
  Synthetic
ucggccacgccacucgcgg

SEQ ID NO: 33421 - RNA, 20 nt, Artificial Sequence
  Synthetic
gucggccacgccacucgcgg

SEQ ID NO: 33422 - RNA, 21 nt, Artificial Sequence
  Synthetic
ggucggccacgccacucgcgg

SEQ ID NO: 33423 - RNA, 22 nt, Artificial Sequence
  Synthetic
aggucggccacgccacucgcgg

SEQ ID NO: 33424 - RNA, 23 nt, Artificial Sequence
  Synthetic
aaggucggccacgccacucgcgg

SEQ ID NO: 33425 - RNA, 24 nt, Artificial Sequence
  Synthetic
uaaggucggccacgccacucgcgg

SEQ ID NO: 33426 - RNA, 18 nt, Artificial Sequence
  Synthetic
uggggggggggagugcgg

SEQ ID NO: 33427 - RNA, 19 nt, Artificial Sequence
  Synthetic
cuggggggggggagugcgg

SEQ ID NO: 33428 - RNA, 20 nt, Artificial Sequence
  Synthetic
ccuggggggggggagugcgg

SEQ ID NO: 33429 - RNA, 21 nt, Artificial Sequence
  Synthetic
gccuggggggggggagugcgg

SEQ ID NO: 33430 - RNA, 22 nt, Artificial Sequence
  Synthetic
ugccuggggggggggagugcgg

SEQ ID NO: 33431 - RNA, 23 nt, Artificial Sequence
  Synthetic
cugccuggggggggggagugcgg

SEQ ID NO: 33432 - RNA, 24 nt, Artificial Sequence
  Synthetic
acugccuggggggggggagugcgg

SEQ ID NO: 33433 - RNA, 18 nt, Artificial Sequence
  Synthetic
gggggugggaagggucgg

SEQ ID NO: 33434 - RNA, 19 nt, Artificial Sequence
  Synthetic
cgggggugggaagggucgg

SEQ ID NO: 33435 - RNA, 20 nt, Artificial Sequence
  Synthetic
gcgggggugggaagggucgg

SEQ ID NO: 33436 - RNA, 21 nt, Artificial Sequence
  Synthetic
cgcgggggugggaagggucgg

SEQ ID NO: 33437 - RNA, 22 nt, Artificial Sequence
  Synthetic
acgcgggggugggaagggucgg

SEQ ID NO: 33438 - RNA, 23 nt, Artificial Sequence
  Synthetic
cacgcgggggugggaagggucgg

SEQ ID NO: 33439 - RNA, 24 nt, Artificial Sequence
  Synthetic
gcacgcgggggugggaagggucgg

SEQ ID NO: 33440 - RNA, 18 nt, Artificial Sequence
  Synthetic
acgcgggggugggaaggg

SEQ ID NO: 33441 - RNA, 19 nt, Artificial Sequence
  Synthetic
cacgcgggggugggaaggg

SEQ ID NO: 33442 - RNA, 20 nt, Artificial Sequence
  Synthetic
gcacgcgggggugggaaggg

SEQ ID NO: 33443 - RNA, 21 nt, Artificial Sequence
  Synthetic
ggcacgcgggggugggaaggg

SEQ ID NO: 33444 - RNA, 22 nt, Artificial Sequence
  Synthetic
uggcacgcgggggugggaaggg

SEQ ID NO: 33445 - RNA, 23 nt, Artificial Sequence
  Synthetic
cuggcacgcgggggugggaaggg

SEQ ID NO: 33446 - RNA, 24 nt, Artificial Sequence
  Synthetic
ucuggcacgcgggggugggaaggg

SEQ ID NO: 33447 - RNA, 18 nt, Artificial Sequence
  Synthetic
cuucuccccaauagaggg

SEQ ID NO: 33448 - RNA, 19 nt, Artificial Sequence
  Synthetic
gcuucuccccaauagaggg

SEQ ID NO: 33449 - RNA, 20 nt, Artificial Sequence
  Synthetic
ugcuucuccccaauagaggg

SEQ ID NO: 33450 - RNA, 21 nt, Artificial Sequence
  Synthetic
cugcuucuccccaauagaggg

SEQ ID NO: 33451 - RNA, 22 nt, Artificial Sequence
  Synthetic
ccugcuucuccccaauagaggg

SEQ ID NO: 33452 - RNA, 23 nt, Artificial Sequence
  Synthetic
accugcuucuccccaauagaggg

SEQ ID NO: 33453 - RNA, 24 nt, Artificial Sequence
  Synthetic
caccugcuucuccccaauagaggg

SEQ ID NO: 33454 - RNA, 18 nt, Artificial Sequence
  Synthetic
uucuccccaauagagggg

SEQ ID NO: 33455 - RNA, 19 nt, Artificial Sequence
  Synthetic
cuucuccccaauagagggg

SEQ ID NO: 33456 - RNA, 20 nt, Artificial Sequence
  Synthetic
gcuucuccccaauagagggg

SEQ ID NO: 33457 - RNA, 21 nt, Artificial Sequence
  Synthetic
ugcuucuccccaauagagggg

SEQ ID NO: 33458 - RNA, 22 nt, Artificial Sequence
  Synthetic
cugcuucuccccaauagagggg

SEQ ID NO: 33459 - RNA, 23 nt, Artificial Sequence
  Synthetic
ccugcuucuccccaauagagggg

SEQ ID NO: 33460 - RNA, 24 nt, Artificial Sequence
  Synthetic
accugcuucuccccaauagagggg

SEQ ID NO: 33461 - RNA, 18 nt, Artificial Sequence
  Synthetic
gaucucuggcacgcgggg

SEQ ID NO: 33462 - RNA, 19 nt, Artificial Sequence
  Synthetic
ugaucucuggcacgcgggg

SEQ ID NO: 33463 - RNA, 20 nt, Artificial Sequence
  Synthetic
gugaucucuggcacgcgggg

SEQ ID NO: 33464 - RNA, 21 nt, Artificial Sequence
  Synthetic
ggugaucucuggcacgcgggg

SEQ ID NO: 33465 - RNA, 22 nt, Artificial Sequence
  Synthetic
gggugaucucuggcacgcgggg

SEQ ID NO: 33466 - RNA, 23 nt, Artificial Sequence
  Synthetic
ggggugaucucuggcacgcgggg

SEQ ID NO: 33467 - RNA, 24 nt, Artificial Sequence
  Synthetic
cggggugaucucuggcacgcgggg

SEQ ID NO: 33468 - RNA, 18 nt, Artificial Sequence
  Synthetic
gggggggggagugcgggg

SEQ ID NO: 33469 - RNA, 19 nt, Artificial Sequence
  Synthetic
ggggggggggagugcgggg

SEQ ID NO: 33470 - RNA, 20 nt, Artificial Sequence
  Synthetic
uggggggggggagugcgggg

SEQ ID NO: 33471 - RNA, 21 nt, Artificial Sequence
  Synthetic
cuggggggggggagugcgggg

SEQ ID NO: 33472 - RNA, 22 nt, Artificial Sequence
  Synthetic
ccuggggggggggagugcgggg

SEQ ID NO: 33473 - RNA, 23 nt, Artificial Sequence
  Synthetic
gccuggggggggggagugcgggg

SEQ ID NO: 33474 - RNA, 24 nt, Artificial Sequence
  Synthetic
ugccuggggggggggagugcgggg

SEQ ID NO: 33475 - RNA, 18 nt, Artificial Sequence
  Synthetic
gggugggaagggucgggg

SEQ ID NO: 33476 - RNA, 19 nt, Artificial Sequence
  Synthetic
ggggugggaagggucgggg

SEQ ID NO: 33477 - RNA, 20 nt, Artificial Sequence
  Synthetic
gggggugggaagggucgggg

SEQ ID NO: 33478 - RNA, 21 nt, Artificial Sequence
  Synthetic
cgggggugggaagggucgggg

SEQ ID NO: 33479 - RNA, 22 nt, Artificial Sequence
  Synthetic
gcgggggugggaagggucgggg

SEQ ID NO: 33480 - RNA, 23 nt, Artificial Sequence
  Synthetic
cgcgggggugggaagggucgggg

SEQ ID NO: 33481 - RNA, 24 nt, Artificial Sequence
  Synthetic
acgcgggggugggaagggucgggg

SEQ ID NO: 33482 - RNA, 18 nt, Artificial Sequence
  Synthetic
aucucuggcacgcggggg

SEQ ID NO: 33483 - RNA, 19 nt, Artificial Sequence
  Synthetic
gaucucuggcacgcggggg

SEQ ID NO: 33484 - RNA, 20 nt, Artificial Sequence
  Synthetic
ugaucucuggcacgcggggg

SEQ ID NO: 33485 - RNA, 21 nt, Artificial Sequence
  Synthetic
gugaucucuggcacgcggggg

SEQ ID NO: 33486 - RNA, 22 nt, Artificial Sequence
  Synthetic
ggugaucucuggcacgcggggg

SEQ ID NO: 33487 - RNA, 23 nt, Artificial Sequence
  Synthetic
gggugaucucuggcacgcggggg

SEQ ID NO: 33488 - RNA, 24 nt, Artificial Sequence
  Synthetic
ggggugaucucuggcacgcggggg

SEQ ID NO: 33489 - RNA, 18 nt, Artificial Sequence
  Synthetic
ggggggggagugcggggg

SEQ ID NO: 33490 - RNA, 19 nt, Artificial Sequence
  Synthetic
gggggggggagugcggggg

SEQ ID NO: 33491 - RNA, 20 nt, Artificial Sequence
  Synthetic
ggggggggggagugcggggg

SEQ ID NO: 33492 - RNA, 21 nt, Artificial Sequence
  Synthetic
uggggggggggagugcggggg

SEQ ID NO: 33493 - RNA, 22 nt, Artificial Sequence
  Synthetic
cuggggggggggagugcggggg

SEQ ID NO: 33494 - RNA, 23 nt, Artificial Sequence
  Synthetic
ccuggggggggggagugcggggg

SEQ ID NO: 33495 - RNA, 24 nt, Artificial Sequence
  Synthetic
gccuggggggggggagugcggggg

SEQ ID NO: 33496 - RNA, 18 nt, Artificial Sequence
  Synthetic
ggugggaagggucggggg

SEQ ID NO: 33497 - RNA, 19 nt, Artificial Sequence
  Synthetic
gggugggaagggucggggg

SEQ ID NO: 33498 - RNA, 20 nt, Artificial Sequence
  Synthetic
ggggugggaagggucggggg

SEQ ID NO: 33499 - RNA, 21 nt, Artificial Sequence
  Synthetic
gggggugggaagggucggggg

SEQ ID NO: 33500 - RNA, 22 nt, Artificial Sequence
  Synthetic
cgggggugggaagggucggggg

SEQ ID NO: 33501 - RNA, 23 nt, Artificial Sequence
  Synthetic
gcgggggugggaagggucggggg

SEQ ID NO: 33502 - RNA, 24 nt, Artificial Sequence
  Synthetic
cgcgggggugggaagggucggggg

SEQ ID NO: 33503 - RNA, 18 nt, Artificial Sequence
  Synthetic
gucuuacugccugggggg

SEQ ID NO: 33504 - RNA, 19 nt, Artificial Sequence
  Synthetic
ggucuuacugccugggggg

SEQ ID NO: 33505 - RNA, 20 nt, Artificial Sequence
  Synthetic
gggucuuacugccugggggg

SEQ ID NO: 33506 - RNA, 21 nt, Artificial Sequence
  Synthetic
ugggucuuacugccugggggg

SEQ ID NO: 33507 - RNA, 22 nt, Artificial Sequence
  Synthetic
uugggucuuacugccugggggg

SEQ ID NO: 33508 - RNA, 23 nt, Artificial Sequence
  Synthetic
cuugggucuuacugccugggggg

SEQ ID NO: 33509 - RNA, 24 nt, Artificial Sequence
  Synthetic
gcuugggucuuacugccugggggg

SEQ ID NO: 33510 - RNA, 18 nt, Artificial Sequence
  Synthetic
ggucuuacugccuggggg

SEQ ID NO: 33511 - RNA, 19 nt, Artificial Sequence
  Synthetic
gggucuuacugccuggggg

SEQ ID NO: 33512 - RNA, 20 nt, Artificial Sequence
  Synthetic
ugggucuuacugccuggggg

SEQ ID NO: 33513 - RNA, 21 nt, Artificial Sequence
  Synthetic
uugggucuuacugccuggggg

SEQ ID NO: 33514 - RNA, 22 nt, Artificial Sequence
  Synthetic
cuugggucuuacugccuggggg

SEQ ID NO: 33515 - RNA, 23 nt, Artificial Sequence
  Synthetic
gcuugggucuuacugccuggggg

SEQ ID NO: 33516 - RNA, 24 nt, Artificial Sequence
  Synthetic
ugcuugggucuuacugccuggggg

SEQ ID NO: 33517 - RNA, 18 nt, Artificial Sequence
  Synthetic
gggucuuacugccugggg

SEQ ID NO: 33518 - RNA, 19 nt, Artificial Sequence
  Synthetic
ugggucuuacugccugggg

SEQ ID NO: 33519 - RNA, 20 nt, Artificial Sequence
  Synthetic
uugggucuuacugccugggg

SEQ ID NO: 33520 - RNA, 21 nt, Artificial Sequence
  Synthetic
cuugggucuuacugccugggg

SEQ ID NO: 33521 - RNA, 22 nt, Artificial Sequence
  Synthetic
gcuugggucuuacugccugggg

SEQ ID NO: 33522 - RNA, 23 nt, Artificial Sequence
  Synthetic
ugcuugggucuuacugccugggg

SEQ ID NO: 33523 - RNA, 24 nt, Artificial Sequence
  Synthetic
augcuugggucuuacugccugggg

SEQ ID NO: 33524 - RNA, 18 nt, Artificial Sequence
  Synthetic
ugggucuuacugccuggg

SEQ ID NO: 33525 - RNA, 19 nt, Artificial Sequence
  Synthetic
uugggucuuacugccuggg

SEQ ID NO: 33526 - RNA, 20 nt, Artificial Sequence
  Synthetic
cuugggucuuacugccuggg

SEQ ID NO: 33527 - RNA, 21 nt, Artificial Sequence
  Synthetic
gcuugggucuuacugccuggg

SEQ ID NO: 33528 - RNA, 22 nt, Artificial Sequence
  Synthetic
ugcuugggucuuacugccuggg

SEQ ID NO: 33529 - RNA, 23 nt, Artificial Sequence
  Synthetic
augcuugggucuuacugccuggg

SEQ ID NO: 33530 - RNA, 24 nt, Artificial Sequence
  Synthetic
uaugcuugggucuuacugccuggg

SEQ ID NO: 33531 - RNA, 18 nt, Artificial Sequence
  Synthetic
uugggucuuacugccugg

SEQ ID NO: 33532 - RNA, 19 nt, Artificial Sequence
  Synthetic
cuugggucuuacugccugg

SEQ ID NO: 33533 - RNA, 20 nt, Artificial Sequence
  Synthetic
gcuugggucuuacugccugg

SEQ ID NO: 33534 - RNA, 21 nt, Artificial Sequence
  Synthetic
ugcuugggucuuacugccugg

SEQ ID NO: 33535 - RNA, 22 nt, Artificial Sequence
  Synthetic
augcuugggucuuacugccugg

SEQ ID NO: 33536 - RNA, 23 nt, Artificial Sequence
  Synthetic
uaugcuugggucuuacugccugg

SEQ ID NO: 33537 - RNA, 24 nt, Artificial Sequence
  Synthetic
cuaugcuugggucuuacugccugg

SEQ ID NO: 33538 - RNA, 18 nt, Artificial Sequence
  Synthetic
gggggagggggggugugg

SEQ ID NO: 33539 - RNA, 19 nt, Artificial Sequence
  Synthetic
cgggggagggggggugugg

SEQ ID NO: 33540 - RNA, 20 nt, Artificial Sequence
  Synthetic
gcgggggagggggggugugg

SEQ ID NO: 33541 - RNA, 21 nt, Artificial Sequence
  Synthetic
ugcgggggagggggggugugg

SEQ ID NO: 33542 - RNA, 22 nt, Artificial Sequence
  Synthetic
gugcgggggagggggggugugg

SEQ ID NO: 33543 - RNA, 23 nt, Artificial Sequence
  Synthetic
agugcgggggagggggggugugg

SEQ ID NO: 33544 - RNA, 24 nt, Artificial Sequence
  Synthetic
gagugcgggggagggggggugugg

SEQ ID NO: 33545 - RNA, 18 nt, Artificial Sequence
  Synthetic
cuugggucuuacugccug

SEQ ID NO: 33546 - RNA, 19 nt, Artificial Sequence
  Synthetic
gcuugggucuuacugccug

SEQ ID NO: 33547 - RNA, 20 nt, Artificial Sequence
  Synthetic
ugcuugggucuuacugccug

SEQ ID NO: 33548 - RNA, 21 nt, Artificial Sequence
  Synthetic
augcuugggucuuacugccug

SEQ ID NO: 33549 - RNA, 22 nt, Artificial Sequence
  Synthetic
uaugcuugggucuuacugccug

SEQ ID NO: 33550 - RNA, 23 nt, Artificial Sequence
  Synthetic
cuaugcuugggucuuacugccug

SEQ ID NO: 33551 - RNA, 24 nt, Artificial Sequence
  Synthetic
ucuaugcuugggucuuacugccug

SEQ ID NO: 33552 - RNA, 18 nt, Artificial Sequence
  Synthetic
gccuggggggggggagug

SEQ ID NO: 33553 - RNA, 19 nt, Artificial Sequence
  Synthetic
ugccuggggggggggagug

SEQ ID NO: 33554 - RNA, 20 nt, Artificial Sequence
  Synthetic
cugccuggggggggggagug

SEQ ID NO: 33555 - RNA, 21 nt, Artificial Sequence
  Synthetic
acugccuggggggggggagug

SEQ ID NO: 33556 - RNA, 22 nt, Artificial Sequence
  Synthetic
uacugccuggggggggggagug

SEQ ID NO: 33557 - RNA, 23 nt, Artificial Sequence
  Synthetic
uuacugccuggggggggggagug

SEQ ID NO: 33558 - RNA, 24 nt, Artificial Sequence
  Synthetic
cuuacugccuggggggggggagug

SEQ ID NO: 33559 - RNA, 18 nt, Artificial Sequence
  Synthetic
acggaggaguggcgggug

SEQ ID NO: 33560 - RNA, 19 nt, Artificial Sequence
  Synthetic
uacggaggaguggcgggug

SEQ ID NO: 33561 - RNA, 20 nt, Artificial Sequence
  Synthetic
auacggaggaguggcgggug

SEQ ID NO: 33562 - RNA, 21 nt, Artificial Sequence
  Synthetic
gauacggaggaguggcgggug

SEQ ID NO: 33563 - RNA, 22 nt, Artificial Sequence
  Synthetic
ggauacggaggaguggcgggug

SEQ ID NO: 33564 - RNA, 23 nt, Artificial Sequence
  Synthetic
aggauacggaggaguggcgggug

SEQ ID NO: 33565 - RNA, 24 nt, Artificial Sequence
  Synthetic
gaggauacggaggaguggcgggug

SEQ ID NO: 33566 - RNA, 18 nt, Artificial Sequence
  Synthetic
ugcgggggagggggggug

SEQ ID NO: 33567 - RNA, 19 nt, Artificial Sequence
  Synthetic
gugcgggggagggggggug

SEQ ID NO: 33568 - RNA, 20 nt, Artificial Sequence
  Synthetic
agugcgggggagggggggug

SEQ ID NO: 33569 - RNA, 21 nt, Artificial Sequence
  Synthetic
gagugcgggggagggggggug

SEQ ID NO: 33570 - RNA, 22 nt, Artificial Sequence
  Synthetic
ggagugcgggggagggggggug

SEQ ID NO: 33571 - RNA, 23 nt, Artificial Sequence
  Synthetic
gggagugcgggggagggggggug

SEQ ID NO: 33572 - RNA, 24 nt, Artificial Sequence
  Synthetic
ggggagugcgggggagggggggug

SEQ ID NO: 33573 - RNA, 18 nt, Artificial Sequence
  Synthetic
uguuccuaaagcgaggau

SEQ ID NO: 33574 - RNA, 19 nt, Artificial Sequence
  Synthetic
uuguuccuaaagcgaggau

SEQ ID NO: 33575 - RNA, 20 nt, Artificial Sequence
  Synthetic
guuguuccuaaagcgaggau

SEQ ID NO: 33576 - RNA, 21 nt, Artificial Sequence
  Synthetic
aguuguuccuaaagcgaggau

SEQ ID NO: 33577 - RNA, 22 nt, Artificial Sequence
  Synthetic
aaguuguuccuaaagcgaggau

SEQ ID NO: 33578 - RNA, 23 nt, Artificial Sequence
  Synthetic
aaaguuguuccuaaagcgaggau

SEQ ID NO: 33579 - RNA, 24 nt, Artificial Sequence
  Synthetic
uaaaguuguuccuaaagcgaggau

SEQ ID NO: 33580 - RNA, 18 nt, Artificial Sequence
  Synthetic
gcuugggucuuacugccu

SEQ ID NO: 33581 - RNA, 19 nt, Artificial Sequence
  Synthetic
ugcuugggucuuacugccu

SEQ ID NO: 33582 - RNA, 20 nt, Artificial Sequence
  Synthetic
augcuugggucuuacugccu

SEQ ID NO: 33583 - RNA, 21 nt, Artificial Sequence
  Synthetic
uaugcuugggucuuacugccu

SEQ ID NO: 33584 - RNA, 22 nt, Artificial Sequence
  Synthetic
cuaugcuugggucuuacugccu

SEQ ID NO: 33585 - RNA, 23 nt, Artificial Sequence
  Synthetic
ucuaugcuugggucuuacugccu

SEQ ID NO: 33586 - RNA, 24 nt, Artificial Sequence
  Synthetic
cucuaugcuugggucuuacugccu

SEQ ID NO: 33587 - RNA, 18 nt, Artificial Sequence
  Synthetic
ccaacugcccccuuaucu

SEQ ID NO: 33588 - RNA, 19 nt, Artificial Sequence
  Synthetic
accaacugcccccuuaucu

SEQ ID NO: 33589 - RNA, 20 nt, Artificial Sequence
  Synthetic
caccaacugcccccuuaucu

SEQ ID NO: 33590 - RNA, 21 nt, Artificial Sequence
  Synthetic
ccaccaacugcccccuuaucu

SEQ ID NO: 33591 - RNA, 22 nt, Artificial Sequence
  Synthetic
accaccaacugcccccuuaucu

SEQ ID NO: 33592 - RNA, 23 nt, Artificial Sequence
  Synthetic
gaccaccaacugcccccuuaucu

SEQ ID NO: 33593 - RNA, 24 nt, Artificial Sequence
  Synthetic
cgaccaccaacugcccccuuaucu

SEQ ID NO: 33594 - RNA, 18 nt, Artificial Sequence
  Synthetic
ugccuggggggggggagu

SEQ ID NO: 33595 - RNA, 19 nt, Artificial Sequence
  Synthetic
cugccuggggggggggagu

SEQ ID NO: 33596 - RNA, 20 nt, Artificial Sequence
  Synthetic
acugccuggggggggggagu

SEQ ID NO: 33597 - RNA, 21 nt, Artificial Sequence
  Synthetic
uacugccuggggggggggagu

SEQ ID NO: 33598 - RNA, 22 nt, Artificial Sequence
  Synthetic
uuacugccuggggggggggagu

SEQ ID NO: 33599 - RNA, 23 nt, Artificial Sequence
  Synthetic
cuuacugccuggggggggggagu

SEQ ID NO: 33600 - RNA, 24 nt, Artificial Sequence
  Synthetic
ucuuacugccuggggggggggagu

SEQ ID NO: 33601 - RNA, 18 nt, Artificial Sequence
  Synthetic
cgcgggggugggaagggu

SEQ ID NO: 33602 - RNA, 19 nt, Artificial Sequence
  Synthetic
acgcgggggugggaagggu

SEQ ID NO: 33603 - RNA, 20 nt, Artificial Sequence
  Synthetic
cacgcgggggugggaagggu

SEQ ID NO: 33604 - RNA, 21 nt, Artificial Sequence
  Synthetic
gcacgcgggggugggaagggu

SEQ ID NO: 33605 - RNA, 22 nt, Artificial Sequence
  Synthetic
ggcacgcgggggugggaagggu

SEQ ID NO: 33606 - RNA, 23 nt, Artificial Sequence
  Synthetic
uggcacgcgggggugggaagggu

SEQ ID NO: 33607 - RNA, 24 nt, Artificial Sequence
  Synthetic
cuggcacgcgggggugggaagggu

SEQ ID NO: 33608 - RNA, 18 nt, Artificial Sequence
  Synthetic
ucucuggcacgcgggggu

SEQ ID NO: 33609 - RNA, 19 nt, Artificial Sequence
  Synthetic
aucucuggcacgcgggggu

SEQ ID NO: 33610 - RNA, 20 nt, Artificial Sequence
  Synthetic
gaucucuggcacgcgggggu

SEQ ID NO: 33611 - RNA, 21 nt, Artificial Sequence
  Synthetic
ugaucucuggcacgcgggggu

SEQ ID NO: 33612 - RNA, 22 nt, Artificial Sequence
  Synthetic
gugaucucuggcacgcgggggu

SEQ ID NO: 33613 - RNA, 23 nt, Artificial Sequence
  Synthetic
ggugaucucuggcacgcgggggu

SEQ ID NO: 33614 - RNA, 24 nt, Artificial Sequence
  Synthetic
gggugaucucuggcacgcgggggu

SEQ ID NO: 33615 - RNA, 18 nt, Artificial Sequence
  Synthetic
gugcgggggagggggggu

SEQ ID NO: 33616 - RNA, 19 nt, Artificial Sequence
  Synthetic
agugcgggggagggggggu

SEQ ID NO: 33617 - RNA, 20 nt, Artificial Sequence
  Synthetic
gagugcgggggagggggggu

SEQ ID NO: 33618 - RNA, 21 nt, Artificial Sequence
  Synthetic
ggagugcgggggagggggggu

SEQ ID NO: 33619 - RNA, 22 nt, Artificial Sequence
  Synthetic
gggagugcgggggagggggggu

SEQ ID NO: 33620 - RNA, 23 nt, Artificial Sequence
  Synthetic
ggggagugcgggggagggggggu

SEQ ID NO: 33621 - RNA, 24 nt, Artificial Sequence
  Synthetic
gggggagugcgggggagggggggu

SEQ ID NO: 33622 - RNA, 18 nt, Artificial Sequence
  Synthetic
gggacggggcgcccaaaa

SEQ ID NO: 33623 - RNA, 20 nt, Artificial Sequence
  Synthetic
gcgggacggggcgcccaaaa

SEQ ID NO: 33624 - RNA, 21 nt, Artificial Sequence
  Synthetic
ggcgggacggggcgcccaaaa

SEQ ID NO: 33625 - RNA, 22 nt, Artificial Sequence
  Synthetic
gggcgggacggggcgcccaaaa

SEQ ID NO: 33626 - RNA, 23 nt, Artificial Sequence
  Synthetic
ggggcgggacggggcgcccaaaa

SEQ ID NO: 33627 - RNA, 23 nt, Artificial Sequence
  Synthetic
guuaacuacacuauagggcaaca

SEQ ID NO: 33628 - RNA, 24 nt, Artificial Sequence
  Synthetic
gguuaacuacacuauagggcaaca

SEQ ID NO: 33629 - RNA, 19 nt, Artificial Sequence
  Synthetic
gcauggagccagaaccaca

SEQ ID NO: 33630 - RNA, 20 nt, Artificial Sequence
  Synthetic
ggcauggagccagaaccaca

SEQ ID NO: 33631 - RNA, 20 nt, Artificial Sequence
  Synthetic
gacacgggcaccacacacca

SEQ ID NO: 33632 - RNA, 24 nt, Artificial Sequence
  Synthetic
gaaagacacgggcaccacacacca

SEQ ID NO: 33633 - RNA, 24 nt, Artificial Sequence
  Synthetic
gaaaacaagaaugcggugcagcca

SEQ ID NO: 33634 - RNA, 21 nt, Artificial Sequence
  Synthetic
gcccuaauaaaaaaaaacuca

SEQ ID NO: 33635 - RNA, 22 nt, Artificial Sequence
  Synthetic
ggcccuaauaaaaaaaaacuca

SEQ ID NO: 33636 - RNA, 18 nt, Artificial Sequence
  Synthetic
gagaaucacaggagacga

SEQ ID NO: 33637 - RNA, 22 nt, Artificial Sequence
  Synthetic
gccagagaaucacaggagacga

SEQ ID NO: 33638 - RNA, 18 nt, Artificial Sequence
  Synthetic
ggaacauaguuagaaaac

SEQ ID NO: 33639 - RNA, 24 nt, Artificial Sequence
  Synthetic
gaaacaggaacauaguuagaaaac

SEQ ID NO: 33640 - RNA, 18 nt, Artificial Sequence
  Synthetic
gucggccacaccacagac

SEQ ID NO: 33641 - RNA, 19 nt, Artificial Sequence
  Synthetic
ggucggccacaccacagac

SEQ ID NO: 33642 - RNA, 20 nt, Artificial Sequence
  Synthetic
gggucggccacaccacagac

SEQ ID NO: 33643 - RNA, 21 nt, Artificial Sequence
  Synthetic
ggggucggccacaccacagac

SEQ ID NO: 33644 - RNA, 22 nt, Artificial Sequence
  Synthetic
gggggucggccacaccacagac

SEQ ID NO: 33645 - RNA, 20 nt, Artificial Sequence
  Synthetic
gcacccugcuccccgagacc

SEQ ID NO: 33646 - RNA, 23 nt, Artificial Sequence
  Synthetic
gccgcacccugcuccccgagacc

SEQ ID NO: 33647 - RNA, 18 nt, Artificial Sequence
  Synthetic
guaaccacgugaugcccc

SEQ ID NO: 33648 - RNA, 19 nt, Artificial Sequence
  Synthetic
gguaaccacgugaugcccc

SEQ ID NO: 33649 - RNA, 20 nt, Artificial Sequence
  Synthetic
ggguaaccacgugaugcccc

SEQ ID NO: 33650 - RNA, 22 nt, Artificial Sequence
  Synthetic
gcggguaaccacgugaugcccc

SEQ ID NO: 33651 - RNA, 20 nt, Artificial Sequence
  Synthetic
gucuguguuggauguaucgc

SEQ ID NO: 33652 - RNA, 18 nt, Artificial Sequence
  Synthetic
gcgcuaccugcccaucuc

SEQ ID NO: 33653 - RNA, 18 nt, Artificial Sequence
  Synthetic
ggaggggggggucgggcg

SEQ ID NO: 33654 - RNA, 19 nt, Artificial Sequence
  Synthetic
gggaggggggggucgggcg

SEQ ID NO: 33655 - RNA, 20 nt, Artificial Sequence
  Synthetic
ggggaggggggggucgggcg

SEQ ID NO: 33656 - RNA, 22 nt, Artificial Sequence
  Synthetic
guggggaggggggggucgggcg

SEQ ID NO: 33657 - RNA, 19 nt, Artificial Sequence
  Synthetic
guguugggggguggggcgg

SEQ ID NO: 33658 - RNA, 20 nt, Artificial Sequence
  Synthetic
gguguugggggguggggcgg

SEQ ID NO: 33659 - RNA, 21 nt, Artificial Sequence
  Synthetic
ggguguugggggguggggcgg

SEQ ID NO: 33660 - RNA, 23 nt, Artificial Sequence
  Synthetic
guggguguugggggguggggcgg

SEQ ID NO: 33661 - RNA, 23 nt, Artificial Sequence
  Synthetic
gccccccguguuuguggggaggg

SEQ ID NO: 33662 - RNA, 18 nt, Artificial Sequence
  Synthetic
gccgccacaaagggcggg

SEQ ID NO: 33663 - RNA, 19 nt, Artificial Sequence
  Synthetic
ggccgccacaaagggcggg

SEQ ID NO: 33664 - RNA, 19 nt, Artificial Sequence
  Synthetic
gagccagaaccacaguggg

SEQ ID NO: 33665 - RNA, 20 nt, Artificial Sequence
  Synthetic
ggagccagaaccacaguggg

SEQ ID NO: 33666 - RNA, 24 nt, Artificial Sequence
  Synthetic
gcauggagccagaaccacaguggg

SEQ ID NO: 33667 - RNA, 20 nt, Artificial Sequence
  Synthetic
guaucuuuucccugucugug

SEQ ID NO: 33668 - RNA, 24 nt, Artificial Sequence
  Synthetic
gccacaccacagacguggguguug

SEQ ID NO: 33669 - RNA, 18 nt, Artificial Sequence
  Synthetic
gucggaguggaacagccu

SEQ ID NO: 33670 - RNA, 20 nt, Artificial Sequence
  Synthetic
gcgucggaguggaacagccu

SEQ ID NO: 33671 - RNA, 18 nt, Artificial Sequence
  Synthetic
gcggggaugcgugggagu

SEQ ID NO: 33672 - RNA, 23 nt, Artificial Sequence
  Synthetic
guaucgcggggaugcgugggagu

SEQ ID NO: 33673 - RNA, 18 nt, Artificial Sequence
  Synthetic
gugggggugcgugggagu

SEQ ID NO: 33674 - RNA, 20 nt, Artificial Sequence
  Synthetic
gagugggggugcgugggagu

SEQ ID NO: 33675 - RNA, 21 nt, Artificial Sequence
  Synthetic
ggagugggggugcgugggagu

SEQ ID NO: 33676 - RNA, 22 nt, Artificial Sequence
  Synthetic
gggagugggggugcgugggagu

SEQ ID NO: 33677 - RNA, 24 nt, Artificial Sequence
  Synthetic
gugggagugggggugcgugggagu

SEQ ID NO: 33678 - RNA, 20 nt, Artificial Sequence
  Synthetic
guacccgacggcccccgcgu

SEQ ID NO: 33679 - RNA, 22 nt, Artificial Sequence
  Synthetic
gaguacccgacggcccccgcgu

SEQ ID NO: 33680 - RNA, 20 nt, Artificial Sequence
  Synthetic
gauguaucgcggggaugcgu

SEQ ID NO: 33681 - RNA, 21 nt, Artificial Sequence
  Synthetic
ggauguaucgcggggaugcgu

SEQ ID NO: 33682 - RNA, 24 nt, Artificial Sequence
  Synthetic
guuggauguaucgcggggaugcgu

SEQ ID NO: 33683 - RNA, 18 nt, Artificial Sequence
  Synthetic
gugggagugggggugcgu

SEQ ID NO: 33684 - RNA, 20 nt, Artificial Sequence
  Synthetic
gcgugggagugggggugcgu

SEQ ID NO: 33685 - RNA, 23 nt, Artificial Sequence
  Synthetic
gaugcgugggagugggggugcgu

SEQ ID NO: 33686 - RNA, 24 nt, Artificial Sequence
  Synthetic
ggaugcgugggagugggggugcgu

SEQ ID NO: 33687 - RNA, 22 nt, Artificial Sequence
  Synthetic
gugcgugggagugggggugcgu

SEQ ID NO: 33688 - RNA, 23 nt, Artificial Sequence
  Synthetic
ggugcgugggagugggggugcgu

SEQ ID NO: 33689 - RNA, 24 nt, Artificial Sequence
  Synthetic
gggugcgugggagugggggugcgu

SEQ ID NO: 33690 - RNA, 19 nt, Artificial Sequence
  Synthetic
gaaccacaguggguugggu

SEQ ID NO: 33691 - RNA, 23 nt, Artificial Sequence
  Synthetic
gccagaaccacaguggguugggu

SEQ ID NO: 33692 - RNA, 18 nt, Artificial Sequence
  Synthetic
gaacagcauguuccccac

SEQ ID NO: 33693 - RNA, 21 nt, Artificial Sequence
  Synthetic
gucgaacagcauguuccccac

SEQ ID NO: 33694 - RNA, 22 nt, Artificial Sequence
  Synthetic
ggucgaacagcauguuccccac

SEQ ID NO: 33695 - RNA, 18 nt, Artificial Sequence
  Synthetic
gaaguccagggcgcccac

SEQ ID NO: 33696 - RNA, 19 nt, Artificial Sequence
  Synthetic
ggaaguccagggcgcccac

SEQ ID NO: 33697 - RNA, 21 nt, Artificial Sequence
  Synthetic
gcggaaguccagggcgcccac

SEQ ID NO: 33698 - RNA, 24 nt, Artificial Sequence
  Synthetic
gcugcggaaguccagggcgcccac

SEQ ID NO: 33699 - RNA, 19 nt, Artificial Sequence
  Synthetic
gcccccugcuccccggacc

SEQ ID NO: 33700 - RNA, 22 nt, Artificial Sequence
  Synthetic
gacgcccccugcuccccggacc

SEQ ID NO: 33701 - RNA, 20 nt, Artificial Sequence
  Synthetic
guaccggcccaccuggccgc

SEQ ID NO: 33702 - RNA, 22 nt, Artificial Sequence
  Synthetic
gaguaccggcccaccuggccgc

SEQ ID NO: 33703 - RNA, 23 nt, Artificial Sequence
  Synthetic
ggaguaccggcccaccuggccgc

SEQ ID NO: 33704 - RNA, 23 nt, Artificial Sequence
  Synthetic
gucccuuauuguuuucccucguc

SEQ ID NO: 33705 - RNA, 18 nt, Artificial Sequence
  Synthetic
guuccccgucuccauguc

SEQ ID NO: 33706 - RNA, 21 nt, Artificial Sequence
  Synthetic
gauguuccccgucuccauguc

SEQ ID NO: 33707 - RNA, 20 nt, Artificial Sequence
  Synthetic
gccaguggcaggaugcuuuc

SEQ ID NO: 33708 - RNA, 18 nt, Artificial Sequence
  Synthetic
ggggaccgcggcccgcag

SEQ ID NO: 33709 - RNA, 21 nt, Artificial Sequence
  Synthetic
gccggggaccgcggcccgcag

SEQ ID NO: 33710 - RNA, 21 nt, Artificial Sequence
  Synthetic
guuacccgcggucucggggag

SEQ ID NO: 33711 - RNA, 22 nt, Artificial Sequence
  Synthetic
gguuacccgcggucucggggag

SEQ ID NO: 33712 - RNA, 24 nt, Artificial Sequence
  Synthetic
gugguuacccgcggucucggggag

SEQ ID NO: 33713 - RNA, 23 nt, Artificial Sequence
  Synthetic
guuccacuccgacgcgggggccg

SEQ ID NO: 33714 - RNA, 21 nt, Artificial Sequence
  Synthetic
guucuggcuccaugccagugg

SEQ ID NO: 33715 - RNA, 22 nt, Artificial Sequence
  Synthetic
gguucuggcuccaugccagugg

SEQ ID NO: 33716 - RNA, 24 nt, Artificial Sequence
  Synthetic
gugguucuggcuccaugccagugg

SEQ ID NO: 33717 - RNA, 19 nt, Artificial Sequence
  Synthetic
cgggacggggcgcccaaaa

SEQ ID NO: 33718 - RNA, 24 nt, Artificial Sequence
  Synthetic
cggggcgggacggggcgcccaaaa

SEQ ID NO: 33719 - RNA, 18 nt, Artificial Sequence
  Synthetic
cuacacuauagggcaaca

SEQ ID NO: 33720 - RNA, 19 nt, Artificial Sequence
  Synthetic
acuacacuauagggcaaca

SEQ ID NO: 33721 - RNA, 20 nt, Artificial Sequence
  Synthetic
aacuacacuauagggcaaca

SEQ ID NO: 33722 - RNA, 21 nt, Artificial Sequence
  Synthetic
uaacuacacuauagggcaaca

SEQ ID NO: 33723 - RNA, 22 nt, Artificial Sequence
  Synthetic
uuaacuacacuauagggcaaca

SEQ ID NO: 33724 - RNA, 18 nt, Artificial Sequence
  Synthetic
cauggagccagaaccaca

SEQ ID NO: 33725 - RNA, 21 nt, Artificial Sequence
  Synthetic
uggcauggagccagaaccaca

SEQ ID NO: 33726 - RNA, 22 nt, Artificial Sequence
  Synthetic
cuggcauggagccagaaccaca

SEQ ID NO: 33727 - RNA, 23 nt, Artificial Sequence
  Synthetic
acuggcauggagccagaaccaca

SEQ ID NO: 33728 - RNA, 24 nt, Artificial Sequence
  Synthetic
cacuggcauggagccagaaccaca

SEQ ID NO: 33729 - RNA, 18 nt, Artificial Sequence
  Synthetic
cacgggcaccacacacca

SEQ ID NO: 33730 - RNA, 19 nt, Artificial Sequence
  Synthetic
acacgggcaccacacacca

SEQ ID NO: 33731 - RNA, 21 nt, Artificial Sequence
  Synthetic
agacacgggcaccacacacca

SEQ ID NO: 33732 - RNA, 22 nt, Artificial Sequence
  Synthetic
aagacacgggcaccacacacca

SEQ ID NO: 33733 - RNA, 23 nt, Artificial Sequence
  Synthetic
aaagacacgggcaccacacacca

SEQ ID NO: 33734 - RNA, 18 nt, Artificial Sequence
  Synthetic
aagaaugcggugcagcca

SEQ ID NO: 33735 - RNA, 19 nt, Artificial Sequence
  Synthetic
caagaaugcggugcagcca

SEQ ID NO: 33736 - RNA, 20 nt, Artificial Sequence
  Synthetic
acaagaaugcggugcagcca

SEQ ID NO: 33737 - RNA, 21 nt, Artificial Sequence
  Synthetic
aacaagaaugcggugcagcca

SEQ ID NO: 33738 - RNA, 22 nt, Artificial Sequence
  Synthetic
aaacaagaaugcggugcagcca

SEQ ID NO: 33739 - RNA, 23 nt, Artificial Sequence
  Synthetic
aaaacaagaaugcggugcagcca

SEQ ID NO: 33740 - RNA, 18 nt, Artificial Sequence
  Synthetic
cuaauaaaaaaaaacuca

SEQ ID NO: 33741 - RNA, 19 nt, Artificial Sequence
  Synthetic
ccuaauaaaaaaaaacuca

SEQ ID NO: 33742 - RNA, 20 nt, Artificial Sequence
  Synthetic
cccuaauaaaaaaaaacuca

SEQ ID NO: 33743 - RNA, 23 nt, Artificial Sequence
  Synthetic
uggcccuaauaaaaaaaaacuca

SEQ ID NO: 33744 - RNA, 24 nt, Artificial Sequence
  Synthetic
uuggcccuaauaaaaaaaaacuca

SEQ ID NO: 33745 - RNA, 19 nt, Artificial Sequence
  Synthetic
agagaaucacaggagacga

SEQ ID NO: 33746 - RNA, 20 nt, Artificial Sequence
  Synthetic
cagagaaucacaggagacga

SEQ ID NO: 33747 - RNA, 21 nt, Artificial Sequence
  Synthetic
ccagagaaucacaggagacga

SEQ ID NO: 33748 - RNA, 23 nt, Artificial Sequence
  Synthetic
agccagagaaucacaggagacga

SEQ ID NO: 33749 - RNA, 24 nt, Artificial Sequence
  Synthetic
cagccagagaaucacaggagacga

SEQ ID NO: 33750 - RNA, 19 nt, Artificial Sequence
  Synthetic
aggaacauaguuagaaaac

SEQ ID NO: 33751 - RNA, 20 nt, Artificial Sequence
  Synthetic
caggaacauaguuagaaaac

SEQ ID NO: 33752 - RNA, 21 nt, Artificial Sequence
  Synthetic
acaggaacauaguuagaaaac

SEQ ID NO: 33753 - RNA, 22 nt, Artificial Sequence
  Synthetic
aacaggaacauaguuagaaaac

SEQ ID NO: 33754 - RNA, 23 nt, Artificial Sequence
  Synthetic
aaacaggaacauaguuagaaaac

SEQ ID NO: 33755 - RNA, 23 nt, Artificial Sequence
  Synthetic
agggggucggccacaccacagac

SEQ ID NO: 33756 - RNA, 24 nt, Artificial Sequence
  Synthetic
aagggggucggccacaccacagac

SEQ ID NO: 33757 - RNA, 18 nt, Artificial Sequence
  Synthetic
acccugcuccccgagacc

SEQ ID NO: 33758 - RNA, 19 nt, Artificial Sequence
  Synthetic
cacccugcuccccgagacc

SEQ ID NO: 33759 - RNA, 21 nt, Artificial Sequence
  Synthetic
cgcacccugcuccccgagacc

SEQ ID NO: 33760 - RNA, 22 nt, Artificial Sequence
  Synthetic
ccgcacccugcuccccgagacc

SEQ ID NO: 33761 - RNA, 24 nt, Artificial Sequence
  Synthetic
cgccgcacccugcuccccgagacc

SEQ ID NO: 33762 - RNA, 21 nt, Artificial Sequence
  Synthetic
cggguaaccacgugaugcccc

SEQ ID NO: 33763 - RNA, 23 nt, Artificial Sequence
  Synthetic
cgcggguaaccacgugaugcccc

SEQ ID NO: 33764 - RNA, 24 nt, Artificial Sequence
  Synthetic
ccgcggguaaccacgugaugcccc

SEQ ID NO: 33765 - RNA, 18 nt, Artificial Sequence
  Synthetic
cuguguuggauguaucgc

SEQ ID NO: 33766 - RNA, 19 nt, Artificial Sequence
  Synthetic
ucuguguuggauguaucgc

SEQ ID NO: 33767 - RNA, 21 nt, Artificial Sequence
  Synthetic
ugucuguguuggauguaucgc

SEQ ID NO: 33768 - RNA, 22 nt, Artificial Sequence
  Synthetic
cugucuguguuggauguaucgc

SEQ ID NO: 33769 - RNA, 23 nt, Artificial Sequence
  Synthetic
ccugucuguguuggauguaucgc

SEQ ID NO: 33770 - RNA, 24 nt, Artificial Sequence
  Synthetic
cccugucuguguuggauguaucgc

SEQ ID NO: 33771 - RNA, 19 nt, Artificial Sequence
  Synthetic
cgcgcuaccugcccaucuc

SEQ ID NO: 33772 - RNA, 20 nt, Artificial Sequence
  Synthetic
acgcgcuaccugcccaucuc

SEQ ID NO: 33773 - RNA, 21 nt, Artificial Sequence
  Synthetic
cacgcgcuaccugcccaucuc

SEQ ID NO: 33774 - RNA, 22 nt, Artificial Sequence
  Synthetic
ucacgcgcuaccugcccaucuc

SEQ ID NO: 33775 - RNA, 23 nt, Artificial Sequence
  Synthetic
cucacgcgcuaccugcccaucuc

SEQ ID NO: 33776 - RNA, 24 nt, Artificial Sequence
  Synthetic
ccucacgcgcuaccugcccaucuc

SEQ ID NO: 33777 - RNA, 18 nt, Artificial Sequence
  Synthetic
agagaccgccgggggacg

SEQ ID NO: 33778 - RNA, 19 nt, Artificial Sequence
  Synthetic
uagagaccgccgggggacg

SEQ ID NO: 33779 - RNA, 20 nt, Artificial Sequence
  Synthetic
uuagagaccgccgggggacg

SEQ ID NO: 33780 - RNA, 21 nt, Artificial Sequence
  Synthetic
cuuagagaccgccgggggacg

SEQ ID NO: 33781 - RNA, 22 nt, Artificial Sequence
  Synthetic
ucuuagagaccgccgggggacg

SEQ ID NO: 33782 - RNA, 23 nt, Artificial Sequence
  Synthetic
uucuuagagaccgccgggggacg

SEQ ID NO: 33783 - RNA, 24 nt, Artificial Sequence
  Synthetic
cuucuuagagaccgccgggggacg

SEQ ID NO: 33784 - RNA, 21 nt, Artificial Sequence
  Synthetic
uggggaggggggggucgggcg

SEQ ID NO: 33785 - RNA, 23 nt, Artificial Sequence
  Synthetic
uguggggaggggggggucgggcg

SEQ ID NO: 33786 - RNA, 24 nt, Artificial Sequence
  Synthetic
uuguggggaggggggggucgggcg

SEQ ID NO: 33787 - RNA, 18 nt, Artificial Sequence
  Synthetic
uguugggggguggggcgg

SEQ ID NO: 33788 - RNA, 22 nt, Artificial Sequence
  Synthetic
uggguguugggggguggggcgg

SEQ ID NO: 33789 - RNA, 24 nt, Artificial Sequence
  Synthetic
cguggguguugggggguggggcgg

SEQ ID NO: 33790 - RNA, 18 nt, Artificial Sequence
  Synthetic
ccguguuuguggggaggg

SEQ ID NO: 33791 - RNA, 19 nt, Artificial Sequence
  Synthetic
cccguguuuguggggaggg

SEQ ID NO: 33792 - RNA, 20 nt, Artificial Sequence
  Synthetic
ccccguguuuguggggaggg

SEQ ID NO: 33793 - RNA, 21 nt, Artificial Sequence
  Synthetic
cccccguguuuguggggaggg

SEQ ID NO: 33794 - RNA, 22 nt, Artificial Sequence
  Synthetic
ccccccguguuuguggggaggg

SEQ ID NO: 33795 - RNA, 24 nt, Artificial Sequence
  Synthetic
cgccccccguguuuguggggaggg

SEQ ID NO: 33796 - RNA, 20 nt, Artificial Sequence
  Synthetic
uggccgccacaaagggcggg

SEQ ID NO: 33797 - RNA, 21 nt, Artificial Sequence
  Synthetic
cuggccgccacaaagggcggg

SEQ ID NO: 33798 - RNA, 22 nt, Artificial Sequence
  Synthetic
ucuggccgccacaaagggcggg

SEQ ID NO: 33799 - RNA, 23 nt, Artificial Sequence
  Synthetic
cucuggccgccacaaagggcggg

SEQ ID NO: 33800 - RNA, 24 nt, Artificial Sequence
  Synthetic
ccucuggccgccacaaagggcggg

SEQ ID NO: 33801 - RNA, 18 nt, Artificial Sequence
  Synthetic
agggcaacaaaggauggg

SEQ ID NO: 33802 - RNA, 19 nt, Artificial Sequence
  Synthetic
uagggcaacaaaggauggg

SEQ ID NO: 33803 - RNA, 20 nt, Artificial Sequence
  Synthetic
auagggcaacaaaggauggg

SEQ ID NO: 33804 - RNA, 21 nt, Artificial Sequence
  Synthetic
uauagggcaacaaaggauggg

SEQ ID NO: 33805 - RNA, 22 nt, Artificial Sequence
  Synthetic
cuauagggcaacaaaggauggg

SEQ ID NO: 33806 - RNA, 23 nt, Artificial Sequence
  Synthetic
acuauagggcaacaaaggauggg

SEQ ID NO: 33807 - RNA, 24 nt, Artificial Sequence
  Synthetic
cacuauagggcaacaaaggauggg

SEQ ID NO: 33808 - RNA, 18 nt, Artificial Sequence
  Synthetic
agccagaaccacaguggg

SEQ ID NO: 33809 - RNA, 21 nt, Artificial Sequence
  Synthetic
uggagccagaaccacaguggg

SEQ ID NO: 33810 - RNA, 22 nt, Artificial Sequence
  Synthetic
auggagccagaaccacaguggg

SEQ ID NO: 33811 - RNA, 23 nt, Artificial Sequence
  Synthetic
cauggagccagaaccacaguggg

SEQ ID NO: 33812 - RNA, 18 nt, Artificial Sequence
  Synthetic
aucuuuucccugucugug

SEQ ID NO: 33813 - RNA, 19 nt, Artificial Sequence
  Synthetic
uaucuuuucccugucugug

SEQ ID NO: 33814 - RNA, 21 nt, Artificial Sequence
  Synthetic
uguaucuuuucccugucugug

SEQ ID NO: 33815 - RNA, 22 nt, Artificial Sequence
  Synthetic
uuguaucuuuucccugucugug

SEQ ID NO: 33816 - RNA, 23 nt, Artificial Sequence
  Synthetic
uuuguaucuuuucccugucugug

SEQ ID NO: 33817 - RNA, 24 nt, Artificial Sequence
  Synthetic
uuuuguaucuuuucccugucugug

SEQ ID NO: 33818 - RNA, 18 nt, Artificial Sequence
  Synthetic
ccacagacguggguguug

SEQ ID NO: 33819 - RNA, 19 nt, Artificial Sequence
  Synthetic
accacagacguggguguug

SEQ ID NO: 33820 - RNA, 20 nt, Artificial Sequence
  Synthetic
caccacagacguggguguug

SEQ ID NO: 33821 - RNA, 21 nt, Artificial Sequence
  Synthetic
acaccacagacguggguguug

SEQ ID NO: 33822 - RNA, 22 nt, Artificial Sequence
  Synthetic
cacaccacagacguggguguug

SEQ ID NO: 33823 - RNA, 23 nt, Artificial Sequence
  Synthetic
ccacaccacagacguggguguug

SEQ ID NO: 33824 - RNA, 19 nt, Artificial Sequence
  Synthetic
cgucggaguggaacagccu

SEQ ID NO: 33825 - RNA, 21 nt, Artificial Sequence
  Synthetic
cgcgucggaguggaacagccu

SEQ ID NO: 33826 - RNA, 22 nt, Artificial Sequence
  Synthetic
ccgcgucggaguggaacagccu

SEQ ID NO: 33827 - RNA, 23 nt, Artificial Sequence
  Synthetic
cccgcgucggaguggaacagccu

SEQ ID NO: 33828 - RNA, 24 nt, Artificial Sequence
  Synthetic
ccccgcgucggaguggaacagccu

SEQ ID NO: 33829 - RNA, 19 nt, Artificial Sequence
  Synthetic
cgcggggaugcgugggagu

SEQ ID NO: 33830 - RNA, 20 nt, Artificial Sequence
  Synthetic
ucgcggggaugcgugggagu

SEQ ID NO: 33831 - RNA, 21 nt, Artificial Sequence
  Synthetic
aucgcggggaugcgugggagu

SEQ ID NO: 33832 - RNA, 22 nt, Artificial Sequence
  Synthetic
uaucgcggggaugcgugggagu

SEQ ID NO: 33833 - RNA, 24 nt, Artificial Sequence
  Synthetic
uguaucgcggggaugcgugggagu

SEQ ID NO: 33834 - RNA, 19 nt, Artificial Sequence
  Synthetic
agugggggugcgugggagu

SEQ ID NO: 33835 - RNA, 23 nt, Artificial Sequence
  Synthetic
ugggagugggggugcgugggagu

SEQ ID NO: 33836 - RNA, 18 nt, Artificial Sequence
  Synthetic
acccgacggcccccgcgu

SEQ ID NO: 33837 - RNA, 19 nt, Artificial Sequence
  Synthetic
uacccgacggcccccgcgu

SEQ ID NO: 33838 - RNA, 21 nt, Artificial Sequence
  Synthetic
aguacccgacggcccccgcgu

SEQ ID NO: 33839 - RNA, 23 nt, Artificial Sequence
  Synthetic
cgaguacccgacggcccccgcgu

SEQ ID NO: 33840 - RNA, 24 nt, Artificial Sequence
  Synthetic
ccgaguacccgacggcccccgcgu

SEQ ID NO: 33841 - RNA, 18 nt, Artificial Sequence
  Synthetic
uguaucgcggggaugcgu

SEQ ID NO: 33842 - RNA, 19 nt, Artificial Sequence
  Synthetic
auguaucgcggggaugcgu

SEQ ID NO: 33843 - RNA, 22 nt, Artificial Sequence
  Synthetic
uggauguaucgcggggaugcgu

SEQ ID NO: 33844 - RNA, 23 nt, Artificial Sequence
  Synthetic
uuggauguaucgcggggaugcgu

SEQ ID NO: 33845 - RNA, 19 nt, Artificial Sequence
  Synthetic
cgugggagugggggugcgu

SEQ ID NO: 33846 - RNA, 21 nt, Artificial Sequence
  Synthetic
ugcgugggagugggggugcgu

SEQ ID NO: 33847 - RNA, 22 nt, Artificial Sequence
  Synthetic
augcgugggagugggggugcgu

SEQ ID NO: 33848 - RNA, 18 nt, Artificial Sequence
  Synthetic
aaccacaguggguugggu

SEQ ID NO: 33849 - RNA, 20 nt, Artificial Sequence
  Synthetic
agaaccacaguggguugggu

SEQ ID NO: 33850 - RNA, 21 nt, Artificial Sequence
  Synthetic
cagaaccacaguggguugggu

SEQ ID NO: 33851 - RNA, 22 nt, Artificial Sequence
  Synthetic
ccagaaccacaguggguugggu

SEQ ID NO: 33852 - RNA, 24 nt, Artificial Sequence
  Synthetic
agccagaaccacaguggguugggu

SEQ ID NO: 33853 - RNA, 19 nt, Artificial Sequence
  Synthetic
cgaacagcauguuccccac

SEQ ID NO: 33854 - RNA, 20 nt, Artificial Sequence
  Synthetic
ucgaacagcauguuccccac

SEQ ID NO: 33855 - RNA, 23 nt, Artificial Sequence
  Synthetic
uggucgaacagcauguuccccac

SEQ ID NO: 33856 - RNA, 24 nt, Artificial Sequence
  Synthetic
cuggucgaacagcauguuccccac

SEQ ID NO: 33857 - RNA, 20 nt, Artificial Sequence
  Synthetic
cggaaguccagggcgcccac

SEQ ID NO: 33858 - RNA, 22 nt, Artificial Sequence
  Synthetic
ugcggaaguccagggcgcccac

SEQ ID NO: 33859 - RNA, 23 nt, Artificial Sequence
  Synthetic
cugcggaaguccagggcgcccac

SEQ ID NO: 33860 - RNA, 18 nt, Artificial Sequence
  Synthetic
acuuuuccccuccccgac

SEQ ID NO: 33861 - RNA, 19 nt, Artificial Sequence
  Synthetic
cacuuuuccccuccccgac

SEQ ID NO: 33862 - RNA, 20 nt, Artificial Sequence
  Synthetic
ucacuuuuccccuccccgac

SEQ ID NO: 33863 - RNA, 21 nt, Artificial Sequence
  Synthetic
uucacuuuuccccuccccgac

SEQ ID NO: 33864 - RNA, 22 nt, Artificial Sequence
  Synthetic
uuucacuuuuccccuccccgac

SEQ ID NO: 33865 - RNA, 23 nt, Artificial Sequence
  Synthetic
cuuucacuuuuccccuccccgac

SEQ ID NO: 33866 - RNA, 24 nt, Artificial Sequence
  Synthetic
ucuuucacuuuuccccuccccgac

SEQ ID NO: 33867 - RNA, 18 nt, Artificial Sequence
  Synthetic
cccccugcuccccggacc

SEQ ID NO: 33868 - RNA, 20 nt, Artificial Sequence
  Synthetic
cgcccccugcuccccggacc

SEQ ID NO: 33869 - RNA, 21 nt, Artificial Sequence
  Synthetic
acgcccccugcuccccggacc

SEQ ID NO: 33870 - RNA, 23 nt, Artificial Sequence
  Synthetic
cgacgcccccugcuccccggacc

SEQ ID NO: 33871 - RNA, 24 nt, Artificial Sequence
  Synthetic
ucgacgcccccugcuccccggacc

SEQ ID NO: 33872 - RNA, 18 nt, Artificial Sequence
  Synthetic
acagacagcaaaaauccc

SEQ ID NO: 33873 - RNA, 19 nt, Artificial Sequence
  Synthetic
aacagacagcaaaaauccc

SEQ ID NO: 33874 - RNA, 20 nt, Artificial Sequence
  Synthetic
caacagacagcaaaaauccc

SEQ ID NO: 33875 - RNA, 21 nt, Artificial Sequence
  Synthetic
ccaacagacagcaaaaauccc

SEQ ID NO: 33876 - RNA, 22 nt, Artificial Sequence
  Synthetic
cccaacagacagcaaaaauccc

SEQ ID NO: 33877 - RNA, 23 nt, Artificial Sequence
  Synthetic
ucccaacagacagcaaaaauccc

SEQ ID NO: 33878 - RNA, 24 nt, Artificial Sequence
  Synthetic
uucccaacagacagcaaaaauccc

SEQ ID NO: 33879 - RNA, 18 nt, Artificial Sequence
  Synthetic
accggcccaccuggccgc

SEQ ID NO: 33880 - RNA, 19 nt, Artificial Sequence
  Synthetic
uaccggcccaccuggccgc

SEQ ID NO: 33881 - RNA, 21 nt, Artificial Sequence
  Synthetic
aguaccggcccaccuggccgc

SEQ ID NO: 33882 - RNA, 24 nt, Artificial Sequence
  Synthetic
uggaguaccggcccaccuggccgc

SEQ ID NO: 33883 - RNA, 18 nt, Artificial Sequence
  Synthetic
ucauaccaccgagcaugc

SEQ ID NO: 33884 - RNA, 19 nt, Artificial Sequence
  Synthetic
uucauaccaccgagcaugc

SEQ ID NO: 33885 - RNA, 20 nt, Artificial Sequence
  Synthetic
cuucauaccaccgagcaugc

SEQ ID NO: 33886 - RNA, 21 nt, Artificial Sequence
  Synthetic
ccuucauaccaccgagcaugc

SEQ ID NO: 33887 - RNA, 22 nt, Artificial Sequence
  Synthetic
uccuucauaccaccgagcaugc

SEQ ID NO: 33888 - RNA, 23 nt, Artificial Sequence
  Synthetic
cuccuucauaccaccgagcaugc

SEQ ID NO: 33889 - RNA, 24 nt, Artificial Sequence
  Synthetic
ccuccuucauaccaccgagcaugc

SEQ ID NO: 33890 - RNA, 18 nt, Artificial Sequence
  Synthetic
uuauuguuuucccucguc

SEQ ID NO: 33891 - RNA, 19 nt, Artificial Sequence
  Synthetic
cuuauuguuuucccucguc

SEQ ID NO: 33892 - RNA, 20 nt, Artificial Sequence
  Synthetic
ccuuauuguuuucccucguc

SEQ ID NO: 33893 - RNA, 21 nt, Artificial Sequence
  Synthetic
cccuuauuguuuucccucguc

SEQ ID NO: 33894 - RNA, 22 nt, Artificial Sequence
  Synthetic
ucccuuauuguuuucccucguc

SEQ ID NO: 33895 - RNA, 24 nt, Artificial Sequence
  Synthetic
cgucccuuauuguuuucccucguc

SEQ ID NO: 33896 - RNA, 19 nt, Artificial Sequence
  Synthetic
uguuccccgucuccauguc

SEQ ID NO: 33897 - RNA, 20 nt, Artificial Sequence
  Synthetic
auguuccccgucuccauguc

SEQ ID NO: 33898 - RNA, 22 nt, Artificial Sequence
  Synthetic
cgauguuccccgucuccauguc

SEQ ID NO: 33899 - RNA, 23 nt, Artificial Sequence
  Synthetic
ccgauguuccccgucuccauguc

SEQ ID NO: 33900 - RNA, 24 nt, Artificial Sequence
  Synthetic
cccgauguuccccgucuccauguc

SEQ ID NO: 33901 - RNA, 18 nt, Artificial Sequence
  Synthetic
caguggcaggaugcuuuc

SEQ ID NO: 33902 - RNA, 19 nt, Artificial Sequence
  Synthetic
ccaguggcaggaugcuuuc

SEQ ID NO: 33903 - RNA, 21 nt, Artificial Sequence
  Synthetic
ugccaguggcaggaugcuuuc

SEQ ID NO: 33904 - RNA, 22 nt, Artificial Sequence
  Synthetic
augccaguggcaggaugcuuuc

SEQ ID NO: 33905 - RNA, 23 nt, Artificial Sequence
  Synthetic
caugccaguggcaggaugcuuuc

SEQ ID NO: 33906 - RNA, 24 nt, Artificial Sequence
  Synthetic
ccaugccaguggcaggaugcuuuc

SEQ ID NO: 33907 - RNA, 19 nt, Artificial Sequence
  Synthetic
cggggaccgcggcccgcag

SEQ ID NO: 33908 - RNA, 20 nt, Artificial Sequence
  Synthetic
ccggggaccgcggcccgcag

SEQ ID NO: 33909 - RNA, 22 nt, Artificial Sequence
  Synthetic
agccggggaccgcggcccgcag

SEQ ID NO: 33910 - RNA, 23 nt, Artificial Sequence
  Synthetic
cagccggggaccgcggcccgcag

SEQ ID NO: 33911 - RNA, 24 nt, Artificial Sequence
  Synthetic
ccagccggggaccgcggcccgcag

SEQ ID NO: 33912 - RNA, 18 nt, Artificial Sequence
  Synthetic
acccgcggucucggggag

SEQ ID NO: 33913 - RNA, 19 nt, Artificial Sequence
  Synthetic
uacccgcggucucggggag

SEQ ID NO: 33914 - RNA, 20 nt, Artificial Sequence
  Synthetic
uuacccgcggucucggggag

SEQ ID NO: 33915 - RNA, 23 nt, Artificial Sequence
  Synthetic
ugguuacccgcggucucggggag

SEQ ID NO: 33916 - RNA, 18 nt, Artificial Sequence
  Synthetic
acuccgacgcgggggccg

SEQ ID NO: 33917 - RNA, 19 nt, Artificial Sequence
  Synthetic
cacuccgacgcgggggccg

SEQ ID NO: 33918 - RNA, 20 nt, Artificial Sequence
  Synthetic
ccacuccgacgcgggggccg

SEQ ID NO: 33919 - RNA, 21 nt, Artificial Sequence
  Synthetic
uccacuccgacgcgggggccg

SEQ ID NO: 33920 - RNA, 22 nt, Artificial Sequence
  Synthetic
uuccacuccgacgcgggggccg

SEQ ID NO: 33921 - RNA, 24 nt, Artificial Sequence
  Synthetic
uguuccacuccgacgcgggggccg

SEQ ID NO: 33922 - RNA, 18 nt, Artificial Sequence
  Synthetic
cuggcuccaugccagugg

SEQ ID NO: 33923 - RNA, 19 nt, Artificial Sequence
  Synthetic
ucuggcuccaugccagugg

SEQ ID NO: 33924 - RNA, 20 nt, Artificial Sequence
  Synthetic
uucuggcuccaugccagugg

SEQ ID NO: 33925 - RNA, 23 nt, Artificial Sequence
  Synthetic
ugguucuggcuccaugccagugg

SEQ ID NO: 33926 - RNA, 18 nt, Artificial Sequence
  Synthetic
caccgagcaugccugggu

SEQ ID NO: 33927 - RNA, 19 nt, Artificial Sequence
  Synthetic
ccaccgagcaugccugggu

SEQ ID NO: 33928 - RNA, 20 nt, Artificial Sequence
  Synthetic
accaccgagcaugccugggu

SEQ ID NO: 33929 - RNA, 21 nt, Artificial Sequence
  Synthetic
uaccaccgagcaugccugggu

SEQ ID NO: 33930 - RNA, 22 nt, Artificial Sequence
  Synthetic
auaccaccgagcaugccugggu

SEQ ID NO: 33931 - RNA, 23 nt, Artificial Sequence
  Synthetic
cauaccaccgagcaugccugggu

SEQ ID NO: 33932 - RNA, 24 nt, Artificial Sequence
  Synthetic
ucauaccaccgagcaugccugggu

SEQ ID NO: 33933 - RNA, 18 nt, Artificial Sequence
  Synthetic
gugucggggaggggaaaa

SEQ ID NO: 33934 - RNA, 19 nt, Artificial Sequence
  Synthetic
cgugucggggaggggaaaa

SEQ ID NO: 33935 - RNA, 20 nt, Artificial Sequence
  Synthetic
ccgugucggggaggggaaaa

SEQ ID NO: 33936 - RNA, 21 nt, Artificial Sequence
  Synthetic
uccgugucggggaggggaaaa

SEQ ID NO: 33937 - RNA, 22 nt, Artificial Sequence
  Synthetic
auccgugucggggaggggaaaa

SEQ ID NO: 33938 - RNA, 23 nt, Artificial Sequence
  Synthetic
aauccgugucggggaggggaaaa

SEQ ID NO: 33939 - RNA, 24 nt, Artificial Sequence
  Synthetic
caauccgugucggggaggggaaaa

SEQ ID NO: 33940 - RNA, 18 nt, Artificial Sequence
  Synthetic
cgggacggggcgcccaaa

SEQ ID NO: 33941 - RNA, 19 nt, Artificial Sequence
  Synthetic
gcgggacggggcgcccaaa

SEQ ID NO: 33942 - RNA, 20 nt, Artificial Sequence
  Synthetic
ggcgggacggggcgcccaaa

SEQ ID NO: 33943 - RNA, 21 nt, Artificial Sequence
  Synthetic
gggcgggacggggcgcccaaa

SEQ ID NO: 33944 - RNA, 22 nt, Artificial Sequence
  Synthetic
ggggcgggacggggcgcccaaa

SEQ ID NO: 33945 - RNA, 23 nt, Artificial Sequence
  Synthetic
cggggcgggacggggcgcccaaa

SEQ ID NO: 33946 - RNA, 24 nt, Artificial Sequence
  Synthetic
gcggggcgggacggggcgcccaaa

SEQ ID NO: 33947 - RNA, 18 nt, Artificial Sequence
  Synthetic
gggggggggagacagaaa

SEQ ID NO: 33948 - RNA, 19 nt, Artificial Sequence
  Synthetic
ggggggggggagacagaaa

SEQ ID NO: 33949 - RNA, 20 nt, Artificial Sequence
  Synthetic
gggggggggggagacagaaa

SEQ ID NO: 33950 - RNA, 21 nt, Artificial Sequence
  Synthetic
ugggggggggggagacagaaa

SEQ ID NO: 33951 - RNA, 22 nt, Artificial Sequence
  Synthetic
gugggggggggggagacagaaa

SEQ ID NO: 33952 - RNA, 23 nt, Artificial Sequence
  Synthetic
ggugggggggggggagacagaaa

SEQ ID NO: 33953 - RNA, 24 nt, Artificial Sequence
  Synthetic
gggugggggggggggagacagaaa

SEQ ID NO: 33954 - RNA, 18 nt, Artificial Sequence
  Synthetic
gcgggacggggcgcccaa

SEQ ID NO: 33955 - RNA, 19 nt, Artificial Sequence
  Synthetic
ggcgggacggggcgcccaa

SEQ ID NO: 33956 - RNA, 20 nt, Artificial Sequence
  Synthetic
gggcgggacggggcgcccaa

SEQ ID NO: 33957 - RNA, 21 nt, Artificial Sequence
  Synthetic
ggggcgggacggggcgcccaa

SEQ ID NO: 33958 - RNA, 22 nt, Artificial Sequence
  Synthetic
cggggcgggacggggcgcccaa

SEQ ID NO: 33959 - RNA, 23 nt, Artificial Sequence
  Synthetic
gcggggcgggacggggcgcccaa

SEQ ID NO: 33960 - RNA, 24 nt, Artificial Sequence
  Synthetic
ggcggggcgggacggggcgcccaa

SEQ ID NO: 33961 - RNA, 18 nt, Artificial Sequence
  Synthetic
acauggagacggggaaca

SEQ ID NO: 33962 - RNA, 19 nt, Artificial Sequence
  Synthetic
gacauggagacggggaaca

SEQ ID NO: 33963 - RNA, 20 nt, Artificial Sequence
  Synthetic
ggacauggagacggggaaca

SEQ ID NO: 33964 - RNA, 21 nt, Artificial Sequence
  Synthetic
uggacauggagacggggaaca

SEQ ID NO: 33965 - RNA, 22 nt, Artificial Sequence
  Synthetic
cuggacauggagacggggaaca

SEQ ID NO: 33966 - RNA, 23 nt, Artificial Sequence
  Synthetic
ccuggacauggagacggggaaca

SEQ ID NO: 33967 - RNA, 24 nt, Artificial Sequence
  Synthetic
uccuggacauggagacggggaaca

SEQ ID NO: 33968 - RNA, 18 nt, Artificial Sequence
  Synthetic
uggccucuggccgccaca

SEQ ID NO: 33969 - RNA, 19 nt, Artificial Sequence
  Synthetic
cuggccucuggccgccaca

SEQ ID NO: 33970 - RNA, 20 nt, Artificial Sequence
  Synthetic
ccuggccucuggccgccaca

SEQ ID NO: 33971 - RNA, 21 nt, Artificial Sequence
  Synthetic
accuggccucuggccgccaca

SEQ ID NO: 33972 - RNA, 22 nt, Artificial Sequence
  Synthetic
gaccuggccucuggccgccaca

SEQ ID NO: 33973 - RNA, 23 nt, Artificial Sequence
  Synthetic
ugaccuggccucuggccgccaca

SEQ ID NO: 33974 - RNA, 24 nt, Artificial Sequence
  Synthetic
cugaccuggccucuggccgccaca

SEQ ID NO: 33975 - RNA, 18 nt, Artificial Sequence
  Synthetic
gccugcccauccuggaca

SEQ ID NO: 33976 - RNA, 19 nt, Artificial Sequence
  Synthetic
ugccugcccauccuggaca

SEQ ID NO: 33977 - RNA, 20 nt, Artificial Sequence
  Synthetic
cugccugcccauccuggaca

SEQ ID NO: 33978 - RNA, 21 nt, Artificial Sequence
  Synthetic
acugccugcccauccuggaca

SEQ ID NO: 33979 - RNA, 22 nt, Artificial Sequence
  Synthetic
gacugccugcccauccuggaca

SEQ ID NO: 33980 - RNA, 23 nt, Artificial Sequence
  Synthetic
ggacugccugcccauccuggaca

SEQ ID NO: 33981 - RNA, 24 nt, Artificial Sequence
  Synthetic
gggacugccugcccauccuggaca

SEQ ID NO: 33982 - RNA, 18 nt, Artificial Sequence
  Synthetic
aggcucugguguuaacca

SEQ ID NO: 33983 - RNA, 19 nt, Artificial Sequence
  Synthetic
caggcucugguguuaacca

SEQ ID NO: 33984 - RNA, 20 nt, Artificial Sequence
  Synthetic
gcaggcucugguguuaacca

SEQ ID NO: 33985 - RNA, 21 nt, Artificial Sequence
  Synthetic
ggcaggcucugguguuaacca

SEQ ID NO: 33986 - RNA, 22 nt, Artificial Sequence
  Synthetic
gggcaggcucugguguuaacca

SEQ ID NO: 33987 - RNA, 23 nt, Artificial Sequence
  Synthetic
ugggcaggcucugguguuaacca

SEQ ID NO: 33988 - RNA, 24 nt, Artificial Sequence
  Synthetic
uugggcaggcucugguguuaacca

SEQ ID NO: 33989 - RNA, 18 nt, Artificial Sequence
  Synthetic
cccgugguccggggagca

SEQ ID NO: 33990 - RNA, 19 nt, Artificial Sequence
  Synthetic
acccgugguccggggagca

SEQ ID NO: 33991 - RNA, 20 nt, Artificial Sequence
  Synthetic
cacccgugguccggggagca

SEQ ID NO: 33992 - RNA, 21 nt, Artificial Sequence
  Synthetic
gcacccgugguccggggagca

SEQ ID NO: 33993 - RNA, 22 nt, Artificial Sequence
  Synthetic
ggcacccgugguccggggagca

SEQ ID NO: 33994 - RNA, 23 nt, Artificial Sequence
  Synthetic
cggcacccgugguccggggagca

SEQ ID NO: 33995 - RNA, 24 nt, Artificial Sequence
  Synthetic
ucggcacccgugguccggggagca

SEQ ID NO: 33996 - RNA, 18 nt, Artificial Sequence
  Synthetic
agcauccugccacuggca

SEQ ID NO: 33997 - RNA, 19 nt, Artificial Sequence
  Synthetic
aagcauccugccacuggca

SEQ ID NO: 33998 - RNA, 20 nt, Artificial Sequence
  Synthetic
aaagcauccugccacuggca

SEQ ID NO: 33999 - RNA, 21 nt, Artificial Sequence
  Synthetic
gaaagcauccugccacuggca

SEQ ID NO: 34000 - RNA, 22 nt, Artificial Sequence
  Synthetic
cgaaagcauccugccacuggca

SEQ ID NO: 34001 - RNA, 23 nt, Artificial Sequence
  Synthetic
ccgaaagcauccugccacuggca

SEQ ID NO: 34002 - RNA, 24 nt, Artificial Sequence
  Synthetic
cccgaaagcauccugccacuggca

SEQ ID NO: 34003 - RNA, 18 nt, Artificial Sequence
  Synthetic
ggugcagccagagaauca

SEQ ID NO: 34004 - RNA, 19 nt, Artificial Sequence
  Synthetic
cggugcagccagagaauca

SEQ ID NO: 34005 - RNA, 20 nt, Artificial Sequence
  Synthetic
gcggugcagccagagaauca

SEQ ID NO: 34006 - RNA, 21 nt, Artificial Sequence
  Synthetic
ugcggugcagccagagaauca

SEQ ID NO: 34007 - RNA, 22 nt, Artificial Sequence
  Synthetic
augcggugcagccagagaauca

SEQ ID NO: 34008 - RNA, 23 nt, Artificial Sequence
  Synthetic
aaugcggugcagccagagaauca

SEQ ID NO: 34009 - RNA, 24 nt, Artificial Sequence
  Synthetic
gaaugcggugcagccagagaauca

SEQ ID NO: 34010 - RNA, 18 nt, Artificial Sequence
  Synthetic
acgugaacaagacuauca

SEQ ID NO: 34011 - RNA, 19 nt, Artificial Sequence
  Synthetic
uacgugaacaagacuauca

SEQ ID NO: 34012 - RNA, 20 nt, Artificial Sequence
  Synthetic
uuacgugaacaagacuauca

SEQ ID NO: 34013 - RNA, 21 nt, Artificial Sequence
  Synthetic
cuuacgugaacaagacuauca

SEQ ID NO: 34014 - RNA, 22 nt, Artificial Sequence
  Synthetic
ccuuacgugaacaagacuauca

SEQ ID NO: 34015 - RNA, 23 nt, Artificial Sequence
  Synthetic
gccuuacgugaacaagacuauca

SEQ ID NO: 34016 - RNA, 24 nt, Artificial Sequence
  Synthetic
cgccuuacgugaacaagacuauca

SEQ ID NO: 34017 - RNA, 18 nt, Artificial Sequence
  Synthetic
ugguccugguggaccaga

SEQ ID NO: 34018 - RNA, 19 nt, Artificial Sequence
  Synthetic
gugguccugguggaccaga

SEQ ID NO: 34019 - RNA, 20 nt, Artificial Sequence
  Synthetic
cgugguccugguggaccaga

SEQ ID NO: 34020 - RNA, 21 nt, Artificial Sequence
  Synthetic
acgugguccugguggaccaga

SEQ ID NO: 34021 - RNA, 22 nt, Artificial Sequence
  Synthetic
uacgugguccugguggaccaga

SEQ ID NO: 34022 - RNA, 23 nt, Artificial Sequence
  Synthetic
guacgugguccugguggaccaga

SEQ ID NO: 34023 - RNA, 24 nt, Artificial Sequence
  Synthetic
cguacgugguccugguggaccaga

SEQ ID NO: 34024 - RNA, 18 nt, Artificial Sequence
  Synthetic
gggugggggggggggaga

SEQ ID NO: 34025 - RNA, 19 nt, Artificial Sequence
  Synthetic
ggggugggggggggggaga

SEQ ID NO: 34026 - RNA, 20 nt, Artificial Sequence
  Synthetic
aggggugggggggggggaga

SEQ ID NO: 34027 - RNA, 21 nt, Artificial Sequence
  Synthetic
gaggggugggggggggggaga

SEQ ID NO: 34028 - RNA, 22 nt, Artificial Sequence
  Synthetic
ggaggggugggggggggggaga

SEQ ID NO: 34029 - RNA, 23 nt, Artificial Sequence
  Synthetic
cggaggggugggggggggggaga

SEQ ID NO: 34030 - RNA, 24 nt, Artificial Sequence
  Synthetic
gcggaggggugggggggggggaga

SEQ ID NO: 34031 - RNA, 18 nt, Artificial Sequence
  Synthetic
ccauccuggacauggaga

SEQ ID NO: 34032 - RNA, 19 nt, Artificial Sequence
  Synthetic
cccauccuggacauggaga

SEQ ID NO: 34033 - RNA, 20 nt, Artificial Sequence
  Synthetic
gcccauccuggacauggaga

SEQ ID NO: 34034 - RNA, 21 nt, Artificial Sequence
  Synthetic
ugcccauccuggacauggaga

SEQ ID NO: 34035 - RNA, 22 nt, Artificial Sequence
  Synthetic
cugcccauccuggacauggaga

SEQ ID NO: 34036 - RNA, 23 nt, Artificial Sequence
  Synthetic
ccugcccauccuggacauggaga

SEQ ID NO: 34037 - RNA, 24 nt, Artificial Sequence
  Synthetic
gccugcccauccuggacauggaga

SEQ ID NO: 34038 - RNA, 18 nt, Artificial Sequence
  Synthetic
ggcgucgacccgggacga

SEQ ID NO: 34039 - RNA, 19 nt, Artificial Sequence
  Synthetic
gggcgucgacccgggacga

SEQ ID NO: 34040 - RNA, 20 nt, Artificial Sequence
  Synthetic
ggggcgucgacccgggacga

SEQ ID NO: 34041 - RNA, 21 nt, Artificial Sequence
  Synthetic
gggggcgucgacccgggacga

SEQ ID NO: 34042 - RNA, 22 nt, Artificial Sequence
  Synthetic
agggggcgucgacccgggacga

SEQ ID NO: 34043 - RNA, 23 nt, Artificial Sequence
  Synthetic
cagggggcgucgacccgggacga

SEQ ID NO: 34044 - RNA, 24 nt, Artificial Sequence
  Synthetic
gcagggggcgucgacccgggacga

SEQ ID NO: 34045 - RNA, 18 nt, Artificial Sequence
  Synthetic
cuauagggcaacaaagga

SEQ ID NO: 34046 - RNA, 19 nt, Artificial Sequence
  Synthetic
acuauagggcaacaaagga

SEQ ID NO: 34047 - RNA, 20 nt, Artificial Sequence
  Synthetic
cacuauagggcaacaaagga

SEQ ID NO: 34048 - RNA, 21 nt, Artificial Sequence
  Synthetic
acacuauagggcaacaaagga

SEQ ID NO: 34049 - RNA, 22 nt, Artificial Sequence
  Synthetic
uacacuauagggcaacaaagga

SEQ ID NO: 34050 - RNA, 23 nt, Artificial Sequence
  Synthetic
cuacacuauagggcaacaaagga

SEQ ID NO: 34051 - RNA, 24 nt, Artificial Sequence
  Synthetic
acuacacuauagggcaacaaagga

SEQ ID NO: 34052 - RNA, 18 nt, Artificial Sequence
  Synthetic
gcucggugguaugaagga

SEQ ID NO: 34053 - RNA, 19 nt, Artificial Sequence
  Synthetic
ugcucggugguaugaagga

SEQ ID NO: 34054 - RNA, 20 nt, Artificial Sequence
  Synthetic
augcucggugguaugaagga

SEQ ID NO: 34055 - RNA, 21 nt, Artificial Sequence
  Synthetic
caugcucggugguaugaagga

SEQ ID NO: 34056 - RNA, 22 nt, Artificial Sequence
  Synthetic
gcaugcucggugguaugaagga

SEQ ID NO: 34057 - RNA, 23 nt, Artificial Sequence
  Synthetic
ggcaugcucggugguaugaagga

SEQ ID NO: 34058 - RNA, 24 nt, Artificial Sequence
  Synthetic
aggcaugcucggugguaugaagga

SEQ ID NO: 34059 - RNA, 18 nt, Artificial Sequence
  Synthetic
gacggcccccgcgucgga

SEQ ID NO: 34060 - RNA, 19 nt, Artificial Sequence
  Synthetic
cgacggcccccgcgucgga

SEQ ID NO: 34061 - RNA, 20 nt, Artificial Sequence
  Synthetic
ccgacggcccccgcgucgga

SEQ ID NO: 34062 - RNA, 21 nt, Artificial Sequence
  Synthetic
cccgacggcccccgcgucgga

SEQ ID NO: 34063 - RNA, 22 nt, Artificial Sequence
  Synthetic
acccgacggcccccgcgucgga

SEQ ID NO: 34064 - RNA, 23 nt, Artificial Sequence
  Synthetic
uacccgacggcccccgcgucgga

SEQ ID NO: 34065 - RNA, 24 nt, Artificial Sequence
  Synthetic
guacccgacggcccccgcgucgga

SEQ ID NO: 34066 - RNA, 18 nt, Artificial Sequence
  Synthetic
agggguggcggggcggga

SEQ ID NO: 34067 - RNA, 19 nt, Artificial Sequence
  Synthetic
gagggguggcggggcggga

SEQ ID NO: 34068 - RNA, 20 nt, Artificial Sequence
  Synthetic
ggagggguggcggggcggga

SEQ ID NO: 34069 - RNA, 21 nt, Artificial Sequence
  Synthetic
gggagggguggcggggcggga

SEQ ID NO: 34070 - RNA, 22 nt, Artificial Sequence
  Synthetic
ugggagggguggcggggcggga

SEQ ID NO: 34071 - RNA, 23 nt, Artificial Sequence
  Synthetic
augggagggguggcggggcggga

SEQ ID NO: 34072 - RNA, 24 nt, Artificial Sequence
  Synthetic
gaugggagggguggcggggcggga

SEQ ID NO: 34073 - RNA, 18 nt, Artificial Sequence
  Synthetic
gccaauccgugucgggga

SEQ ID NO: 34074 - RNA, 19 nt, Artificial Sequence
  Synthetic
agccaauccgugucgggga

SEQ ID NO: 34075 - RNA, 20 nt, Artificial Sequence
  Synthetic
cagccaauccgugucgggga

SEQ ID NO: 34076 - RNA, 21 nt, Artificial Sequence
  Synthetic
ccagccaauccgugucgggga

SEQ ID NO: 34077 - RNA, 22 nt, Artificial Sequence
  Synthetic
accagccaauccgugucgggga

SEQ ID NO: 34078 - RNA, 23 nt, Artificial Sequence
  Synthetic
caccagccaauccgugucgggga

SEQ ID NO: 34079 - RNA, 24 nt, Artificial Sequence
  Synthetic
acaccagccaauccgugucgggga

SEQ ID NO: 34080 - RNA, 18 nt, Artificial Sequence
  Synthetic
cccccguguuugugggga

SEQ ID NO: 34081 - RNA, 19 nt, Artificial Sequence
  Synthetic
ccccccguguuugugggga

SEQ ID NO: 34082 - RNA, 20 nt, Artificial Sequence
  Synthetic
gccccccguguuugugggga

SEQ ID NO: 34083 - RNA, 21 nt, Artificial Sequence
  Synthetic
cgccccccguguuugugggga

SEQ ID NO: 34084 - RNA, 22 nt, Artificial Sequence
  Synthetic
acgccccccguguuugugggga

SEQ ID NO: 34085 - RNA, 23 nt, Artificial Sequence
  Synthetic
gacgccccccguguuugugggga

SEQ ID NO: 34086 - RNA, 24 nt, Artificial Sequence
  Synthetic
ggacgccccccguguuugugggga

SEQ ID NO: 34087 - RNA, 18 nt, Artificial Sequence
  Synthetic
ucgcggggaugcguggga

SEQ ID NO: 34088 - RNA, 19 nt, Artificial Sequence
  Synthetic
aucgcggggaugcguggga

SEQ ID NO: 34089 - RNA, 20 nt, Artificial Sequence
  Synthetic
uaucgcggggaugcguggga

SEQ ID NO: 34090 - RNA, 21 nt, Artificial Sequence
  Synthetic
guaucgcggggaugcguggga

SEQ ID NO: 34091 - RNA, 22 nt, Artificial Sequence
  Synthetic
uguaucgcggggaugcguggga

SEQ ID NO: 34092 - RNA, 23 nt, Artificial Sequence
  Synthetic
auguaucgcggggaugcguggga

SEQ ID NO: 34093 - RNA, 24 nt, Artificial Sequence
  Synthetic
gauguaucgcggggaugcguggga

SEQ ID NO: 34094 - RNA, 18 nt, Artificial Sequence
  Synthetic
gagugggggugcguggga

SEQ ID NO: 34095 - RNA, 19 nt, Artificial Sequence
  Synthetic
ggagugggggugcguggga

SEQ ID NO: 34096 - RNA, 20 nt, Artificial Sequence
  Synthetic
gggagugggggugcguggga

SEQ ID NO: 34097 - RNA, 21 nt, Artificial Sequence
  Synthetic
ugggagugggggugcguggga

SEQ ID NO: 34098 - RNA, 22 nt, Artificial Sequence
  Synthetic
gugggagugggggugcguggga

SEQ ID NO: 34099 - RNA, 23 nt, Artificial Sequence
  Synthetic
cgugggagugggggugcguggga

SEQ ID NO: 34100 - RNA, 24 nt, Artificial Sequence
  Synthetic
gcgugggagugggggugcguggga

SEQ ID NO: 34101 - RNA, 18 nt, Artificial Sequence
  Synthetic
gcaugcucggugguauga

SEQ ID NO: 34102 - RNA, 19 nt, Artificial Sequence
  Synthetic
ggcaugcucggugguauga

SEQ ID NO: 34103 - RNA, 20 nt, Artificial Sequence
  Synthetic
aggcaugcucggugguauga

SEQ ID NO: 34104 - RNA, 21 nt, Artificial Sequence
  Synthetic
caggcaugcucggugguauga

SEQ ID NO: 34105 - RNA, 22 nt, Artificial Sequence
  Synthetic
ccaggcaugcucggugguauga

SEQ ID NO: 34106 - RNA, 23 nt, Artificial Sequence
  Synthetic
cccaggcaugcucggugguauga

SEQ ID NO: 34107 - RNA, 24 nt, Artificial Sequence
  Synthetic
acccaggcaugcucggugguauga

SEQ ID NO: 34108 - RNA, 18 nt, Artificial Sequence
  Synthetic
ggacgagggaaaacaaua

SEQ ID NO: 34109 - RNA, 19 nt, Artificial Sequence
  Synthetic
gggacgagggaaaacaaua

SEQ ID NO: 34110 - RNA, 20 nt, Artificial Sequence
  Synthetic
cgggacgagggaaaacaaua

SEQ ID NO: 34111 - RNA, 21 nt, Artificial Sequence
  Synthetic
ccgggacgagggaaaacaaua

SEQ ID NO: 34112 - RNA, 22 nt, Artificial Sequence
  Synthetic
cccgggacgagggaaaacaaua

SEQ ID NO: 34113 - RNA, 23 nt, Artificial Sequence
  Synthetic
acccgggacgagggaaaacaaua

SEQ ID NO: 34114 - RNA, 24 nt, Artificial Sequence
  Synthetic
gacccgggacgagggaaaacaaua

SEQ ID NO: 34115 - RNA, 18 nt, Artificial Sequence
  Synthetic
gggggguuaacuacacua

SEQ ID NO: 34116 - RNA, 19 nt, Artificial Sequence
  Synthetic
ggggggguuaacuacacua

SEQ ID NO: 34117 - RNA, 20 nt, Artificial Sequence
  Synthetic
gggggggguuaacuacacua

SEQ ID NO: 34118 - RNA, 21 nt, Artificial Sequence
  Synthetic
cgggggggguuaacuacacua

SEQ ID NO: 34119 - RNA, 22 nt, Artificial Sequence
  Synthetic
gcgggggggguuaacuacacua

SEQ ID NO: 34120 - RNA, 23 nt, Artificial Sequence
  Synthetic
ggcgggggggguuaacuacacua

SEQ ID NO: 34121 - RNA, 24 nt, Artificial Sequence
  Synthetic
gggcgggggggguuaacuacacua

SEQ ID NO: 34122 - RNA, 18 nt, Artificial Sequence
  Synthetic
uucgaccagggcacccua

SEQ ID NO: 34123 - RNA, 19 nt, Artificial Sequence
  Synthetic
guucgaccagggcacccua

SEQ ID NO: 34124 - RNA, 20 nt, Artificial Sequence
  Synthetic
uguucgaccagggcacccua

SEQ ID NO: 34125 - RNA, 21 nt, Artificial Sequence
  Synthetic
cuguucgaccagggcacccua

SEQ ID NO: 34126 - RNA, 22 nt, Artificial Sequence
  Synthetic
gcuguucgaccagggcacccua

SEQ ID NO: 34127 - RNA, 23 nt, Artificial Sequence
  Synthetic
ugcuguucgaccagggcacccua

SEQ ID NO: 34128 - RNA, 24 nt, Artificial Sequence
  Synthetic
augcuguucgaccagggcacccua

SEQ ID NO: 34129 - RNA, 18 nt, Artificial Sequence
  Synthetic
ggggggggagacagaaac

SEQ ID NO: 34130 - RNA, 19 nt, Artificial Sequence
  Synthetic
gggggggggagacagaaac

SEQ ID NO: 34131 - RNA, 20 nt, Artificial Sequence
  Synthetic
ggggggggggagacagaaac

SEQ ID NO: 34132 - RNA, 21 nt, Artificial Sequence
  Synthetic
gggggggggggagacagaaac

SEQ ID NO: 34133 - RNA, 22 nt, Artificial Sequence
  Synthetic
ugggggggggggagacagaaac

SEQ ID NO: 34134 - RNA, 23 nt, Artificial Sequence
  Synthetic
gugggggggggggagacagaaac

SEQ ID NO: 34135 - RNA, 24 nt, Artificial Sequence
  Synthetic
ggugggggggggggagacagaaac

SEQ ID NO: 34136 - RNA, 18 nt, Artificial Sequence
  Synthetic
gcccggaagacgcgccac

SEQ ID NO: 34137 - RNA, 19 nt, Artificial Sequence
  Synthetic
ugcccggaagacgcgccac

SEQ ID NO: 34138 - RNA, 20 nt, Artificial Sequence
  Synthetic
gugcccggaagacgcgccac

SEQ ID NO: 34139 - RNA, 21 nt, Artificial Sequence
  Synthetic
ugugcccggaagacgcgccac

SEQ ID NO: 34140 - RNA, 22 nt, Artificial Sequence
  Synthetic
gugugcccggaagacgcgccac

SEQ ID NO: 34141 - RNA, 23 nt, Artificial Sequence
  Synthetic
agugugcccggaagacgcgccac

SEQ ID NO: 34142 - RNA, 24 nt, Artificial Sequence
  Synthetic
aagugugcccggaagacgcgccac

SEQ ID NO: 34143 - RNA, 18 nt, Artificial Sequence
  Synthetic
gugcagccagagaaucac

SEQ ID NO: 34144 - RNA, 19 nt, Artificial Sequence
  Synthetic
ggugcagccagagaaucac

SEQ ID NO: 34145 - RNA, 20 nt, Artificial Sequence
  Synthetic
cggugcagccagagaaucac

SEQ ID NO: 34146 - RNA, 21 nt, Artificial Sequence
  Synthetic
gcggugcagccagagaaucac

SEQ ID NO: 34147 - RNA, 22 nt, Artificial Sequence
  Synthetic
ugcggugcagccagagaaucac

SEQ ID NO: 34148 - RNA, 23 nt, Artificial Sequence
  Synthetic
augcggugcagccagagaaucac

SEQ ID NO: 34149 - RNA, 24 nt, Artificial Sequence
  Synthetic
aaugcggugcagccagagaaucac

SEQ ID NO: 34150 - RNA, 18 nt, Artificial Sequence
  Synthetic
cgugaacaagacuaucac

SEQ ID NO: 34151 - RNA, 19 nt, Artificial Sequence
  Synthetic
acgugaacaagacuaucac

SEQ ID NO: 34152 - RNA, 20 nt, Artificial Sequence
  Synthetic
uacgugaacaagacuaucac

SEQ ID NO: 34153 - RNA, 21 nt, Artificial Sequence
  Synthetic
uuacgugaacaagacuaucac

SEQ ID NO: 34154 - RNA, 22 nt, Artificial Sequence
  Synthetic
cuuacgugaacaagacuaucac

SEQ ID NO: 34155 - RNA, 23 nt, Artificial Sequence
  Synthetic
ccuuacgugaacaagacuaucac

SEQ ID NO: 34156 - RNA, 24 nt, Artificial Sequence
  Synthetic
gccuuacgugaacaagacuaucac

SEQ ID NO: 34157 - RNA, 18 nt, Artificial Sequence
  Synthetic
aggggaaaagugaaagac

SEQ ID NO: 34158 - RNA, 19 nt, Artificial Sequence
  Synthetic
gaggggaaaagugaaagac

SEQ ID NO: 34159 - RNA, 20 nt, Artificial Sequence
  Synthetic
ggaggggaaaagugaaagac

SEQ ID NO: 34160 - RNA, 21 nt, Artificial Sequence
  Synthetic
gggaggggaaaagugaaagac

SEQ ID NO: 34161 - RNA, 22 nt, Artificial Sequence
  Synthetic
ggggaggggaaaagugaaagac

SEQ ID NO: 34162 - RNA, 23 nt, Artificial Sequence
  Synthetic
cggggaggggaaaagugaaagac

SEQ ID NO: 34163 - RNA, 24 nt, Artificial Sequence
  Synthetic
ucggggaggggaaaagugaaagac

SEQ ID NO: 34164 - RNA, 18 nt, Artificial Sequence
  Synthetic
gguccugguggaccagac

SEQ ID NO: 34165 - RNA, 19 nt, Artificial Sequence
  Synthetic
ugguccugguggaccagac

SEQ ID NO: 34166 - RNA, 20 nt, Artificial Sequence
  Synthetic
gugguccugguggaccagac

SEQ ID NO: 34167 - RNA, 21 nt, Artificial Sequence
  Synthetic
cgugguccugguggaccagac

SEQ ID NO: 34168 - RNA, 22 nt, Artificial Sequence
  Synthetic
acgugguccugguggaccagac

SEQ ID NO: 34169 - RNA, 23 nt, Artificial Sequence
  Synthetic
uacgugguccugguggaccagac

SEQ ID NO: 34170 - RNA, 24 nt, Artificial Sequence
  Synthetic
guacgugguccugguggaccagac

SEQ ID NO: 34171 - RNA, 18 nt, Artificial Sequence
  Synthetic
cagagaaucacaggagac

SEQ ID NO: 34172 - RNA, 19 nt, Artificial Sequence
  Synthetic
ccagagaaucacaggagac

SEQ ID NO: 34173 - RNA, 20 nt, Artificial Sequence
  Synthetic
gccagagaaucacaggagac

SEQ ID NO: 34174 - RNA, 21 nt, Artificial Sequence
  Synthetic
agccagagaaucacaggagac

SEQ ID NO: 34175 - RNA, 22 nt, Artificial Sequence
  Synthetic
cagccagagaaucacaggagac

SEQ ID NO: 34176 - RNA, 23 nt, Artificial Sequence
  Synthetic
gcagccagagaaucacaggagac

SEQ ID NO: 34177 - RNA, 24 nt, Artificial Sequence
  Synthetic
ugcagccagagaaucacaggagac

SEQ ID NO: 34178 - RNA, 18 nt, Artificial Sequence
  Synthetic
cauccuggacauggagac

SEQ ID NO: 34179 - RNA, 19 nt, Artificial Sequence
  Synthetic
ccauccuggacauggagac

SEQ ID NO: 34180 - RNA, 20 nt, Artificial Sequence
  Synthetic
cccauccuggacauggagac

SEQ ID NO: 34181 - RNA, 21 nt, Artificial Sequence
  Synthetic
gcccauccuggacauggagac

SEQ ID NO: 34182 - RNA, 22 nt, Artificial Sequence
  Synthetic
ugcccauccuggacauggagac

SEQ ID NO: 34183 - RNA, 23 nt, Artificial Sequence
  Synthetic
cugcccauccuggacauggagac

SEQ ID NO: 34184 - RNA, 24 nt, Artificial Sequence
  Synthetic
ccugcccauccuggacauggagac

SEQ ID NO: 34185 - RNA, 18 nt, Artificial Sequence
  Synthetic
ggagcagggggcgucgac

SEQ ID NO: 34186 - RNA, 19 nt, Artificial Sequence
  Synthetic
gggagcagggggcgucgac

SEQ ID NO: 34187 - RNA, 20 nt, Artificial Sequence
  Synthetic
ggggagcagggggcgucgac

SEQ ID NO: 34188 - RNA, 21 nt, Artificial Sequence
  Synthetic
cggggagcagggggcgucgac

SEQ ID NO: 34189 - RNA, 22 nt, Artificial Sequence
  Synthetic
ccggggagcagggggcgucgac

SEQ ID NO: 34190 - RNA, 23 nt, Artificial Sequence
  Synthetic
uccggggagcagggggcgucgac

SEQ ID NO: 34191 - RNA, 24 nt, Artificial Sequence
  Synthetic
guccggggagcagggggcgucgac

SEQ ID NO: 34192 - RNA, 18 nt, Artificial Sequence
  Synthetic
gggaacaugcuguucgac

SEQ ID NO: 34193 - RNA, 19 nt, Artificial Sequence
  Synthetic
ggggaacaugcuguucgac

SEQ ID NO: 34194 - RNA, 20 nt, Artificial Sequence
  Synthetic
uggggaacaugcuguucgac

SEQ ID NO: 34195 - RNA, 21 nt, Artificial Sequence
  Synthetic
guggggaacaugcuguucgac

SEQ ID NO: 34196 - RNA, 22 nt, Artificial Sequence
  Synthetic
cguggggaacaugcuguucgac

SEQ ID NO: 34197 - RNA, 23 nt, Artificial Sequence
  Synthetic
ccguggggaacaugcuguucgac

SEQ ID NO: 34198 - RNA, 24 nt, Artificial Sequence
  Synthetic
cccguggggaacaugcuguucgac

SEQ ID NO: 34199 - RNA, 18 nt, Artificial Sequence
  Synthetic
ggggcgucgacccgggac

SEQ ID NO: 34200 - RNA, 19 nt, Artificial Sequence
  Synthetic
gggggcgucgacccgggac

SEQ ID NO: 34201 - RNA, 20 nt, Artificial Sequence
  Synthetic
agggggcgucgacccgggac

SEQ ID NO: 34202 - RNA, 21 nt, Artificial Sequence
  Synthetic
cagggggcgucgacccgggac

SEQ ID NO: 34203 - RNA, 22 nt, Artificial Sequence
  Synthetic
gcagggggcgucgacccgggac

SEQ ID NO: 34204 - RNA, 23 nt, Artificial Sequence
  Synthetic
agcagggggcgucgacccgggac

SEQ ID NO: 34205 - RNA, 24 nt, Artificial Sequence
  Synthetic
gagcagggggcgucgacccgggac

SEQ ID NO: 34206 - RNA, 18 nt, Artificial Sequence
  Synthetic
uagagaccgccgggggac

SEQ ID NO: 34207 - RNA, 19 nt, Artificial Sequence
  Synthetic
uuagagaccgccgggggac

SEQ ID NO: 34208 - RNA, 20 nt, Artificial Sequence
  Synthetic
cuuagagaccgccgggggac

SEQ ID NO: 34209 - RNA, 21 nt, Artificial Sequence
  Synthetic
ucuuagagaccgccgggggac

SEQ ID NO: 34210 - RNA, 22 nt, Artificial Sequence
  Synthetic
uucuuagagaccgccgggggac

SEQ ID NO: 34211 - RNA, 23 nt, Artificial Sequence
  Synthetic
cuucuuagagaccgccgggggac

SEQ ID NO: 34212 - RNA, 24 nt, Artificial Sequence
  Synthetic
gcuucuuagagaccgccgggggac

SEQ ID NO: 34213 - RNA, 18 nt, Artificial Sequence
  Synthetic
ugccugcccauccuggac

SEQ ID NO: 34214 - RNA, 19 nt, Artificial Sequence
  Synthetic
cugccugcccauccuggac

SEQ ID NO: 34215 - RNA, 20 nt, Artificial Sequence
  Synthetic
acugccugcccauccuggac

SEQ ID NO: 34216 - RNA, 21 nt, Artificial Sequence
  Synthetic
gacugccugcccauccuggac

SEQ ID NO: 34217 - RNA, 22 nt, Artificial Sequence
  Synthetic
ggacugccugcccauccuggac

SEQ ID NO: 34218 - RNA, 23 nt, Artificial Sequence
  Synthetic
gggacugccugcccauccuggac

SEQ ID NO: 34219 - RNA, 24 nt, Artificial Sequence
  Synthetic
ggggacugccugcccauccuggac

SEQ ID NO: 34220 - RNA, 18 nt, Artificial Sequence
  Synthetic
gucgcccugucgccuuac

SEQ ID NO: 34221 - RNA, 19 nt, Artificial Sequence
  Synthetic
ggucgcccugucgccuuac

SEQ ID NO: 34222 - RNA, 20 nt, Artificial Sequence
  Synthetic
uggucgcccugucgccuuac

SEQ ID NO: 34223 - RNA, 21 nt, Artificial Sequence
  Synthetic
guggucgcccugucgccuuac

SEQ ID NO: 34224 - RNA, 22 nt, Artificial Sequence
  Synthetic
cguggucgcccugucgccuuac

SEQ ID NO: 34225 - RNA, 23 nt, Artificial Sequence
  Synthetic
gcguggucgcccugucgccuuac

SEQ ID NO: 34226 - RNA, 24 nt, Artificial Sequence
  Synthetic
agcguggucgcccugucgccuuac

SEQ ID NO: 34227 - RNA, 18 nt, Artificial Sequence
  Synthetic
gagcagggggcgucgacc

SEQ ID NO: 34228 - RNA, 19 nt, Artificial Sequence
  Synthetic
ggagcagggggcgucgacc

SEQ ID NO: 34229 - RNA, 20 nt, Artificial Sequence
  Synthetic
gggagcagggggcgucgacc

SEQ ID NO: 34230 - RNA, 21 nt, Artificial Sequence
  Synthetic
ggggagcagggggcgucgacc

SEQ ID NO: 34231 - RNA, 22 nt, Artificial Sequence
  Synthetic
cggggagcagggggcgucgacc

SEQ ID NO: 34232 - RNA, 23 nt, Artificial Sequence
  Synthetic
ccggggagcagggggcgucgacc

SEQ ID NO: 34233 - RNA, 24 nt, Artificial Sequence
  Synthetic
uccggggagcagggggcgucgacc

SEQ ID NO: 34234 - RNA, 18 nt, Artificial Sequence
  Synthetic
agccucuggaugaccccc

SEQ ID NO: 34235 - RNA, 19 nt, Artificial Sequence
  Synthetic
cagccucuggaugaccccc

SEQ ID NO: 34236 - RNA, 20 nt, Artificial Sequence
  Synthetic
acagccucuggaugaccccc

SEQ ID NO: 34237 - RNA, 21 nt, Artificial Sequence
  Synthetic
aacagccucuggaugaccccc

SEQ ID NO: 34238 - RNA, 22 nt, Artificial Sequence
  Synthetic
gaacagccucuggaugaccccc

SEQ ID NO: 34239 - RNA, 23 nt, Artificial Sequence
  Synthetic
ggaacagccucuggaugaccccc

SEQ ID NO: 34240 - RNA, 24 nt, Artificial Sequence
  Synthetic
uggaacagccucuggaugaccccc

SEQ ID NO: 34241 - RNA, 18 nt, Artificial Sequence
  Synthetic
acuuccggggccgucccc

SEQ ID NO: 34242 - RNA, 19 nt, Artificial Sequence
  Synthetic
gacuuccggggccgucccc

SEQ ID NO: 34243 - RNA, 20 nt, Artificial Sequence
  Synthetic
agacuuccggggccgucccc

SEQ ID NO: 34244 - RNA, 21 nt, Artificial Sequence
  Synthetic
gagacuuccggggccgucccc

SEQ ID NO: 34245 - RNA, 22 nt, Artificial Sequence
  Synthetic
ggagacuuccggggccgucccc

SEQ ID NO: 34246 - RNA, 23 nt, Artificial Sequence
  Synthetic
cggagacuuccggggccgucccc

SEQ ID NO: 34247 - RNA, 24 nt, Artificial Sequence
  Synthetic
gcggagacuuccggggccgucccc

SEQ ID NO: 34248 - RNA, 18 nt, Artificial Sequence
  Synthetic
ugcuucuuagagaccgcc

SEQ ID NO: 34249 - RNA, 19 nt, Artificial Sequence
  Synthetic
gugcuucuuagagaccgcc

SEQ ID NO: 34250 - RNA, 20 nt, Artificial Sequence
  Synthetic
ggugcuucuuagagaccgcc

SEQ ID NO: 34251 - RNA, 21 nt, Artificial Sequence
  Synthetic
cggugcuucuuagagaccgcc

SEQ ID NO: 34252 - RNA, 22 nt, Artificial Sequence
  Synthetic
gcggugcuucuuagagaccgcc

SEQ ID NO: 34253 - RNA, 23 nt, Artificial Sequence
  Synthetic
ggcggugcuucuuagagaccgcc

SEQ ID NO: 34254 - RNA, 24 nt, Artificial Sequence
  Synthetic
gggcggugcuucuuagagaccgcc

SEQ ID NO: 34255 - RNA, 18 nt, Artificial Sequence
  Synthetic
ggcacccuagugggcgcc

SEQ ID NO: 34256 - RNA, 19 nt, Artificial Sequence
  Synthetic
gggcacccuagugggcgcc

SEQ ID NO: 34257 - RNA, 20 nt, Artificial Sequence
  Synthetic
agggcacccuagugggcgcc

SEQ ID NO: 34258 - RNA, 21 nt, Artificial Sequence
  Synthetic
cagggcacccuagugggcgcc

SEQ ID NO: 34259 - RNA, 22 nt, Artificial Sequence
  Synthetic
ccagggcacccuagugggcgcc

SEQ ID NO: 34260 - RNA, 23 nt, Artificial Sequence
  Synthetic
accagggcacccuagugggcgcc

SEQ ID NO: 34261 - RNA, 24 nt, Artificial Sequence
  Synthetic
gaccagggcacccuagugggcgcc

SEQ ID NO: 34262 - RNA, 18 nt, Artificial Sequence
  Synthetic
uucugggccgcgggggcc

SEQ ID NO: 34263 - RNA, 19 nt, Artificial Sequence
  Synthetic
cuucugggccgcgggggcc

SEQ ID NO: 34264 - RNA, 20 nt, Artificial Sequence
  Synthetic
gcuucugggccgcgggggcc

SEQ ID NO: 34265 - RNA, 21 nt, Artificial Sequence
  Synthetic
ugcuucugggccgcgggggcc

SEQ ID NO: 34266 - RNA, 22 nt, Artificial Sequence
  Synthetic
cugcuucugggccgcgggggcc

SEQ ID NO: 34267 - RNA, 23 nt, Artificial Sequence
  Synthetic
gcugcuucugggccgcgggggcc

SEQ ID NO: 34268 - RNA, 24 nt, Artificial Sequence
  Synthetic
cgcugcuucugggccgcgggggcc

SEQ ID NO: 34269 - RNA, 18 nt, Artificial Sequence
  Synthetic
ccgcgcugcuucugggcc

SEQ ID NO: 34270 - RNA, 19 nt, Artificial Sequence
  Synthetic
cccgcgcugcuucugggcc

SEQ ID NO: 34271 - RNA, 20 nt, Artificial Sequence
  Synthetic
ccccgcgcugcuucugggcc

SEQ ID NO: 34272 - RNA, 21 nt, Artificial Sequence
  Synthetic
cccccgcgcugcuucugggcc

SEQ ID NO: 34273 - RNA, 22 nt, Artificial Sequence
  Synthetic
gcccccgcgcugcuucugggcc

SEQ ID NO: 34274 - RNA, 23 nt, Artificial Sequence
  Synthetic
ggcccccgcgcugcuucugggcc

SEQ ID NO: 34275 - RNA, 24 nt, Artificial Sequence
  Synthetic
cggcccccgcgcugcuucugggcc

SEQ ID NO: 34276 - RNA, 18 nt, Artificial Sequence
  Synthetic
gggccgaggaagugugcc

SEQ ID NO: 34277 - RNA, 19 nt, Artificial Sequence
  Synthetic
ggggccgaggaagugugcc

SEQ ID NO: 34278 - RNA, 20 nt, Artificial Sequence
  Synthetic
gggggccgaggaagugugcc

SEQ ID NO: 34279 - RNA, 21 nt, Artificial Sequence
  Synthetic
cgggggccgaggaagugugcc

SEQ ID NO: 34280 - RNA, 22 nt, Artificial Sequence
  Synthetic
gcgggggccgaggaagugugcc

SEQ ID NO: 34281 - RNA, 23 nt, Artificial Sequence
  Synthetic
cgcgggggccgaggaagugugcc

SEQ ID NO: 34282 - RNA, 24 nt, Artificial Sequence
  Synthetic
ccgcgggggccgaggaagugugcc

SEQ ID NO: 34283 - RNA, 18 nt, Artificial Sequence
  Synthetic
cugccugaccaccgaucc

SEQ ID NO: 34284 - RNA, 19 nt, Artificial Sequence
  Synthetic
gcugccugaccaccgaucc

SEQ ID NO: 34285 - RNA, 20 nt, Artificial Sequence
  Synthetic
ggcugccugaccaccgaucc

SEQ ID NO: 34286 - RNA, 21 nt, Artificial Sequence
  Synthetic
gggcugccugaccaccgaucc

SEQ ID NO: 34287 - RNA, 22 nt, Artificial Sequence
  Synthetic
cgggcugccugaccaccgaucc

SEQ ID NO: 34288 - RNA, 23 nt, Artificial Sequence
  Synthetic
ccgggcugccugaccaccgaucc

SEQ ID NO: 34289 - RNA, 24 nt, Artificial Sequence
  Synthetic
cccgggcugccugaccaccgaucc

SEQ ID NO: 34290 - RNA, 18 nt, Artificial Sequence
  Synthetic
gccgccgcacccugcucc

SEQ ID NO: 34291 - RNA, 19 nt, Artificial Sequence
  Synthetic
agccgccgcacccugcucc

SEQ ID NO: 34292 - RNA, 20 nt, Artificial Sequence
  Synthetic
gagccgccgcacccugcucc

SEQ ID NO: 34293 - RNA, 21 nt, Artificial Sequence
  Synthetic
ggagccgccgcacccugcucc

SEQ ID NO: 34294 - RNA, 22 nt, Artificial Sequence
  Synthetic
uggagccgccgcacccugcucc

SEQ ID NO: 34295 - RNA, 23 nt, Artificial Sequence
  Synthetic
cuggagccgccgcacccugcucc

SEQ ID NO: 34296 - RNA, 24 nt, Artificial Sequence
  Synthetic
gcuggagccgccgcacccugcucc

SEQ ID NO: 34297 - RNA, 18 nt, Artificial Sequence
  Synthetic
ucucggcacccguggucc

SEQ ID NO: 34298 - RNA, 19 nt, Artificial Sequence
  Synthetic
gucucggcacccguggucc

SEQ ID NO: 34299 - RNA, 20 nt, Artificial Sequence
  Synthetic
ggucucggcacccguggucc

SEQ ID NO: 34300 - RNA, 21 nt, Artificial Sequence
  Synthetic
cggucucggcacccguggucc

SEQ ID NO: 34301 - RNA, 22 nt, Artificial Sequence
  Synthetic
gcggucucggcacccguggucc

SEQ ID NO: 34302 - RNA, 23 nt, Artificial Sequence
  Synthetic
ugcggucucggcacccguggucc

SEQ ID NO: 34303 - RNA, 24 nt, Artificial Sequence
  Synthetic
cugcggucucggcacccguggucc

SEQ ID NO: 34304 - RNA, 18 nt, Artificial Sequence
  Synthetic
uguggguguuaaguuucc

SEQ ID NO: 34305 - RNA, 19 nt, Artificial Sequence
  Synthetic
guguggguguuaaguuucc

SEQ ID NO: 34306 - RNA, 20 nt, Artificial Sequence
  Synthetic
gguguggguguuaaguuucc

SEQ ID NO: 34307 - RNA, 21 nt, Artificial Sequence
  Synthetic
ggguguggguguuaaguuucc

SEQ ID NO: 34308 - RNA, 22 nt, Artificial Sequence
  Synthetic
uggguguggguguuaaguuucc

SEQ ID NO: 34309 - RNA, 23 nt, Artificial Sequence
  Synthetic
uuggguguggguguuaaguuucc

SEQ ID NO: 34310 - RNA, 24 nt, Artificial Sequence
  Synthetic
guuggguguggguguuaaguuucc

SEQ ID NO: 34311 - RNA, 18 nt, Artificial Sequence
  Synthetic
acaagaaugcggugcagc

SEQ ID NO: 34312 - RNA, 19 nt, Artificial Sequence
  Synthetic
aacaagaaugcggugcagc

SEQ ID NO: 34313 - RNA, 20 nt, Artificial Sequence
  Synthetic
aaacaagaaugcggugcagc

SEQ ID NO: 34314 - RNA, 21 nt, Artificial Sequence
  Synthetic
aaaacaagaaugcggugcagc

SEQ ID NO: 34315 - RNA, 22 nt, Artificial Sequence
  Synthetic
gaaaacaagaaugcggugcagc

SEQ ID NO: 34316 - RNA, 23 nt, Artificial Sequence
  Synthetic
agaaaacaagaaugcggugcagc

SEQ ID NO: 34317 - RNA, 24 nt, Artificial Sequence
  Synthetic
uagaaaacaagaaugcggugcagc

SEQ ID NO: 34318 - RNA, 18 nt, Artificial Sequence
  Synthetic
acccgugguccggggagc

SEQ ID NO: 34319 - RNA, 19 nt, Artificial Sequence
  Synthetic
cacccgugguccggggagc

SEQ ID NO: 34320 - RNA, 20 nt, Artificial Sequence
  Synthetic
gcacccgugguccggggagc

SEQ ID NO: 34321 - RNA, 21 nt, Artificial Sequence
  Synthetic
ggcacccgugguccggggagc

SEQ ID NO: 34322 - RNA, 22 nt, Artificial Sequence
  Synthetic
cggcacccgugguccggggagc

SEQ ID NO: 34323 - RNA, 23 nt, Artificial Sequence
  Synthetic
ucggcacccgugguccggggagc

SEQ ID NO: 34324 - RNA, 24 nt, Artificial Sequence
  Synthetic
cucggcacccgugguccggggagc

SEQ ID NO: 34325 - RNA, 18 nt, Artificial Sequence
  Synthetic
cugccacuggcauggagc

SEQ ID NO: 34326 - RNA, 19 nt, Artificial Sequence
  Synthetic
ccugccacuggcauggagc

SEQ ID NO: 34327 - RNA, 20 nt, Artificial Sequence
  Synthetic
uccugccacuggcauggagc

SEQ ID NO: 34328 - RNA, 21 nt, Artificial Sequence
  Synthetic
auccugccacuggcauggagc

SEQ ID NO: 34329 - RNA, 22 nt, Artificial Sequence
  Synthetic
cauccugccacuggcauggagc

SEQ ID NO: 34330 - RNA, 23 nt, Artificial Sequence
  Synthetic
gcauccugccacuggcauggagc

SEQ ID NO: 34331 - RNA, 24 nt, Artificial Sequence
  Synthetic
agcauccugccacuggcauggagc

SEQ ID NO: 34332 - RNA, 18 nt, Artificial Sequence
  Synthetic
gugcuucuuagagaccgc

SEQ ID NO: 34333 - RNA, 19 nt, Artificial Sequence
  Synthetic
ggugcuucuuagagaccgc

SEQ ID NO: 34334 - RNA, 20 nt, Artificial Sequence
  Synthetic
cggugcuucuuagagaccgc

SEQ ID NO: 34335 - RNA, 21 nt, Artificial Sequence
  Synthetic
gcggugcuucuuagagaccgc

SEQ ID NO: 34336 - RNA, 22 nt, Artificial Sequence
  Synthetic
ggcggugcuucuuagagaccgc

SEQ ID NO: 34337 - RNA, 23 nt, Artificial Sequence
  Synthetic
gggcggugcuucuuagagaccgc

SEQ ID NO: 34338 - RNA, 24 nt, Artificial Sequence
  Synthetic
ggggcggugcuucuuagagaccgc

SEQ ID NO: 34339 - RNA, 18 nt, Artificial Sequence
  Synthetic
ccgcgagcgccugcccgc

SEQ ID NO: 34340 - RNA, 19 nt, Artificial Sequence
  Synthetic
uccgcgagcgccugcccgc

SEQ ID NO: 34341 - RNA, 20 nt, Artificial Sequence
  Synthetic
uuccgcgagcgccugcccgc

SEQ ID NO: 34342 - RNA, 21 nt, Artificial Sequence
  Synthetic
uuuccgcgagcgccugcccgc

SEQ ID NO: 34343 - RNA, 22 nt, Artificial Sequence
  Synthetic
guuuccgcgagcgccugcccgc

SEQ ID NO: 34344 - RNA, 23 nt, Artificial Sequence
  Synthetic
aguuuccgcgagcgccugcccgc

SEQ ID NO: 34345 - RNA, 24 nt, Artificial Sequence
  Synthetic
aaguuuccgcgagcgccugcccgc

SEQ ID NO: 34346 - RNA, 18 nt, Artificial Sequence
  Synthetic
gcgcugcuucugggccgc

SEQ ID NO: 34347 - RNA, 19 nt, Artificial Sequence
  Synthetic
cgcgcugcuucugggccgc

SEQ ID NO: 34348 - RNA, 20 nt, Artificial Sequence
  Synthetic
ccgcgcugcuucugggccgc

SEQ ID NO: 34349 - RNA, 21 nt, Artificial Sequence
  Synthetic
cccgcgcugcuucugggccgc

SEQ ID NO: 34350 - RNA, 22 nt, Artificial Sequence
  Synthetic
ccccgcgcugcuucugggccgc

SEQ ID NO: 34351 - RNA, 23 nt, Artificial Sequence
  Synthetic
cccccgcgcugcuucugggccgc

SEQ ID NO: 34352 - RNA, 24 nt, Artificial Sequence
  Synthetic
gcccccgcgcugcuucugggccgc

SEQ ID NO: 34353 - RNA, 18 nt, Artificial Sequence
  Synthetic
cgggccgcgguccccggc

SEQ ID NO: 34354 - RNA, 19 nt, Artificial Sequence
  Synthetic
gcgggccgcgguccccggc

SEQ ID NO: 34355 - RNA, 20 nt, Artificial Sequence
  Synthetic
ugcgggccgcgguccccggc

SEQ ID NO: 34356 - RNA, 21 nt, Artificial Sequence
  Synthetic
cugcgggccgcgguccccggc

SEQ ID NO: 34357 - RNA, 22 nt, Artificial Sequence
  Synthetic
gcugcgggccgcgguccccggc

SEQ ID NO: 34358 - RNA, 23 nt, Artificial Sequence
  Synthetic
ggcugcgggccgcgguccccggc

SEQ ID NO: 34359 - RNA, 24 nt, Artificial Sequence
  Synthetic
cggcugcgggccgcgguccccggc

SEQ ID NO: 34360 - RNA, 18 nt, Artificial Sequence
  Synthetic
uaaccacagagccgcggc

SEQ ID NO: 34361 - RNA, 19 nt, Artificial Sequence
  Synthetic
uuaaccacagagccgcggc

SEQ ID NO: 34362 - RNA, 20 nt, Artificial Sequence
  Synthetic
guuaaccacagagccgcggc

SEQ ID NO: 34363 - RNA, 21 nt, Artificial Sequence
  Synthetic
uguuaaccacagagccgcggc

SEQ ID NO: 34364 - RNA, 22 nt, Artificial Sequence
  Synthetic
guguuaaccacagagccgcggc

SEQ ID NO: 34365 - RNA, 23 nt, Artificial Sequence
  Synthetic
gguguuaaccacagagccgcggc

SEQ ID NO: 34366 - RNA, 24 nt, Artificial Sequence
  Synthetic
ugguguuaaccacagagccgcggc

SEQ ID NO: 34367 - RNA, 18 nt, Artificial Sequence
  Synthetic
cuggccgccacaaagggc

SEQ ID NO: 34368 - RNA, 19 nt, Artificial Sequence
  Synthetic
ucuggccgccacaaagggc

SEQ ID NO: 34369 - RNA, 20 nt, Artificial Sequence
  Synthetic
cucuggccgccacaaagggc

SEQ ID NO: 34370 - RNA, 21 nt, Artificial Sequence
  Synthetic
ccucuggccgccacaaagggc

SEQ ID NO: 34371 - RNA, 22 nt, Artificial Sequence
  Synthetic
gccucuggccgccacaaagggc

SEQ ID NO: 34372 - RNA, 23 nt, Artificial Sequence
  Synthetic
ggccucuggccgccacaaagggc

SEQ ID NO: 34373 - RNA, 24 nt, Artificial Sequence
  Synthetic
uggccucuggccgccacaaagggc

SEQ ID NO: 34374 - RNA, 18 nt, Artificial Sequence
  Synthetic
aagcauccugccacuggc

SEQ ID NO: 34375 - RNA, 19 nt, Artificial Sequence
  Synthetic
aaagcauccugccacuggc

SEQ ID NO: 34376 - RNA, 20 nt, Artificial Sequence
  Synthetic
gaaagcauccugccacuggc

SEQ ID NO: 34377 - RNA, 21 nt, Artificial Sequence
  Synthetic
cgaaagcauccugccacuggc

SEQ ID NO: 34378 - RNA, 22 nt, Artificial Sequence
  Synthetic
ccgaaagcauccugccacuggc

SEQ ID NO: 34379 - RNA, 23 nt, Artificial Sequence
  Synthetic
cccgaaagcauccugccacuggc

SEQ ID NO: 34380 - RNA, 24 nt, Artificial Sequence
  Synthetic
ccccgaaagcauccugccacuggc

SEQ ID NO: 34381 - RNA, 18 nt, Artificial Sequence
  Synthetic
gauguaucgcggggaugc

SEQ ID NO: 34382 - RNA, 19 nt, Artificial Sequence
  Synthetic
ggauguaucgcggggaugc

SEQ ID NO: 34383 - RNA, 20 nt, Artificial Sequence
  Synthetic
uggauguaucgcggggaugc

SEQ ID NO: 34384 - RNA, 21 nt, Artificial Sequence
  Synthetic
uuggauguaucgcggggaugc

SEQ ID NO: 34385 - RNA, 22 nt, Artificial Sequence
  Synthetic
guuggauguaucgcggggaugc

SEQ ID NO: 34386 - RNA, 23 nt, Artificial Sequence
  Synthetic
uguuggauguaucgcggggaugc

SEQ ID NO: 34387 - RNA, 24 nt, Artificial Sequence
  Synthetic
guguuggauguaucgcggggaugc

SEQ ID NO: 34388 - RNA, 18 nt, Artificial Sequence
  Synthetic
gcgugggagugggggugc

SEQ ID NO: 34389 - RNA, 19 nt, Artificial Sequence
  Synthetic
ugcgugggagugggggugc

SEQ ID NO: 34390 - RNA, 20 nt, Artificial Sequence
  Synthetic
augcgugggagugggggugc

SEQ ID NO: 34391 - RNA, 21 nt, Artificial Sequence
  Synthetic
gaugcgugggagugggggugc

SEQ ID NO: 34392 - RNA, 22 nt, Artificial Sequence
  Synthetic
ggaugcgugggagugggggugc

SEQ ID NO: 34393 - RNA, 23 nt, Artificial Sequence
  Synthetic
gggaugcgugggagugggggugc

SEQ ID NO: 34394 - RNA, 24 nt, Artificial Sequence
  Synthetic
ggggaugcgugggagugggggugc

SEQ ID NO: 34395 - RNA, 20 nt, Artificial Sequence
  Synthetic
gugcgugggagugggggugc

SEQ ID NO: 34396 - RNA, 21 nt, Artificial Sequence
  Synthetic
ggugcgugggagugggggugc

SEQ ID NO: 34397 - RNA, 22 nt, Artificial Sequence
  Synthetic
gggugcgugggagugggggugc

SEQ ID NO: 34398 - RNA, 23 nt, Artificial Sequence
  Synthetic
ggggugcgugggagugggggugc

SEQ ID NO: 34399 - RNA, 24 nt, Artificial Sequence
  Synthetic
gggggugcgugggagugggggugc

SEQ ID NO: 34400 - RNA, 18 nt, Artificial Sequence
  Synthetic
ggggccgaggaagugugc

SEQ ID NO: 34401 - RNA, 19 nt, Artificial Sequence
  Synthetic
gggggccgaggaagugugc

SEQ ID NO: 34402 - RNA, 20 nt, Artificial Sequence
  Synthetic
cgggggccgaggaagugugc

SEQ ID NO: 34403 - RNA, 21 nt, Artificial Sequence
  Synthetic
gcgggggccgaggaagugugc

SEQ ID NO: 34404 - RNA, 22 nt, Artificial Sequence
  Synthetic
cgcgggggccgaggaagugugc

SEQ ID NO: 34405 - RNA, 23 nt, Artificial Sequence
  Synthetic
ccgcgggggccgaggaagugugc

SEQ ID NO: 34406 - RNA, 24 nt, Artificial Sequence
  Synthetic
gccgcgggggccgaggaagugugc

SEQ ID NO: 34407 - RNA, 18 nt, Artificial Sequence
  Synthetic
acgcgcuaccugcccauc

SEQ ID NO: 34408 - RNA, 19 nt, Artificial Sequence
  Synthetic
cacgcgcuaccugcccauc

SEQ ID NO: 34409 - RNA, 20 nt, Artificial Sequence
  Synthetic
ucacgcgcuaccugcccauc

SEQ ID NO: 34410 - RNA, 21 nt, Artificial Sequence
  Synthetic
cucacgcgcuaccugcccauc

SEQ ID NO: 34411 - RNA, 22 nt, Artificial Sequence
  Synthetic
ccucacgcgcuaccugcccauc

SEQ ID NO: 34412 - RNA, 23 nt, Artificial Sequence
  Synthetic
gccucacgcgcuaccugcccauc

SEQ ID NO: 34413 - RNA, 24 nt, Artificial Sequence
  Synthetic
ggccucacgcgcuaccugcccauc

SEQ ID NO: 34414 - RNA, 18 nt, Artificial Sequence
  Synthetic
ggggacugccugcccauc

SEQ ID NO: 34415 - RNA, 19 nt, Artificial Sequence
  Synthetic
gggggacugccugcccauc

SEQ ID NO: 34416 - RNA, 20 nt, Artificial Sequence
  Synthetic
cgggggacugccugcccauc

SEQ ID NO: 34417 - RNA, 21 nt, Artificial Sequence
  Synthetic
acgggggacugccugcccauc

SEQ ID NO: 34418 - RNA, 22 nt, Artificial Sequence
  Synthetic
cacgggggacugccugcccauc

SEQ ID NO: 34419 - RNA, 23 nt, Artificial Sequence
  Synthetic
ucacgggggacugccugcccauc

SEQ ID NO: 34420 - RNA, 24 nt, Artificial Sequence
  Synthetic
aucacgggggacugccugcccauc

SEQ ID NO: 34421 - RNA, 18 nt, Artificial Sequence
  Synthetic
uacgugaacaagacuauc

SEQ ID NO: 34422 - RNA, 19 nt, Artificial Sequence
  Synthetic
uuacgugaacaagacuauc

SEQ ID NO: 34423 - RNA, 20 nt, Artificial Sequence
  Synthetic
cuuacgugaacaagacuauc

SEQ ID NO: 34424 - RNA, 21 nt, Artificial Sequence
  Synthetic
ccuuacgugaacaagacuauc

SEQ ID NO: 34425 - RNA, 22 nt, Artificial Sequence
  Synthetic
gccuuacgugaacaagacuauc

SEQ ID NO: 34426 - RNA, 23 nt, Artificial Sequence
  Synthetic
cgccuuacgugaacaagacuauc

SEQ ID NO: 34427 - RNA, 24 nt, Artificial Sequence
  Synthetic
ucgccuuacgugaacaagacuauc

SEQ ID NO: 34428 - RNA, 18 nt, Artificial Sequence
  Synthetic
gucuguguuggauguauc

SEQ ID NO: 34429 - RNA, 19 nt, Artificial Sequence
  Synthetic
ugucuguguuggauguauc

SEQ ID NO: 34430 - RNA, 20 nt, Artificial Sequence
  Synthetic
cugucuguguuggauguauc

SEQ ID NO: 34431 - RNA, 21 nt, Artificial Sequence
  Synthetic
ccugucuguguuggauguauc

SEQ ID NO: 34432 - RNA, 22 nt, Artificial Sequence
  Synthetic
cccugucuguguuggauguauc

SEQ ID NO: 34433 - RNA, 23 nt, Artificial Sequence
  Synthetic
ucccugucuguguuggauguauc

SEQ ID NO: 34434 - RNA, 24 nt, Artificial Sequence
  Synthetic
uucccugucuguguuggauguauc

SEQ ID NO: 34435 - RNA, 18 nt, Artificial Sequence
  Synthetic
ccuaauaaaaaaaaacuc

SEQ ID NO: 34436 - RNA, 19 nt, Artificial Sequence
  Synthetic
cccuaauaaaaaaaaacuc

SEQ ID NO: 34437 - RNA, 20 nt, Artificial Sequence
  Synthetic
gcccuaauaaaaaaaaacuc

SEQ ID NO: 34438 - RNA, 21 nt, Artificial Sequence
  Synthetic
ggcccuaauaaaaaaaaacuc

SEQ ID NO: 34439 - RNA, 22 nt, Artificial Sequence
  Synthetic
uggcccuaauaaaaaaaaacuc

SEQ ID NO: 34440 - RNA, 23 nt, Artificial Sequence
  Synthetic
uuggcccuaauaaaaaaaaacuc

SEQ ID NO: 34441 - RNA, 24 nt, Artificial Sequence
  Synthetic
guuggcccuaauaaaaaaaaacuc

SEQ ID NO: 34442 - RNA, 18 nt, Artificial Sequence
  Synthetic
gucucggcacccgugguc

SEQ ID NO: 34443 - RNA, 19 nt, Artificial Sequence
  Synthetic
ggucucggcacccgugguc

SEQ ID NO: 34444 - RNA, 20 nt, Artificial Sequence
  Synthetic
cggucucggcacccgugguc

SEQ ID NO: 34445 - RNA, 21 nt, Artificial Sequence
  Synthetic
gcggucucggcacccgugguc

SEQ ID NO: 34446 - RNA, 22 nt, Artificial Sequence
  Synthetic
ugcggucucggcacccgugguc

SEQ ID NO: 34447 - RNA, 23 nt, Artificial Sequence
  Synthetic
cugcggucucggcacccgugguc

SEQ ID NO: 34448 - RNA, 24 nt, Artificial Sequence
  Synthetic
ccugcggucucggcacccgugguc

SEQ ID NO: 34449 - RNA, 18 nt, Artificial Sequence
  Synthetic
caccagccaauccguguc

SEQ ID NO: 34450 - RNA, 19 nt, Artificial Sequence
  Synthetic
acaccagccaauccguguc

SEQ ID NO: 34451 - RNA, 20 nt, Artificial Sequence
  Synthetic
uacaccagccaauccguguc

SEQ ID NO: 34452 - RNA, 21 nt, Artificial Sequence
  Synthetic
cuacaccagccaauccguguc

SEQ ID NO: 34453 - RNA, 22 nt, Artificial Sequence
  Synthetic
acuacaccagccaauccguguc

SEQ ID NO: 34454 - RNA, 23 nt, Artificial Sequence
  Synthetic
cacuacaccagccaauccguguc

SEQ ID NO: 34455 - RNA, 24 nt, Artificial Sequence
  Synthetic
ccacuacaccagccaauccguguc

SEQ ID NO: 34456 - RNA, 18 nt, Artificial Sequence
  Synthetic
gcgccacgcggagacuuc

SEQ ID NO: 34457 - RNA, 19 nt, Artificial Sequence
  Synthetic
cgcgccacgcggagacuuc

SEQ ID NO: 34458 - RNA, 20 nt, Artificial Sequence
  Synthetic
acgcgccacgcggagacuuc

SEQ ID NO: 34459 - RNA, 21 nt, Artificial Sequence
  Synthetic
gacgcgccacgcggagacuuc

SEQ ID NO: 34460 - RNA, 22 nt, Artificial Sequence
  Synthetic
agacgcgccacgcggagacuuc

SEQ ID NO: 34461 - RNA, 23 nt, Artificial Sequence
  Synthetic
aagacgcgccacgcggagacuuc

SEQ ID NO: 34462 - RNA, 24 nt, Artificial Sequence
  Synthetic
gaagacgcgccacgcggagacuuc

SEQ ID NO: 34463 - RNA, 18 nt, Artificial Sequence
  Synthetic
augcucggugguaugaag

SEQ ID NO: 34464 - RNA, 19 nt, Artificial Sequence
  Synthetic
caugcucggugguaugaag

SEQ ID NO: 34465 - RNA, 20 nt, Artificial Sequence
  Synthetic
gcaugcucggugguaugaag

SEQ ID NO: 34466 - RNA, 21 nt, Artificial Sequence
  Synthetic
ggcaugcucggugguaugaag

SEQ ID NO: 34467 - RNA, 22 nt, Artificial Sequence
  Synthetic
aggcaugcucggugguaugaag

SEQ ID NO: 34468 - RNA, 23 nt, Artificial Sequence
  Synthetic
caggcaugcucggugguaugaag

SEQ ID NO: 34469 - RNA, 24 nt, Artificial Sequence
  Synthetic
ccaggcaugcucggugguaugaag

SEQ ID NO: 34470 - RNA, 18 nt, Artificial Sequence
  Synthetic
gugguccugguggaccag

SEQ ID NO: 34471 - RNA, 19 nt, Artificial Sequence
  Synthetic
cgugguccugguggaccag

SEQ ID NO: 34472 - RNA, 20 nt, Artificial Sequence
  Synthetic
acgugguccugguggaccag

SEQ ID NO: 34473 - RNA, 21 nt, Artificial Sequence
  Synthetic
uacgugguccugguggaccag

SEQ ID NO: 34474 - RNA, 22 nt, Artificial Sequence
  Synthetic
guacgugguccugguggaccag

SEQ ID NO: 34475 - RNA, 23 nt, Artificial Sequence
  Synthetic
cguacgugguccugguggaccag

SEQ ID NO: 34476 - RNA, 24 nt, Artificial Sequence
  Synthetic
gcguacgugguccugguggaccag

SEQ ID NO: 34477 - RNA, 18 nt, Artificial Sequence
  Synthetic
gcgcacccgcgcggccag

SEQ ID NO: 34478 - RNA, 19 nt, Artificial Sequence
  Synthetic
cgcgcacccgcgcggccag

SEQ ID NO: 34479 - RNA, 20 nt, Artificial Sequence
  Synthetic
acgcgcacccgcgcggccag

SEQ ID NO: 34480 - RNA, 21 nt, Artificial Sequence
  Synthetic
cacgcgcacccgcgcggccag

SEQ ID NO: 34481 - RNA, 22 nt, Artificial Sequence
  Synthetic
gcacgcgcacccgcgcggccag

SEQ ID NO: 34482 - RNA, 23 nt, Artificial Sequence
  Synthetic
ggcacgcgcacccgcgcggccag

SEQ ID NO: 34483 - RNA, 24 nt, Artificial Sequence
  Synthetic
aggcacgcgcacccgcgcggccag

SEQ ID NO: 34484 - RNA, 18 nt, Artificial Sequence
  Synthetic
cucggugguaugaaggag

SEQ ID NO: 34485 - RNA, 19 nt, Artificial Sequence
  Synthetic
gcucggugguaugaaggag

SEQ ID NO: 34486 - RNA, 20 nt, Artificial Sequence
  Synthetic
ugcucggugguaugaaggag

SEQ ID NO: 34487 - RNA, 21 nt, Artificial Sequence
  Synthetic
augcucggugguaugaaggag

SEQ ID NO: 34488 - RNA, 22 nt, Artificial Sequence
  Synthetic
caugcucggugguaugaaggag

SEQ ID NO: 34489 - RNA, 23 nt, Artificial Sequence
  Synthetic
gcaugcucggugguaugaaggag

SEQ ID NO: 34490 - RNA, 24 nt, Artificial Sequence
  Synthetic
ggcaugcucggugguaugaaggag

SEQ ID NO: 34491 - RNA, 18 nt, Artificial Sequence
  Synthetic
gccagagaaucacaggag

SEQ ID NO: 34492 - RNA, 19 nt, Artificial Sequence
  Synthetic
agccagagaaucacaggag

SEQ ID NO: 34493 - RNA, 20 nt, Artificial Sequence
  Synthetic
cagccagagaaucacaggag

SEQ ID NO: 34494 - RNA, 21 nt, Artificial Sequence
  Synthetic
gcagccagagaaucacaggag

SEQ ID NO: 34495 - RNA, 22 nt, Artificial Sequence
  Synthetic
ugcagccagagaaucacaggag

SEQ ID NO: 34496 - RNA, 23 nt, Artificial Sequence
  Synthetic
gugcagccagagaaucacaggag

SEQ ID NO: 34497 - RNA, 24 nt, Artificial Sequence
  Synthetic
ggugcagccagagaaucacaggag

SEQ ID NO: 34498 - RNA, 18 nt, Artificial Sequence
  Synthetic
acggcccccgcgucggag

SEQ ID NO: 34499 - RNA, 19 nt, Artificial Sequence
  Synthetic
gacggcccccgcgucggag

SEQ ID NO: 34500 - RNA, 20 nt, Artificial Sequence
  Synthetic
cgacggcccccgcgucggag

SEQ ID NO: 34501 - RNA, 21 nt, Artificial Sequence
  Synthetic
ccgacggcccccgcgucggag

SEQ ID NO: 34502 - RNA, 22 nt, Artificial Sequence
  Synthetic
cccgacggcccccgcgucggag

SEQ ID NO: 34503 - RNA, 23 nt, Artificial Sequence
  Synthetic
acccgacggcccccgcgucggag

SEQ ID NO: 34504 - RNA, 24 nt, Artificial Sequence
  Synthetic
uacccgacggcccccgcgucggag

SEQ ID NO: 34505 - RNA, 18 nt, Artificial Sequence
  Synthetic
cacccgugguccggggag

SEQ ID NO: 34506 - RNA, 19 nt, Artificial Sequence
  Synthetic
gcacccgugguccggggag

SEQ ID NO: 34507 - RNA, 20 nt, Artificial Sequence
  Synthetic
ggcacccgugguccggggag

SEQ ID NO: 34508 - RNA, 21 nt, Artificial Sequence
  Synthetic
cggcacccgugguccggggag

SEQ ID NO: 34509 - RNA, 22 nt, Artificial Sequence
  Synthetic
ucggcacccgugguccggggag

SEQ ID NO: 34510 - RNA, 23 nt, Artificial Sequence
  Synthetic
cucggcacccgugguccggggag

SEQ ID NO: 34511 - RNA, 24 nt, Artificial Sequence
  Synthetic
ucucggcacccgugguccggggag

SEQ ID NO: 34512 - RNA, 18 nt, Artificial Sequence
  Synthetic
ccaauccgugucggggag

SEQ ID NO: 34513 - RNA, 19 nt, Artificial Sequence
  Synthetic
gccaauccgugucggggag

SEQ ID NO: 34514 - RNA, 20 nt, Artificial Sequence
  Synthetic
agccaauccgugucggggag

SEQ ID NO: 34515 - RNA, 21 nt, Artificial Sequence
  Synthetic
cagccaauccgugucggggag

SEQ ID NO: 34516 - RNA, 22 nt, Artificial Sequence
  Synthetic
ccagccaauccgugucggggag

SEQ ID NO: 34517 - RNA, 23 nt, Artificial Sequence
  Synthetic
accagccaauccgugucggggag

SEQ ID NO: 34518 - RNA, 24 nt, Artificial Sequence
  Synthetic
caccagccaauccgugucggggag

SEQ ID NO: 34519 - RNA, 18 nt, Artificial Sequence
  Synthetic
ccccguguuuguggggag

SEQ ID NO: 34520 - RNA, 19 nt, Artificial Sequence
  Synthetic
cccccguguuuguggggag

SEQ ID NO: 34521 - RNA, 20 nt, Artificial Sequence
  Synthetic
ccccccguguuuguggggag

SEQ ID NO: 34522 - RNA, 21 nt, Artificial Sequence
  Synthetic
gccccccguguuuguggggag

SEQ ID NO: 34523 - RNA, 22 nt, Artificial Sequence
  Synthetic
cgccccccguguuuguggggag

SEQ ID NO: 34524 - RNA, 23 nt, Artificial Sequence
  Synthetic
acgccccccguguuuguggggag

SEQ ID NO: 34525 - RNA, 24 nt, Artificial Sequence
  Synthetic
gacgccccccguguuuguggggag

SEQ ID NO: 34526 - RNA, 18 nt, Artificial Sequence
  Synthetic
cgcggggaugcgugggag

SEQ ID NO: 34527 - RNA, 19 nt, Artificial Sequence
  Synthetic
ucgcggggaugcgugggag

SEQ ID NO: 34528 - RNA, 20 nt, Artificial Sequence
  Synthetic
aucgcggggaugcgugggag

SEQ ID NO: 34529 - RNA, 21 nt, Artificial Sequence
  Synthetic
uaucgcggggaugcgugggag

SEQ ID NO: 34530 - RNA, 22 nt, Artificial Sequence
  Synthetic
guaucgcggggaugcgugggag

SEQ ID NO: 34531 - RNA, 23 nt, Artificial Sequence
  Synthetic
uguaucgcggggaugcgugggag

SEQ ID NO: 34532 - RNA, 24 nt, Artificial Sequence
  Synthetic
auguaucgcggggaugcgugggag

SEQ ID NO: 34533 - RNA, 18 nt, Artificial Sequence
  Synthetic
agugggggugcgugggag

SEQ ID NO: 34534 - RNA, 19 nt, Artificial Sequence
  Synthetic
gagugggggugcgugggag

SEQ ID NO: 34535 - RNA, 20 nt, Artificial Sequence
  Synthetic
ggagugggggugcgugggag

SEQ ID NO: 34536 - RNA, 21 nt, Artificial Sequence
  Synthetic
gggagugggggugcgugggag

SEQ ID NO: 34537 - RNA, 22 nt, Artificial Sequence
  Synthetic
ugggagugggggugcgugggag

SEQ ID NO: 34538 - RNA, 23 nt, Artificial Sequence
  Synthetic
gugggagugggggugcgugggag

SEQ ID NO: 34539 - RNA, 24 nt, Artificial Sequence
  Synthetic
cgugggagugggggugcgugggag

SEQ ID NO: 34540 - RNA, 18 nt, Artificial Sequence
  Synthetic
cccauccuggacauggag

SEQ ID NO: 34541 - RNA, 19 nt, Artificial Sequence
  Synthetic
gcccauccuggacauggag

SEQ ID NO: 34542 - RNA, 20 nt, Artificial Sequence
  Synthetic
ugcccauccuggacauggag

SEQ ID NO: 34543 - RNA, 21 nt, Artificial Sequence
  Synthetic
cugcccauccuggacauggag

SEQ ID NO: 34544 - RNA, 22 nt, Artificial Sequence
  Synthetic
ccugcccauccuggacauggag

SEQ ID NO: 34545 - RNA, 23 nt, Artificial Sequence
  Synthetic
gccugcccauccuggacauggag

SEQ ID NO: 34546 - RNA, 24 nt, Artificial Sequence
  Synthetic
ugccugcccauccuggacauggag

SEQ ID NO: 34547 - RNA, 18 nt, Artificial Sequence
  Synthetic
cccggaagacgcgccacg

SEQ ID NO: 34548 - RNA, 19 nt, Artificial Sequence
  Synthetic
gcccggaagacgcgccacg

SEQ ID NO: 34549 - RNA, 20 nt, Artificial Sequence
  Synthetic
ugcccggaagacgcgccacg

SEQ ID NO: 34550 - RNA, 21 nt, Artificial Sequence
  Synthetic
gugcccggaagacgcgccacg

SEQ ID NO: 34551 - RNA, 22 nt, Artificial Sequence
  Synthetic
ugugcccggaagacgcgccacg

SEQ ID NO: 34552 - RNA, 23 nt, Artificial Sequence
  Synthetic
gugugcccggaagacgcgccacg

SEQ ID NO: 34553 - RNA, 24 nt, Artificial Sequence
  Synthetic
agugugcccggaagacgcgccacg

SEQ ID NO: 34554 - RNA, 18 nt, Artificial Sequence
  Synthetic
gugaacaagacuaucacg

SEQ ID NO: 34555 - RNA, 19 nt, Artificial Sequence
  Synthetic
cgugaacaagacuaucacg

SEQ ID NO: 34556 - RNA, 20 nt, Artificial Sequence
  Synthetic
acgugaacaagacuaucacg

SEQ ID NO: 34557 - RNA, 21 nt, Artificial Sequence
  Synthetic
uacgugaacaagacuaucacg

SEQ ID NO: 34558 - RNA, 22 nt, Artificial Sequence
  Synthetic
uuacgugaacaagacuaucacg

SEQ ID NO: 34559 - RNA, 23 nt, Artificial Sequence
  Synthetic
cuuacgugaacaagacuaucacg

SEQ ID NO: 34560 - RNA, 24 nt, Artificial Sequence
  Synthetic
ccuuacgugaacaagacuaucacg

SEQ ID NO: 34561 - RNA, 18 nt, Artificial Sequence
  Synthetic
agagaaucacaggagacg

SEQ ID NO: 34562 - RNA, 19 nt, Artificial Sequence
  Synthetic
cagagaaucacaggagacg

SEQ ID NO: 34563 - RNA, 20 nt, Artificial Sequence
  Synthetic
ccagagaaucacaggagacg

SEQ ID NO: 34564 - RNA, 21 nt, Artificial Sequence
  Synthetic
gccagagaaucacaggagacg

SEQ ID NO: 34565 - RNA, 22 nt, Artificial Sequence
  Synthetic
agccagagaaucacaggagacg

SEQ ID NO: 34566 - RNA, 23 nt, Artificial Sequence
  Synthetic
cagccagagaaucacaggagacg

SEQ ID NO: 34567 - RNA, 24 nt, Artificial Sequence
  Synthetic
gcagccagagaaucacaggagacg

SEQ ID NO: 34568 - RNA, 18 nt, Artificial Sequence
  Synthetic
auccuggacauggagacg

SEQ ID NO: 34569 - RNA, 19 nt, Artificial Sequence
  Synthetic
cauccuggacauggagacg

SEQ ID NO: 34570 - RNA, 20 nt, Artificial Sequence
  Synthetic
ccauccuggacauggagacg

SEQ ID NO: 34571 - RNA, 21 nt, Artificial Sequence
  Synthetic
cccauccuggacauggagacg

SEQ ID NO: 34572 - RNA, 22 nt, Artificial Sequence
  Synthetic
gcccauccuggacauggagacg

SEQ ID NO: 34573 - RNA, 23 nt, Artificial Sequence
  Synthetic
ugcccauccuggacauggagacg

SEQ ID NO: 34574 - RNA, 24 nt, Artificial Sequence
  Synthetic
cugcccauccuggacauggagacg

SEQ ID NO: 34575 - RNA, 18 nt, Artificial Sequence
  Synthetic
gggcgucgacccgggacg

SEQ ID NO: 34576 - RNA, 19 nt, Artificial Sequence
  Synthetic
ggggcgucgacccgggacg

SEQ ID NO: 34577 - RNA, 20 nt, Artificial Sequence
  Synthetic
gggggcgucgacccgggacg

SEQ ID NO: 34578 - RNA, 21 nt, Artificial Sequence
  Synthetic
agggggcgucgacccgggacg

SEQ ID NO: 34579 - RNA, 22 nt, Artificial Sequence
  Synthetic
cagggggcgucgacccgggacg

SEQ ID NO: 34580 - RNA, 23 nt, Artificial Sequence
  Synthetic
gcagggggcgucgacccgggacg

SEQ ID NO: 34581 - RNA, 24 nt, Artificial Sequence
  Synthetic
agcagggggcgucgacccgggacg

SEQ ID NO: 34582 - RNA, 18 nt, Artificial Sequence
  Synthetic
ggugcuucuuagagaccg

SEQ ID NO: 34583 - RNA, 19 nt, Artificial Sequence
  Synthetic
cggugcuucuuagagaccg

SEQ ID NO: 34584 - RNA, 20 nt, Artificial Sequence
  Synthetic
gcggugcuucuuagagaccg

SEQ ID NO: 34585 - RNA, 21 nt, Artificial Sequence
  Synthetic
ggcggugcuucuuagagaccg

SEQ ID NO: 34586 - RNA, 22 nt, Artificial Sequence
  Synthetic
gggcggugcuucuuagagaccg

SEQ ID NO: 34587 - RNA, 23 nt, Artificial Sequence
  Synthetic
ggggcggugcuucuuagagaccg

SEQ ID NO: 34588 - RNA, 24 nt, Artificial Sequence
  Synthetic
gggggcggugcuucuuagagaccg

SEQ ID NO: 34589 - RNA, 18 nt, Artificial Sequence
  Synthetic
gccucuggaugacccccg

SEQ ID NO: 34590 - RNA, 19 nt, Artificial Sequence
  Synthetic
agccucuggaugacccccg

SEQ ID NO: 34591 - RNA, 20 nt, Artificial Sequence
  Synthetic
cagccucuggaugacccccg

SEQ ID NO: 34592 - RNA, 21 nt, Artificial Sequence
  Synthetic
acagccucuggaugacccccg

SEQ ID NO: 34593 - RNA, 22 nt, Artificial Sequence
  Synthetic
aacagccucuggaugacccccg

SEQ ID NO: 34594 - RNA, 23 nt, Artificial Sequence
  Synthetic
gaacagccucuggaugacccccg

SEQ ID NO: 34595 - RNA, 24 nt, Artificial Sequence
  Synthetic
ggaacagccucuggaugacccccg

SEQ ID NO: 34596 - RNA, 18 nt, Artificial Sequence
  Synthetic
gcuucuuagagaccgccg

SEQ ID NO: 34597 - RNA, 19 nt, Artificial Sequence
  Synthetic
ugcuucuuagagaccgccg

SEQ ID NO: 34598 - RNA, 20 nt, Artificial Sequence
  Synthetic
gugcuucuuagagaccgccg

SEQ ID NO: 34599 - RNA, 21 nt, Artificial Sequence
  Synthetic
ggugcuucuuagagaccgccg

SEQ ID NO: 34600 - RNA, 22 nt, Artificial Sequence
  Synthetic
cggugcuucuuagagaccgccg

SEQ ID NO: 34601 - RNA, 23 nt, Artificial Sequence
  Synthetic
gcggugcuucuuagagaccgccg

SEQ ID NO: 34602 - RNA, 24 nt, Artificial Sequence
  Synthetic
ggcggugcuucuuagagaccgccg

SEQ ID NO: 34603 - RNA, 18 nt, Artificial Sequence
  Synthetic
ucugggccgcgggggccg

SEQ ID NO: 34604 - RNA, 19 nt, Artificial Sequence
  Synthetic
uucugggccgcgggggccg

SEQ ID NO: 34605 - RNA, 20 nt, Artificial Sequence
  Synthetic
cuucugggccgcgggggccg

SEQ ID NO: 34606 - RNA, 21 nt, Artificial Sequence
  Synthetic
gcuucugggccgcgggggccg

SEQ ID NO: 34607 - RNA, 22 nt, Artificial Sequence
  Synthetic
ugcuucugggccgcgggggccg

SEQ ID NO: 34608 - RNA, 23 nt, Artificial Sequence
  Synthetic
cugcuucugggccgcgggggccg

SEQ ID NO: 34609 - RNA, 24 nt, Artificial Sequence
  Synthetic
gcugcuucugggccgcgggggccg

SEQ ID NO: 34610 - RNA, 18 nt, Artificial Sequence
  Synthetic
cgcgcugcuucugggccg

SEQ ID NO: 34611 - RNA, 19 nt, Artificial Sequence
  Synthetic
ccgcgcugcuucugggccg

SEQ ID NO: 34612 - RNA, 20 nt, Artificial Sequence
  Synthetic
cccgcgcugcuucugggccg

SEQ ID NO: 34613 - RNA, 21 nt, Artificial Sequence
  Synthetic
ccccgcgcugcuucugggccg

SEQ ID NO: 34614 - RNA, 22 nt, Artificial Sequence
  Synthetic
cccccgcgcugcuucugggccg

SEQ ID NO: 34615 - RNA, 23 nt, Artificial Sequence
  Synthetic
gcccccgcgcugcuucugggccg

SEQ ID NO: 34616 - RNA, 24 nt, Artificial Sequence
  Synthetic
ggcccccgcgcugcuucugggccg

SEQ ID NO: 34617 - RNA, 18 nt, Artificial Sequence
  Synthetic
cucggcacccgugguccg

SEQ ID NO: 34618 - RNA, 19 nt, Artificial Sequence
  Synthetic
ucucggcacccgugguccg

SEQ ID NO: 34619 - RNA, 20 nt, Artificial Sequence
  Synthetic
gucucggcacccgugguccg

SEQ ID NO: 34620 - RNA, 21 nt, Artificial Sequence
  Synthetic
ggucucggcacccgugguccg

SEQ ID NO: 34621 - RNA, 22 nt, Artificial Sequence
  Synthetic
cggucucggcacccgugguccg

SEQ ID NO: 34622 - RNA, 23 nt, Artificial Sequence
  Synthetic
gcggucucggcacccgugguccg

SEQ ID NO: 34623 - RNA, 24 nt, Artificial Sequence
  Synthetic
ugcggucucggcacccgugguccg

SEQ ID NO: 34624 - RNA, 18 nt, Artificial Sequence
  Synthetic
uacccgacggcccccgcg

SEQ ID NO: 34625 - RNA, 19 nt, Artificial Sequence
  Synthetic
guacccgacggcccccgcg

SEQ ID NO: 34626 - RNA, 20 nt, Artificial Sequence
  Synthetic
aguacccgacggcccccgcg

SEQ ID NO: 34627 - RNA, 21 nt, Artificial Sequence
  Synthetic
gaguacccgacggcccccgcg

SEQ ID NO: 34628 - RNA, 22 nt, Artificial Sequence
  Synthetic
cgaguacccgacggcccccgcg

SEQ ID NO: 34629 - RNA, 23 nt, Artificial Sequence
  Synthetic
ccgaguacccgacggcccccgcg

SEQ ID NO: 34630 - RNA, 24 nt, Artificial Sequence
  Synthetic
cccgaguacccgacggcccccgcg

SEQ ID NO: 34631 - RNA, 18 nt, Artificial Sequence
  Synthetic
uggccgccacaaagggcg

SEQ ID NO: 34632 - RNA, 19 nt, Artificial Sequence
  Synthetic
cuggccgccacaaagggcg

SEQ ID NO: 34633 - RNA, 20 nt, Artificial Sequence
  Synthetic
ucuggccgccacaaagggcg

SEQ ID NO: 34634 - RNA, 21 nt, Artificial Sequence
  Synthetic
cucuggccgccacaaagggcg

SEQ ID NO: 34635 - RNA, 22 nt, Artificial Sequence
  Synthetic
ccucuggccgccacaaagggcg

SEQ ID NO: 34636 - RNA, 23 nt, Artificial Sequence
  Synthetic
gccucuggccgccacaaagggcg

SEQ ID NO: 34637 - RNA, 24 nt, Artificial Sequence
  Synthetic
ggccucuggccgccacaaagggcg

SEQ ID NO: 34638 - RNA, 18 nt, Artificial Sequence
  Synthetic
guguugggggguggggcg

SEQ ID NO: 34639 - RNA, 19 nt, Artificial Sequence
  Synthetic
gguguugggggguggggcg

SEQ ID NO: 34640 - RNA, 20 nt, Artificial Sequence
  Synthetic
ggguguugggggguggggcg

SEQ ID NO: 34641 - RNA, 21 nt, Artificial Sequence
  Synthetic
uggguguugggggguggggcg

SEQ ID NO: 34642 - RNA, 22 nt, Artificial Sequence
  Synthetic
guggguguugggggguggggcg

SEQ ID NO: 34643 - RNA, 23 nt, Artificial Sequence
  Synthetic
cguggguguugggggguggggcg

SEQ ID NO: 34644 - RNA, 24 nt, Artificial Sequence
  Synthetic
acguggguguugggggguggggcg

SEQ ID NO: 34645 - RNA, 18 nt, Artificial Sequence
  Synthetic
auguaucgcggggaugcg

SEQ ID NO: 34646 - RNA, 19 nt, Artificial Sequence
  Synthetic
gauguaucgcggggaugcg

SEQ ID NO: 34647 - RNA, 20 nt, Artificial Sequence
  Synthetic
ggauguaucgcggggaugcg

SEQ ID NO: 34648 - RNA, 21 nt, Artificial Sequence
  Synthetic
uggauguaucgcggggaugcg

SEQ ID NO: 34649 - RNA, 22 nt, Artificial Sequence
  Synthetic
uuggauguaucgcggggaugcg

SEQ ID NO: 34650 - RNA, 23 nt, Artificial Sequence
  Synthetic
guuggauguaucgcggggaugcg

SEQ ID NO: 34651 - RNA, 24 nt, Artificial Sequence
  Synthetic
uguuggauguaucgcggggaugcg

SEQ ID NO: 34652 - RNA, 18 nt, Artificial Sequence
  Synthetic
cgugggagugggggugcg

SEQ ID NO: 34653 - RNA, 19 nt, Artificial Sequence
  Synthetic
gcgugggagugggggugcg

SEQ ID NO: 34654 - RNA, 20 nt, Artificial Sequence
  Synthetic
ugcgugggagugggggugcg

SEQ ID NO: 34655 - RNA, 21 nt, Artificial Sequence
  Synthetic
augcgugggagugggggugcg

SEQ ID NO: 34656 - RNA, 22 nt, Artificial Sequence
  Synthetic
gaugcgugggagugggggugcg

SEQ ID NO: 34657 - RNA, 23 nt, Artificial Sequence
  Synthetic
ggaugcgugggagugggggugcg

SEQ ID NO: 34658 - RNA, 24 nt, Artificial Sequence
  Synthetic
gggaugcgugggagugggggugcg

SEQ ID NO: 34659 - RNA, 21 nt, Artificial Sequence
  Synthetic
gugcgugggagugggggugcg

SEQ ID NO: 34660 - RNA, 22 nt, Artificial Sequence
  Synthetic
ggugcgugggagugggggugcg

SEQ ID NO: 34661 - RNA, 23 nt, Artificial Sequence
  Synthetic
gggugcgugggagugggggugcg

SEQ ID NO: 34662 - RNA, 24 nt, Artificial Sequence
  Synthetic
ggggugcgugggagugggggugcg

SEQ ID NO: 34663 - RNA, 18 nt, Artificial Sequence
  Synthetic
ucuguguuggauguaucg

SEQ ID NO: 34664 - RNA, 19 nt, Artificial Sequence
  Synthetic
gucuguguuggauguaucg

SEQ ID NO: 34665 - RNA, 20 nt, Artificial Sequence
  Synthetic
ugucuguguuggauguaucg

SEQ ID NO: 34666 - RNA, 21 nt, Artificial Sequence
  Synthetic
cugucuguguuggauguaucg

SEQ ID NO: 34667 - RNA, 22 nt, Artificial Sequence
  Synthetic
ccugucuguguuggauguaucg

SEQ ID NO: 34668 - RNA, 23 nt, Artificial Sequence
  Synthetic
cccugucuguguuggauguaucg

SEQ ID NO: 34669 - RNA, 24 nt, Artificial Sequence
  Synthetic
ucccugucuguguuggauguaucg

SEQ ID NO: 34670 - RNA, 18 nt, Artificial Sequence
  Synthetic
accagccaauccgugucg

SEQ ID NO: 34671 - RNA, 19 nt, Artificial Sequence
  Synthetic
caccagccaauccgugucg

SEQ ID NO: 34672 - RNA, 20 nt, Artificial Sequence
  Synthetic
acaccagccaauccgugucg

SEQ ID NO: 34673 - RNA, 21 nt, Artificial Sequence
  Synthetic
uacaccagccaauccgugucg

SEQ ID NO: 34674 - RNA, 22 nt, Artificial Sequence
  Synthetic
cuacaccagccaauccgugucg

SEQ ID NO: 34675 - RNA, 23 nt, Artificial Sequence
  Synthetic
acuacaccagccaauccgugucg

SEQ ID NO: 34676 - RNA, 24 nt, Artificial Sequence
  Synthetic
cacuacaccagccaauccgugucg

SEQ ID NO: 34677 - RNA, 18 nt, Artificial Sequence
  Synthetic
acuauagggcaacaaagg

SEQ ID NO: 34678 - RNA, 19 nt, Artificial Sequence
  Synthetic
cacuauagggcaacaaagg

SEQ ID NO: 34679 - RNA, 20 nt, Artificial Sequence
  Synthetic
acacuauagggcaacaaagg

SEQ ID NO: 34680 - RNA, 21 nt, Artificial Sequence
  Synthetic
uacacuauagggcaacaaagg

SEQ ID NO: 34681 - RNA, 22 nt, Artificial Sequence
  Synthetic
cuacacuauagggcaacaaagg

SEQ ID NO: 34682 - RNA, 23 nt, Artificial Sequence
  Synthetic
acuacacuauagggcaacaaagg

SEQ ID NO: 34683 - RNA, 24 nt, Artificial Sequence
  Synthetic
aacuacacuauagggcaacaaagg

SEQ ID NO: 34684 - RNA, 18 nt, Artificial Sequence
  Synthetic
cucuggccgccacaaagg

SEQ ID NO: 34685 - RNA, 19 nt, Artificial Sequence
  Synthetic
ccucuggccgccacaaagg

SEQ ID NO: 34686 - RNA, 20 nt, Artificial Sequence
  Synthetic
gccucuggccgccacaaagg

SEQ ID NO: 34687 - RNA, 21 nt, Artificial Sequence
  Synthetic
ggccucuggccgccacaaagg

SEQ ID NO: 34688 - RNA, 22 nt, Artificial Sequence
  Synthetic
uggccucuggccgccacaaagg

SEQ ID NO: 34689 - RNA, 23 nt, Artificial Sequence
  Synthetic
cuggccucuggccgccacaaagg

SEQ ID NO: 34690 - RNA, 24 nt, Artificial Sequence
  Synthetic
ccuggccucuggccgccacaaagg

SEQ ID NO: 34691 - RNA, 18 nt, Artificial Sequence
  Synthetic
ugcucggugguaugaagg

SEQ ID NO: 34692 - RNA, 19 nt, Artificial Sequence
  Synthetic
augcucggugguaugaagg

SEQ ID NO: 34693 - RNA, 20 nt, Artificial Sequence
  Synthetic
caugcucggugguaugaagg

SEQ ID NO: 34694 - RNA, 21 nt, Artificial Sequence
  Synthetic
gcaugcucggugguaugaagg

SEQ ID NO: 34695 - RNA, 22 nt, Artificial Sequence
  Synthetic
ggcaugcucggugguaugaagg

SEQ ID NO: 34696 - RNA, 23 nt, Artificial Sequence
  Synthetic
aggcaugcucggugguaugaagg

SEQ ID NO: 34697 - RNA, 24 nt, Artificial Sequence
  Synthetic
caggcaugcucggugguaugaagg

SEQ ID NO: 34698 - RNA, 18 nt, Artificial Sequence
  Synthetic
ucggugguaugaaggagg

SEQ ID NO: 34699 - RNA, 19 nt, Artificial Sequence
  Synthetic
cucggugguaugaaggagg

SEQ ID NO: 34700 - RNA, 20 nt, Artificial Sequence
  Synthetic
gcucggugguaugaaggagg

SEQ ID NO: 34701 - RNA, 21 nt, Artificial Sequence
  Synthetic
ugcucggugguaugaaggagg

SEQ ID NO: 34702 - RNA, 22 nt, Artificial Sequence
  Synthetic
augcucggugguaugaaggagg

SEQ ID NO: 34703 - RNA, 23 nt, Artificial Sequence
  Synthetic
caugcucggugguaugaaggagg

SEQ ID NO: 34704 - RNA, 24 nt, Artificial Sequence
  Synthetic
gcaugcucggugguaugaaggagg

SEQ ID NO: 34705 - RNA, 18 nt, Artificial Sequence
  Synthetic
cccguguuuguggggagg

SEQ ID NO: 34706 - RNA, 19 nt, Artificial Sequence
  Synthetic
ccccguguuuguggggagg

SEQ ID NO: 34707 - RNA, 20 nt, Artificial Sequence
  Synthetic
cccccguguuuguggggagg

SEQ ID NO: 34708 - RNA, 21 nt, Artificial Sequence
  Synthetic
ccccccguguuuguggggagg

SEQ ID NO: 34709 - RNA, 22 nt, Artificial Sequence
  Synthetic
gccccccguguuuguggggagg

SEQ ID NO: 34710 - RNA, 23 nt, Artificial Sequence
  Synthetic
cgccccccguguuuguggggagg

SEQ ID NO: 34711 - RNA, 24 nt, Artificial Sequence
  Synthetic
acgccccccguguuuguggggagg

SEQ ID NO: 34712 - RNA, 18 nt, Artificial Sequence
  Synthetic
gcgggccgcgguccccgg

SEQ ID NO: 34713 - RNA, 19 nt, Artificial Sequence
  Synthetic
ugcgggccgcgguccccgg

SEQ ID NO: 34714 - RNA, 20 nt, Artificial Sequence
  Synthetic
cugcgggccgcgguccccgg

SEQ ID NO: 34715 - RNA, 21 nt, Artificial Sequence
  Synthetic
gcugcgggccgcgguccccgg

SEQ ID NO: 34716 - RNA, 22 nt, Artificial Sequence
  Synthetic
ggcugcgggccgcgguccccgg

SEQ ID NO: 34717 - RNA, 23 nt, Artificial Sequence
  Synthetic
cggcugcgggccgcgguccccgg

SEQ ID NO: 34718 - RNA, 24 nt, Artificial Sequence
  Synthetic
ccggcugcgggccgcgguccccgg

SEQ ID NO: 34719 - RNA, 18 nt, Artificial Sequence
  Synthetic
ggccgccacaaagggcgg

SEQ ID NO: 34720 - RNA, 19 nt, Artificial Sequence
  Synthetic
uggccgccacaaagggcgg

SEQ ID NO: 34721 - RNA, 20 nt, Artificial Sequence
  Synthetic
cuggccgccacaaagggcgg

SEQ ID NO: 34722 - RNA, 21 nt, Artificial Sequence
  Synthetic
ucuggccgccacaaagggcgg

SEQ ID NO: 34723 - RNA, 22 nt, Artificial Sequence
  Synthetic
cucuggccgccacaaagggcgg

SEQ ID NO: 34724 - RNA, 23 nt, Artificial Sequence
  Synthetic
ccucuggccgccacaaagggcgg

SEQ ID NO: 34725 - RNA, 24 nt, Artificial Sequence
  Synthetic
gccucuggccgccacaaagggcgg

SEQ ID NO: 34726 - RNA, 18 nt, Artificial Sequence
  Synthetic
ucuggccgccacaaaggg

SEQ ID NO: 34727 - RNA, 19 nt, Artificial Sequence
  Synthetic
cucuggccgccacaaaggg

SEQ ID NO: 34728 - RNA, 20 nt, Artificial Sequence
  Synthetic
ccucuggccgccacaaaggg

SEQ ID NO: 34729 - RNA, 21 nt, Artificial Sequence
  Synthetic
gccucuggccgccacaaaggg

SEQ ID NO: 34730 - RNA, 22 nt, Artificial Sequence
  Synthetic
ggccucuggccgccacaaaggg

SEQ ID NO: 34731 - RNA, 23 nt, Artificial Sequence
  Synthetic
uggccucuggccgccacaaaggg

SEQ ID NO: 34732 - RNA, 24 nt, Artificial Sequence
  Synthetic
cuggccucuggccgccacaaaggg

SEQ ID NO: 34733 - RNA, 18 nt, Artificial Sequence
  Synthetic
gggggguggggcggaggg

SEQ ID NO: 34734 - RNA, 19 nt, Artificial Sequence
  Synthetic
ugggggguggggcggaggg

SEQ ID NO: 34735 - RNA, 20 nt, Artificial Sequence
  Synthetic
uugggggguggggcggaggg

SEQ ID NO: 34736 - RNA, 21 nt, Artificial Sequence
  Synthetic
guugggggguggggcggaggg

SEQ ID NO: 34737 - RNA, 22 nt, Artificial Sequence
  Synthetic
uguugggggguggggcggaggg

SEQ ID NO: 34738 - RNA, 23 nt, Artificial Sequence
  Synthetic
guguugggggguggggcggaggg

SEQ ID NO: 34739 - RNA, 24 nt, Artificial Sequence
  Synthetic
gguguugggggguggggcggaggg

SEQ ID NO: 34740 - RNA, 18 nt, Artificial Sequence
  Synthetic
agggggcgucgacccggg

SEQ ID NO: 34741 - RNA, 19 nt, Artificial Sequence
  Synthetic
cagggggcgucgacccggg

SEQ ID NO: 34742 - RNA, 20 nt, Artificial Sequence
  Synthetic
gcagggggcgucgacccggg

SEQ ID NO: 34743 - RNA, 21 nt, Artificial Sequence
  Synthetic
agcagggggcgucgacccggg

SEQ ID NO: 34744 - RNA, 22 nt, Artificial Sequence
  Synthetic
gagcagggggcgucgacccggg

SEQ ID NO: 34745 - RNA, 23 nt, Artificial Sequence
  Synthetic
ggagcagggggcgucgacccggg

SEQ ID NO: 34746 - RNA, 24 nt, Artificial Sequence
  Synthetic
gggagcagggggcgucgacccggg

SEQ ID NO: 34747 - RNA, 18 nt, Artificial Sequence
  Synthetic
gagggguggcggggcggg

SEQ ID NO: 34748 - RNA, 19 nt, Artificial Sequence
  Synthetic
ggagggguggcggggcggg

SEQ ID NO: 34749 - RNA, 20 nt, Artificial Sequence
  Synthetic
gggagggguggcggggcggg

SEQ ID NO: 34750 - RNA, 21 nt, Artificial Sequence
  Synthetic
ugggagggguggcggggcggg

SEQ ID NO: 34751 - RNA, 22 nt, Artificial Sequence
  Synthetic
augggagggguggcggggcggg

SEQ ID NO: 34752 - RNA, 23 nt, Artificial Sequence
  Synthetic
gaugggagggguggcggggcggg

SEQ ID NO: 34753 - RNA, 24 nt, Artificial Sequence
  Synthetic
ggaugggagggguggcggggcggg

SEQ ID NO: 34754 - RNA, 18 nt, Artificial Sequence
  Synthetic
gaugggagggguggcggg

SEQ ID NO: 34755 - RNA, 19 nt, Artificial Sequence
  Synthetic
ggaugggagggguggcggg

SEQ ID NO: 34756 - RNA, 20 nt, Artificial Sequence
  Synthetic
aggaugggagggguggcggg

SEQ ID NO: 34757 - RNA, 21 nt, Artificial Sequence
  Synthetic
aaggaugggagggguggcggg

SEQ ID NO: 34758 - RNA, 22 nt, Artificial Sequence
  Synthetic
aaaggaugggagggguggcggg

SEQ ID NO: 34759 - RNA, 23 nt, Artificial Sequence
  Synthetic
caaaggaugggagggguggcggg

SEQ ID NO: 34760 - RNA, 24 nt, Artificial Sequence
  Synthetic
acaaaggaugggagggguggcggg

SEQ ID NO: 34761 - RNA, 18 nt, Artificial Sequence
  Synthetic
cagccaauccgugucggg

SEQ ID NO: 34762 - RNA, 19 nt, Artificial Sequence
  Synthetic
ccagccaauccgugucggg

SEQ ID NO: 34763 - RNA, 20 nt, Artificial Sequence
  Synthetic
accagccaauccgugucggg

SEQ ID NO: 34764 - RNA, 21 nt, Artificial Sequence
  Synthetic
caccagccaauccgugucggg

SEQ ID NO: 34765 - RNA, 22 nt, Artificial Sequence
  Synthetic
acaccagccaauccgugucggg

SEQ ID NO: 34766 - RNA, 23 nt, Artificial Sequence
  Synthetic
uacaccagccaauccgugucggg

SEQ ID NO: 34767 - RNA, 24 nt, Artificial Sequence
  Synthetic
cuacaccagccaauccgugucggg

SEQ ID NO: 34768 - RNA, 18 nt, Artificial Sequence
  Synthetic
aucacaggagacgagggg

SEQ ID NO: 34769 - RNA, 19 nt, Artificial Sequence
  Synthetic
aaucacaggagacgagggg

SEQ ID NO: 34770 - RNA, 20 nt, Artificial Sequence
  Synthetic
gaaucacaggagacgagggg

SEQ ID NO: 34771 - RNA, 21 nt, Artificial Sequence
  Synthetic
agaaucacaggagacgagggg

SEQ ID NO: 34772 - RNA, 22 nt, Artificial Sequence
  Synthetic
gagaaucacaggagacgagggg

SEQ ID NO: 34773 - RNA, 23 nt, Artificial Sequence
  Synthetic
agagaaucacaggagacgagggg

SEQ ID NO: 34774 - RNA, 24 nt, Artificial Sequence
  Synthetic
cagagaaucacaggagacgagggg

SEQ ID NO: 34775 - RNA, 18 nt, Artificial Sequence
  Synthetic
ggggguggggcggagggg

SEQ ID NO: 34776 - RNA, 19 nt, Artificial Sequence
  Synthetic
gggggguggggcggagggg

SEQ ID NO: 34777 - RNA, 20 nt, Artificial Sequence
  Synthetic
ugggggguggggcggagggg

SEQ ID NO: 34778 - RNA, 21 nt, Artificial Sequence
  Synthetic
uugggggguggggcggagggg

SEQ ID NO: 34779 - RNA, 22 nt, Artificial Sequence
  Synthetic
guugggggguggggcggagggg

SEQ ID NO: 34780 - RNA, 23 nt, Artificial Sequence
  Synthetic
uguugggggguggggcggagggg

SEQ ID NO: 34781 - RNA, 24 nt, Artificial Sequence
  Synthetic
guguugggggguggggcggagggg

SEQ ID NO: 34782 - RNA, 18 nt, Artificial Sequence
  Synthetic
augggagggguggcgggg

SEQ ID NO: 34783 - RNA, 19 nt, Artificial Sequence
  Synthetic
gaugggagggguggcgggg

SEQ ID NO: 34784 - RNA, 20 nt, Artificial Sequence
  Synthetic
ggaugggagggguggcgggg

SEQ ID NO: 34785 - RNA, 21 nt, Artificial Sequence
  Synthetic
aggaugggagggguggcgggg

SEQ ID NO: 34786 - RNA, 22 nt, Artificial Sequence
  Synthetic
aaggaugggagggguggcgggg

SEQ ID NO: 34787 - RNA, 23 nt, Artificial Sequence
  Synthetic
aaaggaugggagggguggcgggg

SEQ ID NO: 34788 - RNA, 24 nt, Artificial Sequence
  Synthetic
caaaggaugggagggguggcgggg

SEQ ID NO: 34789 - RNA, 18 nt, Artificial Sequence
  Synthetic
agccaauccgugucgggg

SEQ ID NO: 34790 - RNA, 19 nt, Artificial Sequence
  Synthetic
cagccaauccgugucgggg

SEQ ID NO: 34791 - RNA, 20 nt, Artificial Sequence
  Synthetic
ccagccaauccgugucgggg

SEQ ID NO: 34792 - RNA, 21 nt, Artificial Sequence
  Synthetic
accagccaauccgugucgggg

SEQ ID NO: 34793 - RNA, 22 nt, Artificial Sequence
  Synthetic
caccagccaauccgugucgggg

SEQ ID NO: 34794 - RNA, 23 nt, Artificial Sequence
  Synthetic
acaccagccaauccgugucgggg

SEQ ID NO: 34795 - RNA, 24 nt, Artificial Sequence
  Synthetic
uacaccagccaauccgugucgggg

SEQ ID NO: 34796 - RNA, 18 nt, Artificial Sequence
  Synthetic
gcuucugggccgcggggg

SEQ ID NO: 34797 - RNA, 19 nt, Artificial Sequence
  Synthetic
ugcuucugggccgcggggg

SEQ ID NO: 34798 - RNA, 20 nt, Artificial Sequence
  Synthetic
cugcuucugggccgcggggg

SEQ ID NO: 34799 - RNA, 21 nt, Artificial Sequence
  Synthetic
gcugcuucugggccgcggggg

SEQ ID NO: 34800 - RNA, 22 nt, Artificial Sequence
  Synthetic
cgcugcuucugggccgcggggg

SEQ ID NO: 34801 - RNA, 23 nt, Artificial Sequence
  Synthetic
gcgcugcuucugggccgcggggg

SEQ ID NO: 34802 - RNA, 24 nt, Artificial Sequence
  Synthetic
cgcgcugcuucugggccgcggggg

SEQ ID NO: 34803 - RNA, 18 nt, Artificial Sequence
  Synthetic
uuuguggggagggggggg

SEQ ID NO: 34804 - RNA, 19 nt, Artificial Sequence
  Synthetic
guuuguggggagggggggg

SEQ ID NO: 34805 - RNA, 20 nt, Artificial Sequence
  Synthetic
uguuuguggggagggggggg

SEQ ID NO: 34806 - RNA, 21 nt, Artificial Sequence
  Synthetic
guguuuguggggagggggggg

SEQ ID NO: 34807 - RNA, 22 nt, Artificial Sequence
  Synthetic
cguguuuguggggagggggggg

SEQ ID NO: 34808 - RNA, 23 nt, Artificial Sequence
  Synthetic
ccguguuuguggggagggggggg

SEQ ID NO: 34809 - RNA, 24 nt, Artificial Sequence
  Synthetic
cccguguuuguggggagggggggg

SEQ ID NO: 34810 - RNA, 18 nt, Artificial Sequence
  Synthetic
gcggaggggugggggggg

SEQ ID NO: 34811 - RNA, 19 nt, Artificial Sequence
  Synthetic
ggcggaggggugggggggg

SEQ ID NO: 34812 - RNA, 20 nt, Artificial Sequence
  Synthetic
gggcggaggggugggggggg

SEQ ID NO: 34813 - RNA, 21 nt, Artificial Sequence
  Synthetic
ggggcggaggggugggggggg

SEQ ID NO: 34814 - RNA, 22 nt, Artificial Sequence
  Synthetic
uggggcggaggggugggggggg

SEQ ID NO: 34815 - RNA, 23 nt, Artificial Sequence
  Synthetic
guggggcggaggggugggggggg

SEQ ID NO: 34816 - RNA, 24 nt, Artificial Sequence
  Synthetic
gguggggcggaggggugggggggg

SEQ ID NO: 34817 - RNA, 18 nt, Artificial Sequence
  Synthetic
ggcggagggguggggggg

SEQ ID NO: 34818 - RNA, 19 nt, Artificial Sequence
  Synthetic
gggcggagggguggggggg

SEQ ID NO: 34819 - RNA, 20 nt, Artificial Sequence
  Synthetic
ggggcggagggguggggggg

SEQ ID NO: 34820 - RNA, 21 nt, Artificial Sequence
  Synthetic
uggggcggagggguggggggg

SEQ ID NO: 34821 - RNA, 22 nt, Artificial Sequence
  Synthetic
guggggcggagggguggggggg

SEQ ID NO: 34822 - RNA, 23 nt, Artificial Sequence
  Synthetic
gguggggcggagggguggggggg

SEQ ID NO: 34823 - RNA, 24 nt, Artificial Sequence
  Synthetic
ggguggggcggagggguggggggg

SEQ ID NO: 34824 - RNA, 18 nt, Artificial Sequence
  Synthetic
gggcggaggggugggggg

SEQ ID NO: 34825 - RNA, 19 nt, Artificial Sequence
  Synthetic
ggggcggaggggugggggg

SEQ ID NO: 34826 - RNA, 20 nt, Artificial Sequence
  Synthetic
uggggcggaggggugggggg

SEQ ID NO: 34827 - RNA, 21 nt, Artificial Sequence
  Synthetic
guggggcggaggggugggggg

SEQ ID NO: 34828 - RNA, 22 nt, Artificial Sequence
  Synthetic
gguggggcggaggggugggggg

SEQ ID NO: 34829 - RNA, 23 nt, Artificial Sequence
  Synthetic
ggguggggcggaggggugggggg

SEQ ID NO: 34830 - RNA, 24 nt, Artificial Sequence
  Synthetic
gggguggggcggaggggugggggg

SEQ ID NO: 34831 - RNA, 18 nt, Artificial Sequence
  Synthetic
gacguggguguugggggg

SEQ ID NO: 34832 - RNA, 19 nt, Artificial Sequence
  Synthetic
agacguggguguugggggg

SEQ ID NO: 34833 - RNA, 20 nt, Artificial Sequence
  Synthetic
cagacguggguguugggggg

SEQ ID NO: 34834 - RNA, 21 nt, Artificial Sequence
  Synthetic
acagacguggguguugggggg

SEQ ID NO: 34835 - RNA, 22 nt, Artificial Sequence
  Synthetic
cacagacguggguguugggggg

SEQ ID NO: 34836 - RNA, 23 nt, Artificial Sequence
  Synthetic
ccacagacguggguguugggggg

SEQ ID NO: 34837 - RNA, 24 nt, Artificial Sequence
  Synthetic
accacagacguggguguugggggg

SEQ ID NO: 34838 - RNA, 18 nt, Artificial Sequence
  Synthetic
ggggcggagggguggggg

SEQ ID NO: 34839 - RNA, 19 nt, Artificial Sequence
  Synthetic
uggggcggagggguggggg

SEQ ID NO: 34840 - RNA, 20 nt, Artificial Sequence
  Synthetic
guggggcggagggguggggg

SEQ ID NO: 34841 - RNA, 21 nt, Artificial Sequence
  Synthetic
gguggggcggagggguggggg

SEQ ID NO: 34842 - RNA, 22 nt, Artificial Sequence
  Synthetic
ggguggggcggagggguggggg

SEQ ID NO: 34843 - RNA, 23 nt, Artificial Sequence
  Synthetic
gggguggggcggagggguggggg

SEQ ID NO: 34844 - RNA, 24 nt, Artificial Sequence
  Synthetic
ggggguggggcggagggguggggg

SEQ ID NO: 34845 - RNA, 18 nt, Artificial Sequence
  Synthetic
agacguggguguuggggg

SEQ ID NO: 34846 - RNA, 19 nt, Artificial Sequence
  Synthetic
cagacguggguguuggggg

SEQ ID NO: 34847 - RNA, 20 nt, Artificial Sequence
  Synthetic
acagacguggguguuggggg

SEQ ID NO: 34848 - RNA, 21 nt, Artificial Sequence
  Synthetic
cacagacguggguguuggggg

SEQ ID NO: 34849 - RNA, 22 nt, Artificial Sequence
  Synthetic
ccacagacguggguguuggggg

SEQ ID NO: 34850 - RNA, 23 nt, Artificial Sequence
  Synthetic
accacagacguggguguuggggg

SEQ ID NO: 34851 - RNA, 24 nt, Artificial Sequence
  Synthetic
caccacagacguggguguuggggg

SEQ ID NO: 34852 - RNA, 18 nt, Artificial Sequence
  Synthetic
uggggcggaggggugggg

SEQ ID NO: 34853 - RNA, 19 nt, Artificial Sequence
  Synthetic
guggggcggaggggugggg

SEQ ID NO: 34854 - RNA, 20 nt, Artificial Sequence
  Synthetic
gguggggcggaggggugggg

SEQ ID NO: 34855 - RNA, 21 nt, Artificial Sequence
  Synthetic
ggguggggcggaggggugggg

SEQ ID NO: 34856 - RNA, 22 nt, Artificial Sequence
  Synthetic
gggguggggcggaggggugggg

SEQ ID NO: 34857 - RNA, 23 nt, Artificial Sequence
  Synthetic
ggggguggggcggaggggugggg

SEQ ID NO: 34858 - RNA, 24 nt, Artificial Sequence
  Synthetic
gggggguggggcggaggggugggg

SEQ ID NO: 34859 - RNA, 18 nt, Artificial Sequence
  Synthetic
ggguguuggggggugggg

SEQ ID NO: 34860 - RNA, 19 nt, Artificial Sequence
  Synthetic
uggguguuggggggugggg

SEQ ID NO: 34861 - RNA, 20 nt, Artificial Sequence
  Synthetic
guggguguuggggggugggg

SEQ ID NO: 34862 - RNA, 21 nt, Artificial Sequence
  Synthetic
cguggguguuggggggugggg

SEQ ID NO: 34863 - RNA, 22 nt, Artificial Sequence
  Synthetic
acguggguguuggggggugggg

SEQ ID NO: 34864 - RNA, 23 nt, Artificial Sequence
  Synthetic
gacguggguguuggggggugggg

SEQ ID NO: 34865 - RNA, 24 nt, Artificial Sequence
  Synthetic
agacguggguguuggggggugggg

SEQ ID NO: 34866 - RNA, 18 nt, Artificial Sequence
  Synthetic
ccccccguguuugugggg

SEQ ID NO: 34867 - RNA, 19 nt, Artificial Sequence
  Synthetic
gccccccguguuugugggg

SEQ ID NO: 34868 - RNA, 20 nt, Artificial Sequence
  Synthetic
cgccccccguguuugugggg

SEQ ID NO: 34869 - RNA, 21 nt, Artificial Sequence
  Synthetic
acgccccccguguuugugggg

SEQ ID NO: 34870 - RNA, 22 nt, Artificial Sequence
  Synthetic
gacgccccccguguuugugggg

SEQ ID NO: 34871 - RNA, 23 nt, Artificial Sequence
  Synthetic
ggacgccccccguguuugugggg

SEQ ID NO: 34872 - RNA, 24 nt, Artificial Sequence
  Synthetic
gggacgccccccguguuugugggg

SEQ ID NO: 34873 - RNA, 18 nt, Artificial Sequence
  Synthetic
guggggcggagggguggg

SEQ ID NO: 34874 - RNA, 19 nt, Artificial Sequence
  Synthetic
gguggggcggagggguggg

SEQ ID NO: 34875 - RNA, 20 nt, Artificial Sequence
  Synthetic
ggguggggcggagggguggg

SEQ ID NO: 34876 - RNA, 21 nt, Artificial Sequence
  Synthetic
gggguggggcggagggguggg

SEQ ID NO: 34877 - RNA, 22 nt, Artificial Sequence
  Synthetic
ggggguggggcggagggguggg

SEQ ID NO: 34878 - RNA, 23 nt, Artificial Sequence
  Synthetic
gggggguggggcggagggguggg

SEQ ID NO: 34879 - RNA, 24 nt, Artificial Sequence
  Synthetic
ugggggguggggcggagggguggg

SEQ ID NO: 34880 - RNA, 18 nt, Artificial Sequence
  Synthetic
uggguguugggggguggg

SEQ ID NO: 34881 - RNA, 19 nt, Artificial Sequence
  Synthetic
guggguguugggggguggg

SEQ ID NO: 34882 - RNA, 20 nt, Artificial Sequence
  Synthetic
cguggguguugggggguggg

SEQ ID NO: 34883 - RNA, 21 nt, Artificial Sequence
  Synthetic
acguggguguugggggguggg

SEQ ID NO: 34884 - RNA, 22 nt, Artificial Sequence
  Synthetic
gacguggguguugggggguggg

SEQ ID NO: 34885 - RNA, 23 nt, Artificial Sequence
  Synthetic
agacguggguguugggggguggg

SEQ ID NO: 34886 - RNA, 24 nt, Artificial Sequence
  Synthetic
cagacguggguguugggggguggg

SEQ ID NO: 34887 - RNA, 18 nt, Artificial Sequence
  Synthetic
gccccccguguuuguggg

SEQ ID NO: 34888 - RNA, 19 nt, Artificial Sequence
  Synthetic
cgccccccguguuuguggg

SEQ ID NO: 34889 - RNA, 20 nt, Artificial Sequence
  Synthetic
acgccccccguguuuguggg

SEQ ID NO: 34890 - RNA, 21 nt, Artificial Sequence
  Synthetic
gacgccccccguguuuguggg

SEQ ID NO: 34891 - RNA, 22 nt, Artificial Sequence
  Synthetic
ggacgccccccguguuuguggg

SEQ ID NO: 34892 - RNA, 23 nt, Artificial Sequence
  Synthetic
gggacgccccccguguuuguggg

SEQ ID NO: 34893 - RNA, 24 nt, Artificial Sequence
  Synthetic
agggacgccccccguguuuguggg

SEQ ID NO: 34894 - RNA, 18 nt, Artificial Sequence
  Synthetic
uagggcaacaaaggaugg

SEQ ID NO: 34895 - RNA, 19 nt, Artificial Sequence
  Synthetic
auagggcaacaaaggaugg

SEQ ID NO: 34896 - RNA, 20 nt, Artificial Sequence
  Synthetic
uauagggcaacaaaggaugg

SEQ ID NO: 34897 - RNA, 21 nt, Artificial Sequence
  Synthetic
cuauagggcaacaaaggaugg

SEQ ID NO: 34898 - RNA, 22 nt, Artificial Sequence
  Synthetic
acuauagggcaacaaaggaugg

SEQ ID NO: 34899 - RNA, 23 nt, Artificial Sequence
  Synthetic
cacuauagggcaacaaaggaugg

SEQ ID NO: 34900 - RNA, 24 nt, Artificial Sequence
  Synthetic
acacuauagggcaacaaaggaugg

SEQ ID NO: 34901 - RNA, 18 nt, Artificial Sequence
  Synthetic
gguggggcggaggggugg

SEQ ID NO: 34902 - RNA, 19 nt, Artificial Sequence
  Synthetic
ggguggggcggaggggugg

SEQ ID NO: 34903 - RNA, 20 nt, Artificial Sequence
  Synthetic
gggguggggcggaggggugg

SEQ ID NO: 34904 - RNA, 21 nt, Artificial Sequence
  Synthetic
ggggguggggcggaggggugg

SEQ ID NO: 34905 - RNA, 22 nt, Artificial Sequence
  Synthetic
gggggguggggcggaggggugg

SEQ ID NO: 34906 - RNA, 23 nt, Artificial Sequence
  Synthetic
ugggggguggggcggaggggugg

SEQ ID NO: 34907 - RNA, 24 nt, Artificial Sequence
  Synthetic
uugggggguggggcggaggggugg

SEQ ID NO: 34908 - RNA, 18 nt, Artificial Sequence
  Synthetic
aaaggaugggaggggugg

SEQ ID NO: 34909 - RNA, 19 nt, Artificial Sequence
  Synthetic
caaaggaugggaggggugg

SEQ ID NO: 34910 - RNA, 20 nt, Artificial Sequence
  Synthetic
acaaaggaugggaggggugg

SEQ ID NO: 34911 - RNA, 21 nt, Artificial Sequence
  Synthetic
aacaaaggaugggaggggugg

SEQ ID NO: 34912 - RNA, 22 nt, Artificial Sequence
  Synthetic
caacaaaggaugggaggggugg

SEQ ID NO: 34913 - RNA, 23 nt, Artificial Sequence
  Synthetic
gcaacaaaggaugggaggggugg

SEQ ID NO: 34914 - RNA, 24 nt, Artificial Sequence
  Synthetic
ggcaacaaaggaugggaggggugg

SEQ ID NO: 34915 - RNA, 18 nt, Artificial Sequence
  Synthetic
gggagugggggugccaug

SEQ ID NO: 34916 - RNA, 19 nt, Artificial Sequence
  Synthetic
ugggagugggggugccaug

SEQ ID NO: 34917 - RNA, 20 nt, Artificial Sequence
  Synthetic
gugggagugggggugccaug

SEQ ID NO: 34918 - RNA, 21 nt, Artificial Sequence
  Synthetic
cgugggagugggggugccaug

SEQ ID NO: 34919 - RNA, 22 nt, Artificial Sequence
  Synthetic
gcgugggagugggggugccaug

SEQ ID NO: 34920 - RNA, 23 nt, Artificial Sequence
  Synthetic
ugcgugggagugggggugccaug

SEQ ID NO: 34921 - RNA, 24 nt, Artificial Sequence
  Synthetic
gugcgugggagugggggugccaug

SEQ ID NO: 34922 - RNA, 18 nt, Artificial Sequence
  Synthetic
ggcaugcucggugguaug

SEQ ID NO: 34923 - RNA, 19 nt, Artificial Sequence
  Synthetic
aggcaugcucggugguaug

SEQ ID NO: 34924 - RNA, 20 nt, Artificial Sequence
  Synthetic
caggcaugcucggugguaug

SEQ ID NO: 34925 - RNA, 21 nt, Artificial Sequence
  Synthetic
ccaggcaugcucggugguaug

SEQ ID NO: 34926 - RNA, 22 nt, Artificial Sequence
  Synthetic
cccaggcaugcucggugguaug

SEQ ID NO: 34927 - RNA, 23 nt, Artificial Sequence
  Synthetic
acccaggcaugcucggugguaug

SEQ ID NO: 34928 - RNA, 24 nt, Artificial Sequence
  Synthetic
cacccaggcaugcucggugguaug

SEQ ID NO: 34929 - RNA, 18 nt, Artificial Sequence
  Synthetic
ggggcguacgugguccug

SEQ ID NO: 34930 - RNA, 19 nt, Artificial Sequence
  Synthetic
cggggcguacgugguccug

SEQ ID NO: 34931 - RNA, 20 nt, Artificial Sequence
  Synthetic
ucggggcguacgugguccug

SEQ ID NO: 34932 - RNA, 21 nt, Artificial Sequence
  Synthetic
aucggggcguacgugguccug

SEQ ID NO: 34933 - RNA, 22 nt, Artificial Sequence
  Synthetic
caucggggcguacgugguccug

SEQ ID NO: 34934 - RNA, 23 nt, Artificial Sequence
  Synthetic
acaucggggcguacgugguccug

SEQ ID NO: 34935 - RNA, 24 nt, Artificial Sequence
  Synthetic
aacaucggggcguacgugguccug

SEQ ID NO: 34936 - RNA, 18 nt, Artificial Sequence
  Synthetic
ggggauuuuugcugucug

SEQ ID NO: 34937 - RNA, 19 nt, Artificial Sequence
  Synthetic
aggggauuuuugcugucug

SEQ ID NO: 34938 - RNA, 20 nt, Artificial Sequence
  Synthetic
caggggauuuuugcugucug

SEQ ID NO: 34939 - RNA, 21 nt, Artificial Sequence
  Synthetic
ucaggggauuuuugcugucug

SEQ ID NO: 34940 - RNA, 22 nt, Artificial Sequence
  Synthetic
cucaggggauuuuugcugucug

SEQ ID NO: 34941 - RNA, 23 nt, Artificial Sequence
  Synthetic
acucaggggauuuuugcugucug

SEQ ID NO: 34942 - RNA, 24 nt, Artificial Sequence
  Synthetic
aacucaggggauuuuugcugucug

SEQ ID NO: 34943 - RNA, 18 nt, Artificial Sequence
  Synthetic
cucuggaugacccccgug

SEQ ID NO: 34944 - RNA, 19 nt, Artificial Sequence
  Synthetic
ccucuggaugacccccgug

SEQ ID NO: 34945 - RNA, 20 nt, Artificial Sequence
  Synthetic
gccucuggaugacccccgug

SEQ ID NO: 34946 - RNA, 21 nt, Artificial Sequence
  Synthetic
agccucuggaugacccccgug

SEQ ID NO: 34947 - RNA, 22 nt, Artificial Sequence
  Synthetic
cagccucuggaugacccccgug

SEQ ID NO: 34948 - RNA, 23 nt, Artificial Sequence
  Synthetic
acagccucuggaugacccccgug

SEQ ID NO: 34949 - RNA, 24 nt, Artificial Sequence
  Synthetic
aacagccucuggaugacccccgug

SEQ ID NO: 34950 - RNA, 18 nt, Artificial Sequence
  Synthetic
uacaccagccaauccgug

SEQ ID NO: 34951 - RNA, 19 nt, Artificial Sequence
  Synthetic
cuacaccagccaauccgug

SEQ ID NO: 34952 - RNA, 20 nt, Artificial Sequence
  Synthetic
acuacaccagccaauccgug

SEQ ID NO: 34953 - RNA, 21 nt, Artificial Sequence
  Synthetic
cacuacaccagccaauccgug

SEQ ID NO: 34954 - RNA, 22 nt, Artificial Sequence
  Synthetic
ccacuacaccagccaauccgug

SEQ ID NO: 34955 - RNA, 23 nt, Artificial Sequence
  Synthetic
cccacuacaccagccaauccgug

SEQ ID NO: 34956 - RNA, 24 nt, Artificial Sequence
  Synthetic
gcccacuacaccagccaauccgug

SEQ ID NO: 34957 - RNA, 18 nt, Artificial Sequence
  Synthetic
ggguggggcggaggggug

SEQ ID NO: 34958 - RNA, 19 nt, Artificial Sequence
  Synthetic
gggguggggcggaggggug

SEQ ID NO: 34959 - RNA, 20 nt, Artificial Sequence
  Synthetic
ggggguggggcggaggggug

SEQ ID NO: 34960 - RNA, 21 nt, Artificial Sequence
  Synthetic
gggggguggggcggaggggug

SEQ ID NO: 34961 - RNA, 22 nt, Artificial Sequence
  Synthetic
ugggggguggggcggaggggug

SEQ ID NO: 34962 - RNA, 23 nt, Artificial Sequence
  Synthetic
uugggggguggggcggaggggug

SEQ ID NO: 34963 - RNA, 24 nt, Artificial Sequence
  Synthetic
guugggggguggggcggaggggug

SEQ ID NO: 34964 - RNA, 18 nt, Artificial Sequence
  Synthetic
caaaggaugggaggggug

SEQ ID NO: 34965 - RNA, 19 nt, Artificial Sequence
  Synthetic
acaaaggaugggaggggug

SEQ ID NO: 34966 - RNA, 20 nt, Artificial Sequence
  Synthetic
aacaaaggaugggaggggug

SEQ ID NO: 34967 - RNA, 21 nt, Artificial Sequence
  Synthetic
caacaaaggaugggaggggug

SEQ ID NO: 34968 - RNA, 22 nt, Artificial Sequence
  Synthetic
gcaacaaaggaugggaggggug

SEQ ID NO: 34969 - RNA, 23 nt, Artificial Sequence
  Synthetic
ggcaacaaaggaugggaggggug

SEQ ID NO: 34970 - RNA, 24 nt, Artificial Sequence
  Synthetic
gggcaacaaaggaugggaggggug

SEQ ID NO: 34971 - RNA, 18 nt, Artificial Sequence
  Synthetic
acaccacagacgugggug

SEQ ID NO: 34972 - RNA, 19 nt, Artificial Sequence
  Synthetic
cacaccacagacgugggug

SEQ ID NO: 34973 - RNA, 20 nt, Artificial Sequence
  Synthetic
ccacaccacagacgugggug

SEQ ID NO: 34974 - RNA, 21 nt, Artificial Sequence
  Synthetic
gccacaccacagacgugggug

SEQ ID NO: 34975 - RNA, 22 nt, Artificial Sequence
  Synthetic
ggccacaccacagacgugggug

SEQ ID NO: 34976 - RNA, 23 nt, Artificial Sequence
  Synthetic
cggccacaccacagacgugggug

SEQ ID NO: 34977 - RNA, 24 nt, Artificial Sequence
  Synthetic
ucggccacaccacagacgugggug

SEQ ID NO: 34978 - RNA, 18 nt, Artificial Sequence
  Synthetic
acgccccccguguuugug

SEQ ID NO: 34979 - RNA, 19 nt, Artificial Sequence
  Synthetic
gacgccccccguguuugug

SEQ ID NO: 34980 - RNA, 20 nt, Artificial Sequence
  Synthetic
ggacgccccccguguuugug

SEQ ID NO: 34981 - RNA, 21 nt, Artificial Sequence
  Synthetic
gggacgccccccguguuugug

SEQ ID NO: 34982 - RNA, 22 nt, Artificial Sequence
  Synthetic
agggacgccccccguguuugug

SEQ ID NO: 34983 - RNA, 23 nt, Artificial Sequence
  Synthetic
aagggacgccccccguguuugug

SEQ ID NO: 34984 - RNA, 24 nt, Artificial Sequence
  Synthetic
uaagggacgccccccguguuugug

SEQ ID NO: 34985 - RNA, 18 nt, Artificial Sequence
  Synthetic
ggacgccccccguguuug

SEQ ID NO: 34986 - RNA, 19 nt, Artificial Sequence
  Synthetic
gggacgccccccguguuug

SEQ ID NO: 34987 - RNA, 20 nt, Artificial Sequence
  Synthetic
agggacgccccccguguuug

SEQ ID NO: 34988 - RNA, 21 nt, Artificial Sequence
  Synthetic
aagggacgccccccguguuug

SEQ ID NO: 34989 - RNA, 22 nt, Artificial Sequence
  Synthetic
uaagggacgccccccguguuug

SEQ ID NO: 34990 - RNA, 23 nt, Artificial Sequence
  Synthetic
auaagggacgccccccguguuug

SEQ ID NO: 34991 - RNA, 24 nt, Artificial Sequence
  Synthetic
aauaagggacgccccccguguuug

SEQ ID NO: 34992 - RNA, 18 nt, Artificial Sequence
  Synthetic
gggacgagggaaaacaau

SEQ ID NO: 34993 - RNA, 19 nt, Artificial Sequence
  Synthetic
cgggacgagggaaaacaau

SEQ ID NO: 34994 - RNA, 20 nt, Artificial Sequence
  Synthetic
ccgggacgagggaaaacaau

SEQ ID NO: 34995 - RNA, 21 nt, Artificial Sequence
  Synthetic
cccgggacgagggaaaacaau

SEQ ID NO: 34996 - RNA, 22 nt, Artificial Sequence
  Synthetic
acccgggacgagggaaaacaau

SEQ ID NO: 34997 - RNA, 23 nt, Artificial Sequence
  Synthetic
gacccgggacgagggaaaacaau

SEQ ID NO: 34998 - RNA, 24 nt, Artificial Sequence
  Synthetic
cgacccgggacgagggaaaacaau

SEQ ID NO: 34999 - RNA, 18 nt, Artificial Sequence
  Synthetic
cauggagacggggaacau

SEQ ID NO: 35000 - RNA, 19 nt, Artificial Sequence
  Synthetic
acauggagacggggaacau

SEQ ID NO: 35001 - RNA, 20 nt, Artificial Sequence
  Synthetic
gacauggagacggggaacau

SEQ ID NO: 35002 - RNA, 21 nt, Artificial Sequence
  Synthetic
ggacauggagacggggaacau

SEQ ID NO: 35003 - RNA, 22 nt, Artificial Sequence
  Synthetic
uggacauggagacggggaacau

SEQ ID NO: 35004 - RNA, 23 nt, Artificial Sequence
  Synthetic
cuggacauggagacggggaacau

SEQ ID NO: 35005 - RNA, 24 nt, Artificial Sequence
  Synthetic
ccuggacauggagacggggaacau

SEQ ID NO: 35006 - RNA, 18 nt, Artificial Sequence
  Synthetic
uauagggcaacaaaggau

SEQ ID NO: 35007 - RNA, 19 nt, Artificial Sequence
  Synthetic
cuauagggcaacaaaggau

SEQ ID NO: 35008 - RNA, 20 nt, Artificial Sequence
  Synthetic
acuauagggcaacaaaggau

SEQ ID NO: 35009 - RNA, 21 nt, Artificial Sequence
  Synthetic
cacuauagggcaacaaaggau

SEQ ID NO: 35010 - RNA, 22 nt, Artificial Sequence
  Synthetic
acacuauagggcaacaaaggau

SEQ ID NO: 35011 - RNA, 23 nt, Artificial Sequence
  Synthetic
uacacuauagggcaacaaaggau

SEQ ID NO: 35012 - RNA, 24 nt, Artificial Sequence
  Synthetic
cuacacuauagggcaacaaaggau

SEQ ID NO: 35013 - RNA, 18 nt, Artificial Sequence
  Synthetic
cccuaauaaaaaaaaacu

SEQ ID NO: 35014 - RNA, 19 nt, Artificial Sequence
  Synthetic
gcccuaauaaaaaaaaacu

SEQ ID NO: 35015 - RNA, 20 nt, Artificial Sequence
  Synthetic
ggcccuaauaaaaaaaaacu

SEQ ID NO: 35016 - RNA, 21 nt, Artificial Sequence
  Synthetic
uggcccuaauaaaaaaaaacu

SEQ ID NO: 35017 - RNA, 22 nt, Artificial Sequence
  Synthetic
uuggcccuaauaaaaaaaaacu

SEQ ID NO: 35018 - RNA, 23 nt, Artificial Sequence
  Synthetic
guuggcccuaauaaaaaaaaacu

SEQ ID NO: 35019 - RNA, 24 nt, Artificial Sequence
  Synthetic
uguuggcccuaauaaaaaaaaacu

SEQ ID NO: 35020 - RNA, 18 nt, Artificial Sequence
  Synthetic
aaacauggcgacccggcu

SEQ ID NO: 35021 - RNA, 19 nt, Artificial Sequence
  Synthetic
gaaacauggcgacccggcu

SEQ ID NO: 35022 - RNA, 20 nt, Artificial Sequence
  Synthetic
ggaaacauggcgacccggcu

SEQ ID NO: 35023 - RNA, 21 nt, Artificial Sequence
  Synthetic
gggaaacauggcgacccggcu

SEQ ID NO: 35024 - RNA, 22 nt, Artificial Sequence
  Synthetic
cgggaaacauggcgacccggcu

SEQ ID NO: 35025 - RNA, 23 nt, Artificial Sequence
  Synthetic
acgggaaacauggcgacccggcu

SEQ ID NO: 35026 - RNA, 24 nt, Artificial Sequence
  Synthetic
gacgggaaacauggcgacccggcu

SEQ ID NO: 35027 - RNA, 18 nt, Artificial Sequence
  Synthetic
cgcgcuaccugcccaucu

SEQ ID NO: 35028 - RNA, 19 nt, Artificial Sequence
  Synthetic
acgcgcuaccugcccaucu

SEQ ID NO: 35029 - RNA, 20 nt, Artificial Sequence
  Synthetic
cacgcgcuaccugcccaucu

SEQ ID NO: 35030 - RNA, 21 nt, Artificial Sequence
  Synthetic
ucacgcgcuaccugcccaucu

SEQ ID NO: 35031 - RNA, 22 nt, Artificial Sequence
  Synthetic
cucacgcgcuaccugcccaucu

SEQ ID NO: 35032 - RNA, 23 nt, Artificial Sequence
  Synthetic
ccucacgcgcuaccugcccaucu

SEQ ID NO: 35033 - RNA, 24 nt, Artificial Sequence
  Synthetic
gccucacgcgcuaccugcccaucu

SEQ ID NO: 35034 - RNA, 18 nt, Artificial Sequence
  Synthetic
agggggggcggugcuucu

SEQ ID NO: 35035 - RNA, 19 nt, Artificial Sequence
  Synthetic
gagggggggcggugcuucu

SEQ ID NO: 35036 - RNA, 20 nt, Artificial Sequence
  Synthetic
ggagggggggcggugcuucu

SEQ ID NO: 35037 - RNA, 21 nt, Artificial Sequence
  Synthetic
aggagggggggcggugcuucu

SEQ ID NO: 35038 - RNA, 22 nt, Artificial Sequence
  Synthetic
aaggagggggggcggugcuucu

SEQ ID NO: 35039 - RNA, 23 nt, Artificial Sequence
  Synthetic
gaaggagggggggcggugcuucu

SEQ ID NO: 35040 - RNA, 24 nt, Artificial Sequence
  Synthetic
ugaaggagggggggcggugcuucu

SEQ ID NO: 35041 - RNA, 18 nt, Artificial Sequence
  Synthetic
cagaaacaggaacauagu

SEQ ID NO: 35042 - RNA, 19 nt, Artificial Sequence
  Synthetic
acagaaacaggaacauagu

SEQ ID NO: 35043 - RNA, 20 nt, Artificial Sequence
  Synthetic
gacagaaacaggaacauagu

SEQ ID NO: 35044 - RNA, 21 nt, Artificial Sequence
  Synthetic
agacagaaacaggaacauagu

SEQ ID NO: 35045 - RNA, 22 nt, Artificial Sequence
  Synthetic
gagacagaaacaggaacauagu

SEQ ID NO: 35046 - RNA, 23 nt, Artificial Sequence
  Synthetic
ggagacagaaacaggaacauagu

SEQ ID NO: 35047 - RNA, 24 nt, Artificial Sequence
  Synthetic
gggagacagaaacaggaacauagu

SEQ ID NO: 35048 - RNA, 18 nt, Artificial Sequence
  Synthetic
ccucuggaugacccccgu

SEQ ID NO: 35049 - RNA, 19 nt, Artificial Sequence
  Synthetic
gccucuggaugacccccgu

SEQ ID NO: 35050 - RNA, 20 nt, Artificial Sequence
  Synthetic
agccucuggaugacccccgu

SEQ ID NO: 35051 - RNA, 21 nt, Artificial Sequence
  Synthetic
cagccucuggaugacccccgu

SEQ ID NO: 35052 - RNA, 22 nt, Artificial Sequence
  Synthetic
acagccucuggaugacccccgu

SEQ ID NO: 35053 - RNA, 23 nt, Artificial Sequence
  Synthetic
aacagccucuggaugacccccgu

SEQ ID NO: 35054 - RNA, 24 nt, Artificial Sequence
  Synthetic
gaacagccucuggaugacccccgu

SEQ ID NO: 35055 - RNA, 18 nt, Artificial Sequence
  Synthetic
gggguggggcggaggggu

SEQ ID NO: 35056 - RNA, 19 nt, Artificial Sequence
  Synthetic
ggggguggggcggaggggu

SEQ ID NO: 35057 - RNA, 20 nt, Artificial Sequence
  Synthetic
gggggguggggcggaggggu

SEQ ID NO: 35058 - RNA, 21 nt, Artificial Sequence
  Synthetic
ugggggguggggcggaggggu

SEQ ID NO: 35059 - RNA, 22 nt, Artificial Sequence
  Synthetic
uugggggguggggcggaggggu

SEQ ID NO: 35060 - RNA, 23 nt, Artificial Sequence
  Synthetic
guugggggguggggcggaggggu

SEQ ID NO: 35061 - RNA, 24 nt, Artificial Sequence
  Synthetic
uguugggggguggggcggaggggu

SEQ ID NO: 35062 - RNA, 18 nt, Artificial Sequence
  Synthetic
ggucucggcacccguggu

SEQ ID NO: 35063 - RNA, 19 nt, Artificial Sequence
  Synthetic
cggucucggcacccguggu

SEQ ID NO: 35064 - RNA, 20 nt, Artificial Sequence
  Synthetic
gcggucucggcacccguggu

SEQ ID NO: 35065 - RNA, 21 nt, Artificial Sequence
  Synthetic
ugcggucucggcacccguggu

SEQ ID NO: 35066 - RNA, 22 nt, Artificial Sequence
  Synthetic
cugcggucucggcacccguggu

SEQ ID NO: 35067 - RNA, 23 nt, Artificial Sequence
  Synthetic
ccugcggucucggcacccguggu

SEQ ID NO: 35068 - RNA, 24 nt, Artificial Sequence
  Synthetic
gccugcggucucggcacccguggu

SEQ ID NO: 35069 - RNA, 18 nt, Artificial Sequence
  Synthetic
ccaggcaugcucgguggu

SEQ ID NO: 35070 - RNA, 19 nt, Artificial Sequence
  Synthetic
cccaggcaugcucgguggu

SEQ ID NO: 35071 - RNA, 20 nt, Artificial Sequence
  Synthetic
acccaggcaugcucgguggu

SEQ ID NO: 35072 - RNA, 21 nt, Artificial Sequence
  Synthetic
cacccaggcaugcucgguggu

SEQ ID NO: 35073 - RNA, 22 nt, Artificial Sequence
  Synthetic
acacccaggcaugcucgguggu

SEQ ID NO: 35074 - RNA, 23 nt, Artificial Sequence
  Synthetic
cacacccaggcaugcucgguggu

SEQ ID NO: 35075 - RNA, 24 nt, Artificial Sequence
  Synthetic
ccacacccaggcaugcucgguggu

SEQ ID NO: 35076 - RNA, 18 nt, Artificial Sequence
  Synthetic
gggauuuuugcugucugu

SEQ ID NO: 35077 - RNA, 19 nt, Artificial Sequence
  Synthetic
ggggauuuuugcugucugu

SEQ ID NO: 35078 - RNA, 20 nt, Artificial Sequence
  Synthetic
aggggauuuuugcugucugu

SEQ ID NO: 35079 - RNA, 21 nt, Artificial Sequence
  Synthetic
caggggauuuuugcugucugu

SEQ ID NO: 35080 - RNA, 22 nt, Artificial Sequence
  Synthetic
ucaggggauuuuugcugucugu

SEQ ID NO: 35081 - RNA, 23 nt, Artificial Sequence
  Synthetic
cucaggggauuuuugcugucugu

SEQ ID NO: 35082 - RNA, 24 nt, Artificial Sequence
  Synthetic
acucaggggauuuuugcugucugu

SEQ ID NO: 35083 - RNA, 18 nt, Artificial Sequence
  Synthetic
acaccagccaauccgugu

SEQ ID NO: 35084 - RNA, 19 nt, Artificial Sequence
  Synthetic
uacaccagccaauccgugu

SEQ ID NO: 35085 - RNA, 20 nt, Artificial Sequence
  Synthetic
cuacaccagccaauccgugu

SEQ ID NO: 35086 - RNA, 21 nt, Artificial Sequence
  Synthetic
acuacaccagccaauccgugu

SEQ ID NO: 35087 - RNA, 22 nt, Artificial Sequence
  Synthetic
cacuacaccagccaauccgugu

SEQ ID NO: 35088 - RNA, 23 nt, Artificial Sequence
  Synthetic
ccacuacaccagccaauccgugu

SEQ ID NO: 35089 - RNA, 24 nt, Artificial Sequence
  Synthetic
cccacuacaccagccaauccgugu

SEQ ID NO: 35090 - RNA, 18 nt, Artificial Sequence
  Synthetic
caccacagacgugggugu

SEQ ID NO: 35091 - RNA, 19 nt, Artificial Sequence
  Synthetic
acaccacagacgugggugu

SEQ ID NO: 35092 - RNA, 20 nt, Artificial Sequence
  Synthetic
cacaccacagacgugggugu

SEQ ID NO: 35093 - RNA, 21 nt, Artificial Sequence
  Synthetic
ccacaccacagacgugggugu

SEQ ID NO: 35094 - RNA, 22 nt, Artificial Sequence
  Synthetic
gccacaccacagacgugggugu

SEQ ID NO: 35095 - RNA, 23 nt, Artificial Sequence
  Synthetic
ggccacaccacagacgugggugu

SEQ ID NO: 35096 - RNA, 24 nt, Artificial Sequence
  Synthetic
cggccacaccacagacgugggugu

SEQ ID NO: 35097 - RNA, 18 nt, Artificial Sequence
  Synthetic
gacgccccccguguuugu

SEQ ID NO: 35098 - RNA, 19 nt, Artificial Sequence
  Synthetic
ggacgccccccguguuugu

SEQ ID NO: 35099 - RNA, 20 nt, Artificial Sequence
  Synthetic
gggacgccccccguguuugu

SEQ ID NO: 35100 - RNA, 21 nt, Artificial Sequence
  Synthetic
agggacgccccccguguuugu

SEQ ID NO: 35101 - RNA, 22 nt, Artificial Sequence
  Synthetic
aagggacgccccccguguuugu

SEQ ID NO: 35102 - RNA, 23 nt, Artificial Sequence
  Synthetic
uaagggacgccccccguguuugu

SEQ ID NO: 35103 - RNA, 24 nt, Artificial Sequence
  Synthetic
auaagggacgccccccguguuugu

SEQ ID NO: 35104 - RNA, 18 nt, Artificial Sequence
  Synthetic
cgcgccacgcggagacuu

SEQ ID NO: 35105 - RNA, 19 nt, Artificial Sequence
  Synthetic
acgcgccacgcggagacuu

SEQ ID NO: 35106 - RNA, 20 nt, Artificial Sequence
  Synthetic
gacgcgccacgcggagacuu

SEQ ID NO: 35107 - RNA, 21 nt, Artificial Sequence
  Synthetic
agacgcgccacgcggagacuu

SEQ ID NO: 35108 - RNA, 22 nt, Artificial Sequence
  Synthetic
aagacgcgccacgcggagacuu

SEQ ID NO: 35109 - RNA, 23 nt, Artificial Sequence
  Synthetic
gaagacgcgccacgcggagacuu

SEQ ID NO: 35110 - RNA, 24 nt, Artificial Sequence
  Synthetic
ggaagacgcgccacgcggagacuu

SEQ ID NO: 35111 - RNA, 18 nt, Artificial Sequence
  Synthetic
ucggcccccgcgcugcuu

SEQ ID NO: 35112 - RNA, 19 nt, Artificial Sequence
  Synthetic
cucggcccccgcgcugcuu

SEQ ID NO: 35113 - RNA, 20 nt, Artificial Sequence
  Synthetic
ccucggcccccgcgcugcuu

SEQ ID NO: 35114 - RNA, 21 nt, Artificial Sequence
  Synthetic
cccucggcccccgcgcugcuu

SEQ ID NO: 35115 - RNA, 22 nt, Artificial Sequence
  Synthetic
ucccucggcccccgcgcugcuu

SEQ ID NO: 35116 - RNA, 23 nt, Artificial Sequence
  Synthetic
cucccucggcccccgcgcugcuu

SEQ ID NO: 35117 - RNA, 24 nt, Artificial Sequence
  Synthetic
ccucccucggcccccgcgcugcuu

SEQ ID NO: 35118 - RNA, 18 nt, Artificial Sequence
  Synthetic
ggauuuuugcugucuguu

SEQ ID NO: 35119 - RNA, 19 nt, Artificial Sequence
  Synthetic
gggauuuuugcugucuguu

SEQ ID NO: 35120 - RNA, 20 nt, Artificial Sequence
  Synthetic
ggggauuuuugcugucuguu

SEQ ID NO: 35121 - RNA, 21 nt, Artificial Sequence
  Synthetic
aggggauuuuugcugucuguu

SEQ ID NO: 35122 - RNA, 22 nt, Artificial Sequence
  Synthetic
caggggauuuuugcugucuguu

SEQ ID NO: 35123 - RNA, 23 nt, Artificial Sequence
  Synthetic
ucaggggauuuuugcugucuguu

SEQ ID NO: 35124 - RNA, 24 nt, Artificial Sequence
  Synthetic
cucaggggauuuuugcugucuguu

SEQ ID NO: 35125 - RNA, 18 nt, Artificial Sequence
  Synthetic
accacagacguggguguu

SEQ ID NO: 35126 - RNA, 19 nt, Artificial Sequence
  Synthetic
caccacagacguggguguu

SEQ ID NO: 35127 - RNA, 20 nt, Artificial Sequence
  Synthetic
acaccacagacguggguguu

SEQ ID NO: 35128 - RNA, 21 nt, Artificial Sequence
  Synthetic
cacaccacagacguggguguu

SEQ ID NO: 35129 - RNA, 22 nt, Artificial Sequence
  Synthetic
ccacaccacagacguggguguu

SEQ ID NO: 35130 - RNA, 23 nt, Artificial Sequence
  Synthetic
gccacaccacagacguggguguu

SEQ ID NO: 35131 - RNA, 24 nt, Artificial Sequence
  Synthetic
ggccacaccacagacguggguguu

SEQ ID NO: 35132 - RNA, 18 nt, Artificial Sequence
  Synthetic
gggacgccccccguguuu

SEQ ID NO: 35133 - RNA, 19 nt, Artificial Sequence
  Synthetic
agggacgccccccguguuu

SEQ ID NO: 35134 - RNA, 20 nt, Artificial Sequence
  Synthetic
aagggacgccccccguguuu

SEQ ID NO: 35135 - RNA, 21 nt, Artificial Sequence
  Synthetic
uaagggacgccccccguguuu

SEQ ID NO: 35136 - RNA, 22 nt, Artificial Sequence
  Synthetic
auaagggacgccccccguguuu

SEQ ID NO: 35137 - RNA, 23 nt, Artificial Sequence
  Synthetic
aauaagggacgccccccguguuu

SEQ ID NO: 35138 - RNA, 24 nt, Artificial Sequence
  Synthetic
caauaagggacgccccccguguuu

SEQ ID NO: 35139 - RNA, 18 nt, Artificial Sequence
  Synthetic
ccccccuccccacaaaca

SEQ ID NO: 35140 - RNA, 19 nt, Artificial Sequence
  Synthetic
cccccccuccccacaaaca

SEQ ID NO: 35141 - RNA, 20 nt, Artificial Sequence
  Synthetic
ccccccccuccccacaaaca

SEQ ID NO: 35142 - RNA, 21 nt, Artificial Sequence
  Synthetic
accccccccuccccacaaaca

SEQ ID NO: 35143 - RNA, 22 nt, Artificial Sequence
  Synthetic
gaccccccccuccccacaaaca

SEQ ID NO: 35144 - RNA, 23 nt, Artificial Sequence
  Synthetic
cgaccccccccuccccacaaaca

SEQ ID NO: 35145 - RNA, 24 nt, Artificial Sequence
  Synthetic
ccgaccccccccuccccacaaaca

SEQ ID NO: 35146 - RNA, 18 nt, Artificial Sequence
  Synthetic
auacauccaacacagaca

SEQ ID NO: 35147 - RNA, 19 nt, Artificial Sequence
  Synthetic
gauacauccaacacagaca

SEQ ID NO: 35148 - RNA, 20 nt, Artificial Sequence
  Synthetic
cgauacauccaacacagaca

SEQ ID NO: 35149 - RNA, 21 nt, Artificial Sequence
  Synthetic
gcgauacauccaacacagaca

SEQ ID NO: 35150 - RNA, 22 nt, Artificial Sequence
  Synthetic
cgcgauacauccaacacagaca

SEQ ID NO: 35151 - RNA, 23 nt, Artificial Sequence
  Synthetic
ccgcgauacauccaacacagaca

SEQ ID NO: 35152 - RNA, 24 nt, Artificial Sequence
  Synthetic
cccgcgauacauccaacacagaca

SEQ ID NO: 35153 - RNA, 18 nt, Artificial Sequence
  Synthetic
ccccccuccuucauacca

SEQ ID NO: 35154 - RNA, 19 nt, Artificial Sequence
  Synthetic
cccccccuccuucauacca

SEQ ID NO: 35155 - RNA, 20 nt, Artificial Sequence
  Synthetic
gcccccccuccuucauacca

SEQ ID NO: 35156 - RNA, 21 nt, Artificial Sequence
  Synthetic
cgcccccccuccuucauacca

SEQ ID NO: 35157 - RNA, 22 nt, Artificial Sequence
  Synthetic
ccgcccccccuccuucauacca

SEQ ID NO: 35158 - RNA, 23 nt, Artificial Sequence
  Synthetic
accgcccccccuccuucauacca

SEQ ID NO: 35159 - RNA, 24 nt, Artificial Sequence
  Synthetic
caccgcccccccuccuucauacca

SEQ ID NO: 35160 - RNA, 18 nt, Artificial Sequence
  Synthetic
cgaacagcauguucccca

SEQ ID NO: 35161 - RNA, 19 nt, Artificial Sequence
  Synthetic
ucgaacagcauguucccca

SEQ ID NO: 35162 - RNA, 20 nt, Artificial Sequence
  Synthetic
gucgaacagcauguucccca

SEQ ID NO: 35163 - RNA, 21 nt, Artificial Sequence
  Synthetic
ggucgaacagcauguucccca

SEQ ID NO: 35164 - RNA, 22 nt, Artificial Sequence
  Synthetic
uggucgaacagcauguucccca

SEQ ID NO: 35165 - RNA, 23 nt, Artificial Sequence
  Synthetic
cuggucgaacagcauguucccca

SEQ ID NO: 35166 - RNA, 24 nt, Artificial Sequence
  Synthetic
ccuggucgaacagcauguucccca

SEQ ID NO: 35167 - RNA, 18 nt, Artificial Sequence
  Synthetic
cgauacauccaacacaga

SEQ ID NO: 35168 - RNA, 19 nt, Artificial Sequence
  Synthetic
gcgauacauccaacacaga

SEQ ID NO: 35169 - RNA, 20 nt, Artificial Sequence
  Synthetic
cgcgauacauccaacacaga

SEQ ID NO: 35170 - RNA, 21 nt, Artificial Sequence
  Synthetic
ccgcgauacauccaacacaga

SEQ ID NO: 35171 - RNA, 22 nt, Artificial Sequence
  Synthetic
cccgcgauacauccaacacaga

SEQ ID NO: 35172 - RNA, 23 nt, Artificial Sequence
  Synthetic
ccccgcgauacauccaacacaga

SEQ ID NO: 35173 - RNA, 24 nt, Artificial Sequence
  Synthetic
uccccgcgauacauccaacacaga

SEQ ID NO: 35174 - RNA, 18 nt, Artificial Sequence
  Synthetic
aagcagcgcgggggccga

SEQ ID NO: 35175 - RNA, 19 nt, Artificial Sequence
  Synthetic
gaagcagcgcgggggccga

SEQ ID NO: 35176 - RNA, 20 nt, Artificial Sequence
  Synthetic
agaagcagcgcgggggccga

SEQ ID NO: 35177 - RNA, 21 nt, Artificial Sequence
  Synthetic
cagaagcagcgcgggggccga

SEQ ID NO: 35178 - RNA, 22 nt, Artificial Sequence
  Synthetic
ccagaagcagcgcgggggccga

SEQ ID NO: 35179 - RNA, 23 nt, Artificial Sequence
  Synthetic
cccagaagcagcgcgggggccga

SEQ ID NO: 35180 - RNA, 24 nt, Artificial Sequence
  Synthetic
gcccagaagcagcgcgggggccga

SEQ ID NO: 35181 - RNA, 18 nt, Artificial Sequence
  Synthetic
cuuguucacguaaggcga

SEQ ID NO: 35182 - RNA, 19 nt, Artificial Sequence
  Synthetic
ucuuguucacguaaggcga

SEQ ID NO: 35183 - RNA, 20 nt, Artificial Sequence
  Synthetic
gucuuguucacguaaggcga

SEQ ID NO: 35184 - RNA, 21 nt, Artificial Sequence
  Synthetic
agucuuguucacguaaggcga

SEQ ID NO: 35185 - RNA, 22 nt, Artificial Sequence
  Synthetic
uagucuuguucacguaaggcga

SEQ ID NO: 35186 - RNA, 23 nt, Artificial Sequence
  Synthetic
auagucuuguucacguaaggcga

SEQ ID NO: 35187 - RNA, 24 nt, Artificial Sequence
  Synthetic
gauagucuuguucacguaaggcga

SEQ ID NO: 35188 - RNA, 18 nt, Artificial Sequence
  Synthetic
cacggauuggcuggugua

SEQ ID NO: 35189 - RNA, 19 nt, Artificial Sequence
  Synthetic
acacggauuggcuggugua

SEQ ID NO: 35190 - RNA, 20 nt, Artificial Sequence
  Synthetic
gacacggauuggcuggugua

SEQ ID NO: 35191 - RNA, 21 nt, Artificial Sequence
  Synthetic
cgacacggauuggcuggugua

SEQ ID NO: 35192 - RNA, 22 nt, Artificial Sequence
  Synthetic
ccgacacggauuggcuggugua

SEQ ID NO: 35193 - RNA, 23 nt, Artificial Sequence
  Synthetic
cccgacacggauuggcuggugua

SEQ ID NO: 35194 - RNA, 24 nt, Artificial Sequence
  Synthetic
ccccgacacggauuggcuggugua

SEQ ID NO: 35195 - RNA, 18 nt, Artificial Sequence
  Synthetic
cccccccuccccacaaac

SEQ ID NO: 35196 - RNA, 19 nt, Artificial Sequence
  Synthetic
ccccccccuccccacaaac

SEQ ID NO: 35197 - RNA, 20 nt, Artificial Sequence
  Synthetic
accccccccuccccacaaac

SEQ ID NO: 35198 - RNA, 21 nt, Artificial Sequence
  Synthetic
gaccccccccuccccacaaac

SEQ ID NO: 35199 - RNA, 22 nt, Artificial Sequence
  Synthetic
cgaccccccccuccccacaaac

SEQ ID NO: 35200 - RNA, 23 nt, Artificial Sequence
  Synthetic
ccgaccccccccuccccacaaac

SEQ ID NO: 35201 - RNA, 24 nt, Artificial Sequence
  Synthetic
cccgaccccccccuccccacaaac

SEQ ID NO: 35202 - RNA, 18 nt, Artificial Sequence
  Synthetic
cccccuccccacaaacac

SEQ ID NO: 35203 - RNA, 19 nt, Artificial Sequence
  Synthetic
ccccccuccccacaaacac

SEQ ID NO: 35204 - RNA, 20 nt, Artificial Sequence
  Synthetic
cccccccuccccacaaacac

SEQ ID NO: 35205 - RNA, 21 nt, Artificial Sequence
  Synthetic
ccccccccuccccacaaacac

SEQ ID NO: 35206 - RNA, 22 nt, Artificial Sequence
  Synthetic
accccccccuccccacaaacac

SEQ ID NO: 35207 - RNA, 23 nt, Artificial Sequence
  Synthetic
gaccccccccuccccacaaacac

SEQ ID NO: 35208 - RNA, 24 nt, Artificial Sequence
  Synthetic
cgaccccccccuccccacaaacac

SEQ ID NO: 35209 - RNA, 18 nt, Artificial Sequence
  Synthetic
cggcucugugguuaacac

SEQ ID NO: 35210 - RNA, 19 nt, Artificial Sequence
  Synthetic
gcggcucugugguuaacac

SEQ ID NO: 35211 - RNA, 20 nt, Artificial Sequence
  Synthetic
cgcggcucugugguuaacac

SEQ ID NO: 35212 - RNA, 21 nt, Artificial Sequence
  Synthetic
ccgcggcucugugguuaacac

SEQ ID NO: 35213 - RNA, 22 nt, Artificial Sequence
  Synthetic
gccgcggcucugugguuaacac

SEQ ID NO: 35214 - RNA, 23 nt, Artificial Sequence
  Synthetic
ggccgcggcucugugguuaacac

SEQ ID NO: 35215 - RNA, 24 nt, Artificial Sequence
  Synthetic
gggccgcggcucugugguuaacac

SEQ ID NO: 35216 - RNA, 18 nt, Artificial Sequence
  Synthetic
guuucccgucugguccac

SEQ ID NO: 35217 - RNA, 19 nt, Artificial Sequence
  Synthetic
uguuucccgucugguccac

SEQ ID NO: 35218 - RNA, 20 nt, Artificial Sequence
  Synthetic
auguuucccgucugguccac

SEQ ID NO: 35219 - RNA, 21 nt, Artificial Sequence
  Synthetic
cauguuucccgucugguccac

SEQ ID NO: 35220 - RNA, 22 nt, Artificial Sequence
  Synthetic
ccauguuucccgucugguccac

SEQ ID NO: 35221 - RNA, 23 nt, Artificial Sequence
  Synthetic
gccauguuucccgucugguccac

SEQ ID NO: 35222 - RNA, 24 nt, Artificial Sequence
  Synthetic
cgccauguuucccgucugguccac

SEQ ID NO: 35223 - RNA, 18 nt, Artificial Sequence
  Synthetic
gauacauccaacacagac

SEQ ID NO: 35224 - RNA, 19 nt, Artificial Sequence
  Synthetic
cgauacauccaacacagac

SEQ ID NO: 35225 - RNA, 20 nt, Artificial Sequence
  Synthetic
gcgauacauccaacacagac

SEQ ID NO: 35226 - RNA, 21 nt, Artificial Sequence
  Synthetic
cgcgauacauccaacacagac

SEQ ID NO: 35227 - RNA, 22 nt, Artificial Sequence
  Synthetic
ccgcgauacauccaacacagac

SEQ ID NO: 35228 - RNA, 23 nt, Artificial Sequence
  Synthetic
cccgcgauacauccaacacagac

SEQ ID NO: 35229 - RNA, 24 nt, Artificial Sequence
  Synthetic
ccccgcgauacauccaacacagac

SEQ ID NO: 35230 - RNA, 18 nt, Artificial Sequence
  Synthetic
aggcuguuccacuccgac

SEQ ID NO: 35231 - RNA, 19 nt, Artificial Sequence
  Synthetic
gaggcuguuccacuccgac

SEQ ID NO: 35232 - RNA, 20 nt, Artificial Sequence
  Synthetic
agaggcuguuccacuccgac

SEQ ID NO: 35233 - RNA, 21 nt, Artificial Sequence
  Synthetic
cagaggcuguuccacuccgac

SEQ ID NO: 35234 - RNA, 22 nt, Artificial Sequence
  Synthetic
ccagaggcuguuccacuccgac

SEQ ID NO: 35235 - RNA, 23 nt, Artificial Sequence
  Synthetic
uccagaggcuguuccacuccgac

SEQ ID NO: 35236 - RNA, 24 nt, Artificial Sequence
  Synthetic
auccagaggcuguuccacuccgac

SEQ ID NO: 35237 - RNA, 18 nt, Artificial Sequence
  Synthetic
gcgggggccgucggguac

SEQ ID NO: 35238 - RNA, 19 nt, Artificial Sequence
  Synthetic
cgcgggggccgucggguac

SEQ ID NO: 35239 - RNA, 20 nt, Artificial Sequence
  Synthetic
acgcgggggccgucggguac

SEQ ID NO: 35240 - RNA, 21 nt, Artificial Sequence
  Synthetic
gacgcgggggccgucggguac

SEQ ID NO: 35241 - RNA, 22 nt, Artificial Sequence
  Synthetic
cgacgcgggggccgucggguac

SEQ ID NO: 35242 - RNA, 23 nt, Artificial Sequence
  Synthetic
ccgacgcgggggccgucggguac

SEQ ID NO: 35243 - RNA, 24 nt, Artificial Sequence
  Synthetic
uccgacgcgggggccgucggguac

SEQ ID NO: 35244 - RNA, 18 nt, Artificial Sequence
  Synthetic
cgaccacgcuagagaccc

SEQ ID NO: 35245 - RNA, 19 nt, Artificial Sequence
  Synthetic
gcgaccacgcuagagaccc

SEQ ID NO: 35246 - RNA, 20 nt, Artificial Sequence
  Synthetic
ggcgaccacgcuagagaccc

SEQ ID NO: 35247 - RNA, 21 nt, Artificial Sequence
  Synthetic
gggcgaccacgcuagagaccc

SEQ ID NO: 35248 - RNA, 22 nt, Artificial Sequence
  Synthetic
agggcgaccacgcuagagaccc

SEQ ID NO: 35249 - RNA, 23 nt, Artificial Sequence
  Synthetic
cagggcgaccacgcuagagaccc

SEQ ID NO: 35250 - RNA, 24 nt, Artificial Sequence
  Synthetic
acagggcgaccacgcuagagaccc

SEQ ID NO: 35251 - RNA, 18 nt, Artificial Sequence
  Synthetic
ucgaacagcauguucccc

SEQ ID NO: 35252 - RNA, 19 nt, Artificial Sequence
  Synthetic
gucgaacagcauguucccc

SEQ ID NO: 35253 - RNA, 20 nt, Artificial Sequence
  Synthetic
ggucgaacagcauguucccc

SEQ ID NO: 35254 - RNA, 21 nt, Artificial Sequence
  Synthetic
uggucgaacagcauguucccc

SEQ ID NO: 35255 - RNA, 22 nt, Artificial Sequence
  Synthetic
cuggucgaacagcauguucccc

SEQ ID NO: 35256 - RNA, 23 nt, Artificial Sequence
  Synthetic
ccuggucgaacagcauguucccc

SEQ ID NO: 35257 - RNA, 24 nt, Artificial Sequence
  Synthetic
cccuggucgaacagcauguucccc

SEQ ID NO: 35258 - RNA, 18 nt, Artificial Sequence
  Synthetic
uagcgcgugaggccgccc

SEQ ID NO: 35259 - RNA, 19 nt, Artificial Sequence
  Synthetic
guagcgcgugaggccgccc

SEQ ID NO: 35260 - RNA, 20 nt, Artificial Sequence
  Synthetic
gguagcgcgugaggccgccc

SEQ ID NO: 35261 - RNA, 21 nt, Artificial Sequence
  Synthetic
agguagcgcgugaggccgccc

SEQ ID NO: 35262 - RNA, 22 nt, Artificial Sequence
  Synthetic
cagguagcgcgugaggccgccc

SEQ ID NO: 35263 - RNA, 23 nt, Artificial Sequence
  Synthetic
gcagguagcgcgugaggccgccc

SEQ ID NO: 35264 - RNA, 24 nt, Artificial Sequence
  Synthetic
ggcagguagcgcgugaggccgccc

SEQ ID NO: 35265 - RNA, 18 nt, Artificial Sequence
  Synthetic
cgcccgcggggacggccc

SEQ ID NO: 35266 - RNA, 19 nt, Artificial Sequence
  Synthetic
ccgcccgcggggacggccc

SEQ ID NO: 35267 - RNA, 20 nt, Artificial Sequence
  Synthetic
gccgcccgcggggacggccc

SEQ ID NO: 35268 - RNA, 21 nt, Artificial Sequence
  Synthetic
ggccgcccgcggggacggccc

SEQ ID NO: 35269 - RNA, 22 nt, Artificial Sequence
  Synthetic
aggccgcccgcggggacggccc

SEQ ID NO: 35270 - RNA, 23 nt, Artificial Sequence
  Synthetic
gaggccgcccgcggggacggccc

SEQ ID NO: 35271 - RNA, 24 nt, Artificial Sequence
  Synthetic
ugaggccgcccgcggggacggccc

SEQ ID NO: 35272 - RNA, 18 nt, Artificial Sequence
  Synthetic
ggugcggcggcuccagcc

SEQ ID NO: 35273 - RNA, 19 nt, Artificial Sequence
  Synthetic
gggugcggcggcuccagcc

SEQ ID NO: 35274 - RNA, 20 nt, Artificial Sequence
  Synthetic
agggugcggcggcuccagcc

SEQ ID NO: 35275 - RNA, 21 nt, Artificial Sequence
  Synthetic
cagggugcggcggcuccagcc

SEQ ID NO: 35276 - RNA, 22 nt, Artificial Sequence
  Synthetic
gcagggugcggcggcuccagcc

SEQ ID NO: 35277 - RNA, 23 nt, Artificial Sequence
  Synthetic
agcagggugcggcggcuccagcc

SEQ ID NO: 35278 - RNA, 24 nt, Artificial Sequence
  Synthetic
gagcagggugcggcggcuccagcc

SEQ ID NO: 35279 - RNA, 18 nt, Artificial Sequence
  Synthetic
ccgcccgcggggacggcc

SEQ ID NO: 35280 - RNA, 19 nt, Artificial Sequence
  Synthetic
gccgcccgcggggacggcc

SEQ ID NO: 35281 - RNA, 20 nt, Artificial Sequence
  Synthetic
ggccgcccgcggggacggcc

SEQ ID NO: 35282 - RNA, 21 nt, Artificial Sequence
  Synthetic
aggccgcccgcggggacggcc

SEQ ID NO: 35283 - RNA, 22 nt, Artificial Sequence
  Synthetic
gaggccgcccgcggggacggcc

SEQ ID NO: 35284 - RNA, 23 nt, Artificial Sequence
  Synthetic
ugaggccgcccgcggggacggcc

SEQ ID NO: 35285 - RNA, 24 nt, Artificial Sequence
  Synthetic
gugaggccgcccgcggggacggcc

SEQ ID NO: 35286 - RNA, 18 nt, Artificial Sequence
  Synthetic
uccucggcccccgcggcc

SEQ ID NO: 35287 - RNA, 19 nt, Artificial Sequence
  Synthetic
uuccucggcccccgcggcc

SEQ ID NO: 35288 - RNA, 20 nt, Artificial Sequence
  Synthetic
cuuccucggcccccgcggcc

SEQ ID NO: 35289 - RNA, 21 nt, Artificial Sequence
  Synthetic
acuuccucggcccccgcggcc

SEQ ID NO: 35290 - RNA, 22 nt, Artificial Sequence
  Synthetic
cacuuccucggcccccgcggcc

SEQ ID NO: 35291 - RNA, 23 nt, Artificial Sequence
  Synthetic
acacuuccucggcccccgcggcc

SEQ ID NO: 35292 - RNA, 24 nt, Artificial Sequence
  Synthetic
cacacuuccucggcccccgcggcc

SEQ ID NO: 35293 - RNA, 18 nt, Artificial Sequence
  Synthetic
agaagcagcgcgggggcc

SEQ ID NO: 35294 - RNA, 19 nt, Artificial Sequence
  Synthetic
cagaagcagcgcgggggcc

SEQ ID NO: 35295 - RNA, 20 nt, Artificial Sequence
  Synthetic
ccagaagcagcgcgggggcc

SEQ ID NO: 35296 - RNA, 21 nt, Artificial Sequence
  Synthetic
cccagaagcagcgcgggggcc

SEQ ID NO: 35297 - RNA, 22 nt, Artificial Sequence
  Synthetic
gcccagaagcagcgcgggggcc

SEQ ID NO: 35298 - RNA, 23 nt, Artificial Sequence
  Synthetic
ggcccagaagcagcgcgggggcc

SEQ ID NO: 35299 - RNA, 24 nt, Artificial Sequence
  Synthetic
cggcccagaagcagcgcgggggcc

SEQ ID NO: 35300 - RNA, 18 nt, Artificial Sequence
  Synthetic
gucgacgcccccugcucc

SEQ ID NO: 35301 - RNA, 19 nt, Artificial Sequence
  Synthetic
ggucgacgcccccugcucc

SEQ ID NO: 35302 - RNA, 20 nt, Artificial Sequence
  Synthetic
gggucgacgcccccugcucc

SEQ ID NO: 35303 - RNA, 21 nt, Artificial Sequence
  Synthetic
cgggucgacgcccccugcucc

SEQ ID NO: 35304 - RNA, 22 nt, Artificial Sequence
  Synthetic
ccgggucgacgcccccugcucc

SEQ ID NO: 35305 - RNA, 23 nt, Artificial Sequence
  Synthetic
cccgggucgacgcccccugcucc

SEQ ID NO: 35306 - RNA, 24 nt, Artificial Sequence
  Synthetic
ucccgggucgacgcccccugcucc

SEQ ID NO: 35307 - RNA, 18 nt, Artificial Sequence
  Synthetic
gggugcggcggcuccagc

SEQ ID NO: 35308 - RNA, 19 nt, Artificial Sequence
  Synthetic
agggugcggcggcuccagc

SEQ ID NO: 35309 - RNA, 20 nt, Artificial Sequence
  Synthetic
cagggugcggcggcuccagc

SEQ ID NO: 35310 - RNA, 21 nt, Artificial Sequence
  Synthetic
gcagggugcggcggcuccagc

SEQ ID NO: 35311 - RNA, 22 nt, Artificial Sequence
  Synthetic
agcagggugcggcggcuccagc

SEQ ID NO: 35312 - RNA, 23 nt, Artificial Sequence
  Synthetic
gagcagggugcggcggcuccagc

SEQ ID NO: 35313 - RNA, 24 nt, Artificial Sequence
  Synthetic
ggagcagggugcggcggcuccagc

SEQ ID NO: 35314 - RNA, 18 nt, Artificial Sequence
  Synthetic
ccgcggcccagaagcagc

SEQ ID NO: 35315 - RNA, 19 nt, Artificial Sequence
  Synthetic
cccgcggcccagaagcagc

SEQ ID NO: 35316 - RNA, 20 nt, Artificial Sequence
  Synthetic
ccccgcggcccagaagcagc

SEQ ID NO: 35317 - RNA, 21 nt, Artificial Sequence
  Synthetic
cccccgcggcccagaagcagc

SEQ ID NO: 35318 - RNA, 22 nt, Artificial Sequence
  Synthetic
gcccccgcggcccagaagcagc

SEQ ID NO: 35319 - RNA, 23 nt, Artificial Sequence
  Synthetic
ggcccccgcggcccagaagcagc

SEQ ID NO: 35320 - RNA, 24 nt, Artificial Sequence
  Synthetic
cggcccccgcggcccagaagcagc

SEQ ID NO: 35321 - RNA, 18 nt, Artificial Sequence
  Synthetic
gaucgguggucaggcagc

SEQ ID NO: 35322 - RNA, 19 nt, Artificial Sequence
  Synthetic
ggaucgguggucaggcagc

SEQ ID NO: 35323 - RNA, 20 nt, Artificial Sequence
  Synthetic
gggaucgguggucaggcagc

SEQ ID NO: 35324 - RNA, 21 nt, Artificial Sequence
  Synthetic
ggggaucgguggucaggcagc

SEQ ID NO: 35325 - RNA, 22 nt, Artificial Sequence
  Synthetic
cggggaucgguggucaggcagc

SEQ ID NO: 35326 - RNA, 23 nt, Artificial Sequence
  Synthetic
ucggggaucgguggucaggcagc

SEQ ID NO: 35327 - RNA, 24 nt, Artificial Sequence
  Synthetic
uucggggaucgguggucaggcagc

SEQ ID NO: 35328 - RNA, 18 nt, Artificial Sequence
  Synthetic
gcgacagggcgaccacgc

SEQ ID NO: 35329 - RNA, 19 nt, Artificial Sequence
  Synthetic
ggcgacagggcgaccacgc

SEQ ID NO: 35330 - RNA, 20 nt, Artificial Sequence
  Synthetic
aggcgacagggcgaccacgc

SEQ ID NO: 35331 - RNA, 21 nt, Artificial Sequence
  Synthetic
aaggcgacagggcgaccacgc

SEQ ID NO: 35332 - RNA, 22 nt, Artificial Sequence
  Synthetic
uaaggcgacagggcgaccacgc

SEQ ID NO: 35333 - RNA, 23 nt, Artificial Sequence
  Synthetic
guaaggcgacagggcgaccacgc

SEQ ID NO: 35334 - RNA, 24 nt, Artificial Sequence
  Synthetic
cguaaggcgacagggcgaccacgc

SEQ ID NO: 35335 - RNA, 18 nt, Artificial Sequence
  Synthetic
gcuguuccacuccgacgc

SEQ ID NO: 35336 - RNA, 19 nt, Artificial Sequence
  Synthetic
ggcuguuccacuccgacgc

SEQ ID NO: 35337 - RNA, 20 nt, Artificial Sequence
  Synthetic
aggcuguuccacuccgacgc

SEQ ID NO: 35338 - RNA, 21 nt, Artificial Sequence
  Synthetic
gaggcuguuccacuccgacgc

SEQ ID NO: 35339 - RNA, 22 nt, Artificial Sequence
  Synthetic
agaggcuguuccacuccgacgc

SEQ ID NO: 35340 - RNA, 23 nt, Artificial Sequence
  Synthetic
cagaggcuguuccacuccgacgc

SEQ ID NO: 35341 - RNA, 24 nt, Artificial Sequence
  Synthetic
ccagaggcuguuccacuccgacgc

SEQ ID NO: 35342 - RNA, 18 nt, Artificial Sequence
  Synthetic
gcgcgugaggccgcccgc

SEQ ID NO: 35343 - RNA, 19 nt, Artificial Sequence
  Synthetic
agcgcgugaggccgcccgc

SEQ ID NO: 35344 - RNA, 20 nt, Artificial Sequence
  Synthetic
uagcgcgugaggccgcccgc

SEQ ID NO: 35345 - RNA, 21 nt, Artificial Sequence
  Synthetic
guagcgcgugaggccgcccgc

SEQ ID NO: 35346 - RNA, 22 nt, Artificial Sequence
  Synthetic
gguagcgcgugaggccgcccgc

SEQ ID NO: 35347 - RNA, 23 nt, Artificial Sequence
  Synthetic
agguagcgcgugaggccgcccgc

SEQ ID NO: 35348 - RNA, 24 nt, Artificial Sequence
  Synthetic
cagguagcgcgugaggccgcccgc

SEQ ID NO: 35349 - RNA, 18 nt, Artificial Sequence
  Synthetic
gcggcccagaagcagcgc

SEQ ID NO: 35350 - RNA, 19 nt, Artificial Sequence
  Synthetic
cgcggcccagaagcagcgc

SEQ ID NO: 35351 - RNA, 20 nt, Artificial Sequence
  Synthetic
ccgcggcccagaagcagcgc

SEQ ID NO: 35352 - RNA, 21 nt, Artificial Sequence
  Synthetic
cccgcggcccagaagcagcgc

SEQ ID NO: 35353 - RNA, 22 nt, Artificial Sequence
  Synthetic
ccccgcggcccagaagcagcgc

SEQ ID NO: 35354 - RNA, 23 nt, Artificial Sequence
  Synthetic
cccccgcggcccagaagcagcgc

SEQ ID NO: 35355 - RNA, 24 nt, Artificial Sequence
  Synthetic
gcccccgcggcccagaagcagcgc

SEQ ID NO: 35356 - RNA, 18 nt, Artificial Sequence
  Synthetic
gagaugggcagguagcgc

SEQ ID NO: 35357 - RNA, 19 nt, Artificial Sequence
  Synthetic
cgagaugggcagguagcgc

SEQ ID NO: 35358 - RNA, 20 nt, Artificial Sequence
  Synthetic
ccgagaugggcagguagcgc

SEQ ID NO: 35359 - RNA, 21 nt, Artificial Sequence
  Synthetic
cccgagaugggcagguagcgc

SEQ ID NO: 35360 - RNA, 22 nt, Artificial Sequence
  Synthetic
ccccgagaugggcagguagcgc

SEQ ID NO: 35361 - RNA, 23 nt, Artificial Sequence
  Synthetic
cccccgagaugggcagguagcgc

SEQ ID NO: 35362 - RNA, 24 nt, Artificial Sequence
  Synthetic
acccccgagaugggcagguagcgc

SEQ ID NO: 35363 - RNA, 18 nt, Artificial Sequence
  Synthetic
ugguguagugggcgcggc

SEQ ID NO: 35364 - RNA, 19 nt, Artificial Sequence
  Synthetic
cugguguagugggcgcggc

SEQ ID NO: 35365 - RNA, 20 nt, Artificial Sequence
  Synthetic
gcugguguagugggcgcggc

SEQ ID NO: 35366 - RNA, 21 nt, Artificial Sequence
  Synthetic
ggcugguguagugggcgcggc

SEQ ID NO: 35367 - RNA, 22 nt, Artificial Sequence
  Synthetic
uggcugguguagugggcgcggc

SEQ ID NO: 35368 - RNA, 23 nt, Artificial Sequence
  Synthetic
uuggcugguguagugggcgcggc

SEQ ID NO: 35369 - RNA, 24 nt, Artificial Sequence
  Synthetic
auuggcugguguagugggcgcggc

SEQ ID NO: 35370 - RNA, 18 nt, Artificial Sequence
  Synthetic
cccgcccuuuguggcggc

SEQ ID NO: 35371 - RNA, 19 nt, Artificial Sequence
  Synthetic
ccccgcccuuuguggcggc

SEQ ID NO: 35372 - RNA, 20 nt, Artificial Sequence
  Synthetic
cccccgcccuuuguggcggc

SEQ ID NO: 35373 - RNA, 21 nt, Artificial Sequence
  Synthetic
ccccccgcccuuuguggcggc

SEQ ID NO: 35374 - RNA, 22 nt, Artificial Sequence
  Synthetic
cccccccgcccuuuguggcggc

SEQ ID NO: 35375 - RNA, 23 nt, Artificial Sequence
  Synthetic
ccccccccgcccuuuguggcggc

SEQ ID NO: 35376 - RNA, 24 nt, Artificial Sequence
  Synthetic
accccccccgcccuuuguggcggc

SEQ ID NO: 35377 - RNA, 18 nt, Artificial Sequence
  Synthetic
uuccccacgggggucauc

SEQ ID NO: 35378 - RNA, 19 nt, Artificial Sequence
  Synthetic
guuccccacgggggucauc

SEQ ID NO: 35379 - RNA, 20 nt, Artificial Sequence
  Synthetic
uguuccccacgggggucauc

SEQ ID NO: 35380 - RNA, 21 nt, Artificial Sequence
  Synthetic
auguuccccacgggggucauc

SEQ ID NO: 35381 - RNA, 22 nt, Artificial Sequence
  Synthetic
cauguuccccacgggggucauc

SEQ ID NO: 35382 - RNA, 23 nt, Artificial Sequence
  Synthetic
gcauguuccccacgggggucauc

SEQ ID NO: 35383 - RNA, 24 nt, Artificial Sequence
  Synthetic
agcauguuccccacgggggucauc

SEQ ID NO: 35384 - RNA, 18 nt, Artificial Sequence
  Synthetic
gggggccgucggguacuc

SEQ ID NO: 35385 - RNA, 19 nt, Artificial Sequence
  Synthetic
cgggggccgucggguacuc

SEQ ID NO: 35386 - RNA, 20 nt, Artificial Sequence
  Synthetic
gcgggggccgucggguacuc

SEQ ID NO: 35387 - RNA, 21 nt, Artificial Sequence
  Synthetic
cgcgggggccgucggguacuc

SEQ ID NO: 35388 - RNA, 22 nt, Artificial Sequence
  Synthetic
acgcgggggccgucggguacuc

SEQ ID NO: 35389 - RNA, 23 nt, Artificial Sequence
  Synthetic
gacgcgggggccgucggguacuc

SEQ ID NO: 35390 - RNA, 24 nt, Artificial Sequence
  Synthetic
cgacgcgggggccgucggguacuc

SEQ ID NO: 35391 - RNA, 18 nt, Artificial Sequence
  Synthetic
ccgggcgggcaggcgcuc

SEQ ID NO: 35392 - RNA, 19 nt, Artificial Sequence
  Synthetic
uccgggcgggcaggcgcuc

SEQ ID NO: 35393 - RNA, 20 nt, Artificial Sequence
  Synthetic
guccgggcgggcaggcgcuc

SEQ ID NO: 35394 - RNA, 21 nt, Artificial Sequence
  Synthetic
aguccgggcgggcaggcgcuc

SEQ ID NO: 35395 - RNA, 22 nt, Artificial Sequence
  Synthetic
caguccgggcgggcaggcgcuc

SEQ ID NO: 35396 - RNA, 23 nt, Artificial Sequence
  Synthetic
ucaguccgggcgggcaggcgcuc

SEQ ID NO: 35397 - RNA, 24 nt, Artificial Sequence
  Synthetic
gucaguccgggcgggcaggcgcuc

SEQ ID NO: 35398 - RNA, 18 nt, Artificial Sequence
  Synthetic
gugguuacccgcggucuc

SEQ ID NO: 35399 - RNA, 19 nt, Artificial Sequence
  Synthetic
cgugguuacccgcggucuc

SEQ ID NO: 35400 - RNA, 20 nt, Artificial Sequence
  Synthetic
acgugguuacccgcggucuc

SEQ ID NO: 35401 - RNA, 21 nt, Artificial Sequence
  Synthetic
cacgugguuacccgcggucuc

SEQ ID NO: 35402 - RNA, 22 nt, Artificial Sequence
  Synthetic
ucacgugguuacccgcggucuc

SEQ ID NO: 35403 - RNA, 23 nt, Artificial Sequence
  Synthetic
aucacgugguuacccgcggucuc

SEQ ID NO: 35404 - RNA, 24 nt, Artificial Sequence
  Synthetic
caucacgugguuacccgcggucuc

SEQ ID NO: 35405 - RNA, 18 nt, Artificial Sequence
  Synthetic
ccgcaggcugcggaaguc

SEQ ID NO: 35406 - RNA, 19 nt, Artificial Sequence
  Synthetic
accgcaggcugcggaaguc

SEQ ID NO: 35407 - RNA, 20 nt, Artificial Sequence
  Synthetic
gaccgcaggcugcggaaguc

SEQ ID NO: 35408 - RNA, 21 nt, Artificial Sequence
  Synthetic
agaccgcaggcugcggaaguc

SEQ ID NO: 35409 - RNA, 22 nt, Artificial Sequence
  Synthetic
gagaccgcaggcugcggaaguc

SEQ ID NO: 35410 - RNA, 23 nt, Artificial Sequence
  Synthetic
cgagaccgcaggcugcggaaguc

SEQ ID NO: 35411 - RNA, 24 nt, Artificial Sequence
  Synthetic
ccgagaccgcaggcugcggaaguc

SEQ ID NO: 35412 - RNA, 18 nt, Artificial Sequence
  Synthetic
acgugguuacccgcgguc

SEQ ID NO: 35413 - RNA, 19 nt, Artificial Sequence
  Synthetic
cacgugguuacccgcgguc

SEQ ID NO: 35414 - RNA, 20 nt, Artificial Sequence
  Synthetic
ucacgugguuacccgcgguc

SEQ ID NO: 35415 - RNA, 21 nt, Artificial Sequence
  Synthetic
aucacgugguuacccgcgguc

SEQ ID NO: 35416 - RNA, 22 nt, Artificial Sequence
  Synthetic
caucacgugguuacccgcgguc

SEQ ID NO: 35417 - RNA, 23 nt, Artificial Sequence
  Synthetic
gcaucacgugguuacccgcgguc

SEQ ID NO: 35418 - RNA, 24 nt, Artificial Sequence
  Synthetic
ggcaucacgugguuacccgcgguc

SEQ ID NO: 35419 - RNA, 18 nt, Artificial Sequence
  Synthetic
agggugcggcggcuccag

SEQ ID NO: 35420 - RNA, 19 nt, Artificial Sequence
  Synthetic
cagggugcggcggcuccag

SEQ ID NO: 35421 - RNA, 20 nt, Artificial Sequence
  Synthetic
gcagggugcggcggcuccag

SEQ ID NO: 35422 - RNA, 21 nt, Artificial Sequence
  Synthetic
agcagggugcggcggcuccag

SEQ ID NO: 35423 - RNA, 22 nt, Artificial Sequence
  Synthetic
gagcagggugcggcggcuccag

SEQ ID NO: 35424 - RNA, 23 nt, Artificial Sequence
  Synthetic
ggagcagggugcggcggcuccag

SEQ ID NO: 35425 - RNA, 24 nt, Artificial Sequence
  Synthetic
gggagcagggugcggcggcuccag

SEQ ID NO: 35426 - RNA, 18 nt, Artificial Sequence
  Synthetic
acgcuagagacccccgag

SEQ ID NO: 35427 - RNA, 19 nt, Artificial Sequence
  Synthetic
cacgcuagagacccccgag

SEQ ID NO: 35428 - RNA, 20 nt, Artificial Sequence
  Synthetic
ccacgcuagagacccccgag

SEQ ID NO: 35429 - RNA, 21 nt, Artificial Sequence
  Synthetic
accacgcuagagacccccgag

SEQ ID NO: 35430 - RNA, 22 nt, Artificial Sequence
  Synthetic
gaccacgcuagagacccccgag

SEQ ID NO: 35431 - RNA, 23 nt, Artificial Sequence
  Synthetic
cgaccacgcuagagacccccgag

SEQ ID NO: 35432 - RNA, 24 nt, Artificial Sequence
  Synthetic
gcgaccacgcuagagacccccgag

SEQ ID NO: 35433 - RNA, 18 nt, Artificial Sequence
  Synthetic
ccccuccccacaaacacg

SEQ ID NO: 35434 - RNA, 19 nt, Artificial Sequence
  Synthetic
cccccuccccacaaacacg

SEQ ID NO: 35435 - RNA, 20 nt, Artificial Sequence
  Synthetic
ccccccuccccacaaacacg

SEQ ID NO: 35436 - RNA, 21 nt, Artificial Sequence
  Synthetic
cccccccuccccacaaacacg

SEQ ID NO: 35437 - RNA, 22 nt, Artificial Sequence
  Synthetic
ccccccccuccccacaaacacg

SEQ ID NO: 35438 - RNA, 23 nt, Artificial Sequence
  Synthetic
accccccccuccccacaaacacg

SEQ ID NO: 35439 - RNA, 24 nt, Artificial Sequence
  Synthetic
gaccccccccuccccacaaacacg

SEQ ID NO: 35440 - RNA, 18 nt, Artificial Sequence
  Synthetic
ggcuguuccacuccgacg

SEQ ID NO: 35441 - RNA, 19 nt, Artificial Sequence
  Synthetic
aggcuguuccacuccgacg

SEQ ID NO: 35442 - RNA, 20 nt, Artificial Sequence
  Synthetic
gaggcuguuccacuccgacg

SEQ ID NO: 35443 - RNA, 21 nt, Artificial Sequence
  Synthetic
agaggcuguuccacuccgacg

SEQ ID NO: 35444 - RNA, 22 nt, Artificial Sequence
  Synthetic
cagaggcuguuccacuccgacg

SEQ ID NO: 35445 - RNA, 23 nt, Artificial Sequence
  Synthetic
ccagaggcuguuccacuccgacg

SEQ ID NO: 35446 - RNA, 24 nt, Artificial Sequence
  Synthetic
uccagaggcuguuccacuccgacg

SEQ ID NO: 35447 - RNA, 18 nt, Artificial Sequence
  Synthetic
agcgcgugaggccgcccg

SEQ ID NO: 35448 - RNA, 19 nt, Artificial Sequence
  Synthetic
uagcgcgugaggccgcccg

SEQ ID NO: 35449 - RNA, 20 nt, Artificial Sequence
  Synthetic
guagcgcgugaggccgcccg

SEQ ID NO: 35450 - RNA, 21 nt, Artificial Sequence
  Synthetic
gguagcgcgugaggccgcccg

SEQ ID NO: 35451 - RNA, 22 nt, Artificial Sequence
  Synthetic
agguagcgcgugaggccgcccg

SEQ ID NO: 35452 - RNA, 23 nt, Artificial Sequence
  Synthetic
cagguagcgcgugaggccgcccg

SEQ ID NO: 35453 - RNA, 24 nt, Artificial Sequence
  Synthetic
gcagguagcgcgugaggccgcccg

SEQ ID NO: 35454 - RNA, 18 nt, Artificial Sequence
  Synthetic
gaagcagcgcgggggccg

SEQ ID NO: 35455 - RNA, 19 nt, Artificial Sequence
  Synthetic
agaagcagcgcgggggccg

SEQ ID NO: 35456 - RNA, 20 nt, Artificial Sequence
  Synthetic
cagaagcagcgcgggggccg

SEQ ID NO: 35457 - RNA, 21 nt, Artificial Sequence
  Synthetic
ccagaagcagcgcgggggccg

SEQ ID NO: 35458 - RNA, 22 nt, Artificial Sequence
  Synthetic
cccagaagcagcgcgggggccg

SEQ ID NO: 35459 - RNA, 23 nt, Artificial Sequence
  Synthetic
gcccagaagcagcgcgggggccg

SEQ ID NO: 35460 - RNA, 24 nt, Artificial Sequence
  Synthetic
ggcccagaagcagcgcgggggccg

SEQ ID NO: 35461 - RNA, 18 nt, Artificial Sequence
  Synthetic
cgcggcccagaagcagcg

SEQ ID NO: 35462 - RNA, 19 nt, Artificial Sequence
  Synthetic
ccgcggcccagaagcagcg

SEQ ID NO: 35463 - RNA, 20 nt, Artificial Sequence
  Synthetic
cccgcggcccagaagcagcg

SEQ ID NO: 35464 - RNA, 21 nt, Artificial Sequence
  Synthetic
ccccgcggcccagaagcagcg

SEQ ID NO: 35465 - RNA, 22 nt, Artificial Sequence
  Synthetic
cccccgcggcccagaagcagcg

SEQ ID NO: 35466 - RNA, 23 nt, Artificial Sequence
  Synthetic
gcccccgcggcccagaagcagcg

SEQ ID NO: 35467 - RNA, 24 nt, Artificial Sequence
  Synthetic
ggcccccgcggcccagaagcagcg

SEQ ID NO: 35468 - RNA, 18 nt, Artificial Sequence
  Synthetic
ggggccgucggguacucg

SEQ ID NO: 35469 - RNA, 19 nt, Artificial Sequence
  Synthetic
gggggccgucggguacucg

SEQ ID NO: 35470 - RNA, 20 nt, Artificial Sequence
  Synthetic
cgggggccgucggguacucg

SEQ ID NO: 35471 - RNA, 21 nt, Artificial Sequence
  Synthetic
gcgggggccgucggguacucg

SEQ ID NO: 35472 - RNA, 22 nt, Artificial Sequence
  Synthetic
cgcgggggccgucggguacucg

SEQ ID NO: 35473 - RNA, 23 nt, Artificial Sequence
  Synthetic
acgcgggggccgucggguacucg

SEQ ID NO: 35474 - RNA, 24 nt, Artificial Sequence
  Synthetic
gacgcgggggccgucggguacucg

SEQ ID NO: 35475 - RNA, 18 nt, Artificial Sequence
  Synthetic
cgggcgggcaggcgcucg

SEQ ID NO: 35476 - RNA, 19 nt, Artificial Sequence
  Synthetic
ccgggcgggcaggcgcucg

SEQ ID NO: 35477 - RNA, 20 nt, Artificial Sequence
  Synthetic
uccgggcgggcaggcgcucg

SEQ ID NO: 35478 - RNA, 21 nt, Artificial Sequence
  Synthetic
guccgggcgggcaggcgcucg

SEQ ID NO: 35479 - RNA, 22 nt, Artificial Sequence
  Synthetic
aguccgggcgggcaggcgcucg

SEQ ID NO: 35480 - RNA, 23 nt, Artificial Sequence
  Synthetic
caguccgggcgggcaggcgcucg

SEQ ID NO: 35481 - RNA, 24 nt, Artificial Sequence
  Synthetic
ucaguccgggcgggcaggcgcucg

SEQ ID NO: 35482 - RNA, 18 nt, Artificial Sequence
  Synthetic
ugguuacccgcggucucg

SEQ ID NO: 35483 - RNA, 19 nt, Artificial Sequence
  Synthetic
gugguuacccgcggucucg

SEQ ID NO: 35484 - RNA, 20 nt, Artificial Sequence
  Synthetic
cgugguuacccgcggucucg

SEQ ID NO: 35485 - RNA, 21 nt, Artificial Sequence
  Synthetic
acgugguuacccgcggucucg

SEQ ID NO: 35486 - RNA, 22 nt, Artificial Sequence
  Synthetic
cacgugguuacccgcggucucg

SEQ ID NO: 35487 - RNA, 23 nt, Artificial Sequence
  Synthetic
ucacgugguuacccgcggucucg

SEQ ID NO: 35488 - RNA, 24 nt, Artificial Sequence
  Synthetic
aucacgugguuacccgcggucucg

SEQ ID NO: 35489 - RNA, 18 nt, Artificial Sequence
  Synthetic
cccgucuccauguccagg

SEQ ID NO: 35490 - RNA, 19 nt, Artificial Sequence
  Synthetic
ccccgucuccauguccagg

SEQ ID NO: 35491 - RNA, 20 nt, Artificial Sequence
  Synthetic
uccccgucuccauguccagg

SEQ ID NO: 35492 - RNA, 21 nt, Artificial Sequence
  Synthetic
uuccccgucuccauguccagg

SEQ ID NO: 35493 - RNA, 22 nt, Artificial Sequence
  Synthetic
guuccccgucuccauguccagg

SEQ ID NO: 35494 - RNA, 23 nt, Artificial Sequence
  Synthetic
uguuccccgucuccauguccagg

SEQ ID NO: 35495 - RNA, 24 nt, Artificial Sequence
  Synthetic
auguuccccgucuccauguccagg

SEQ ID NO: 35496 - RNA, 18 nt, Artificial Sequence
  Synthetic
gaggccaggucaguccgg

SEQ ID NO: 35497 - RNA, 19 nt, Artificial Sequence
  Synthetic
agaggccaggucaguccgg

SEQ ID NO: 35498 - RNA, 20 nt, Artificial Sequence
  Synthetic
cagaggccaggucaguccgg

SEQ ID NO: 35499 - RNA, 21 nt, Artificial Sequence
  Synthetic
ccagaggccaggucaguccgg

SEQ ID NO: 35500 - RNA, 22 nt, Artificial Sequence
  Synthetic
gccagaggccaggucaguccgg

SEQ ID NO: 35501 - RNA, 23 nt, Artificial Sequence
  Synthetic
ggccagaggccaggucaguccgg

SEQ ID NO: 35502 - RNA, 24 nt, Artificial Sequence
  Synthetic
cggccagaggccaggucaguccgg

SEQ ID NO: 35503 - RNA, 18 nt, Artificial Sequence
  Synthetic
ccagaagcagcgcggggg

SEQ ID NO: 35504 - RNA, 19 nt, Artificial Sequence
  Synthetic
cccagaagcagcgcggggg

SEQ ID NO: 35505 - RNA, 20 nt, Artificial Sequence
  Synthetic
gcccagaagcagcgcggggg

SEQ ID NO: 35506 - RNA, 21 nt, Artificial Sequence
  Synthetic
ggcccagaagcagcgcggggg

SEQ ID NO: 35507 - RNA, 22 nt, Artificial Sequence
  Synthetic
cggcccagaagcagcgcggggg

SEQ ID NO: 35508 - RNA, 23 nt, Artificial Sequence
  Synthetic
gcggcccagaagcagcgcggggg

SEQ ID NO: 35509 - RNA, 24 nt, Artificial Sequence
  Synthetic
cgcggcccagaagcagcgcggggg

SEQ ID NO: 35510 - RNA, 18 nt, Artificial Sequence
  Synthetic
cccacuagggugcccugg

SEQ ID NO: 35511 - RNA, 19 nt, Artificial Sequence
  Synthetic
gcccacuagggugcccugg

SEQ ID NO: 35512 - RNA, 20 nt, Artificial Sequence
  Synthetic
cgcccacuagggugcccugg

SEQ ID NO: 35513 - RNA, 21 nt, Artificial Sequence
  Synthetic
gcgcccacuagggugcccugg

SEQ ID NO: 35514 - RNA, 22 nt, Artificial Sequence
  Synthetic
ggcgcccacuagggugcccugg

SEQ ID NO: 35515 - RNA, 23 nt, Artificial Sequence
  Synthetic
gggcgcccacuagggugcccugg

SEQ ID NO: 35516 - RNA, 24 nt, Artificial Sequence
  Synthetic
agggcgcccacuagggugcccugg

SEQ ID NO: 35517 - RNA, 18 nt, Artificial Sequence
  Synthetic
ugccgagaccgcaggcug

SEQ ID NO: 35518 - RNA, 19 nt, Artificial Sequence
  Synthetic
gugccgagaccgcaggcug

SEQ ID NO: 35519 - RNA, 20 nt, Artificial Sequence
  Synthetic
ggugccgagaccgcaggcug

SEQ ID NO: 35520 - RNA, 21 nt, Artificial Sequence
  Synthetic
gggugccgagaccgcaggcug

SEQ ID NO: 35521 - RNA, 22 nt, Artificial Sequence
  Synthetic
cgggugccgagaccgcaggcug

SEQ ID NO: 35522 - RNA, 23 nt, Artificial Sequence
  Synthetic
acgggugccgagaccgcaggcug

SEQ ID NO: 35523 - RNA, 24 nt, Artificial Sequence
  Synthetic
cacgggugccgagaccgcaggcug

SEQ ID NO: 35524 - RNA, 18 nt, Artificial Sequence
  Synthetic
cuccccggaccacgggug

SEQ ID NO: 35525 - RNA, 19 nt, Artificial Sequence
  Synthetic
gcuccccggaccacgggug

SEQ ID NO: 35526 - RNA, 20 nt, Artificial Sequence
  Synthetic
ugcuccccggaccacgggug

SEQ ID NO: 35527 - RNA, 21 nt, Artificial Sequence
  Synthetic
cugcuccccggaccacgggug

SEQ ID NO: 35528 - RNA, 22 nt, Artificial Sequence
  Synthetic
ccugcuccccggaccacgggug

SEQ ID NO: 35529 - RNA, 23 nt, Artificial Sequence
  Synthetic
cccugcuccccggaccacgggug

SEQ ID NO: 35530 - RNA, 24 nt, Artificial Sequence
  Synthetic
ccccugcuccccggaccacgggug

SEQ ID NO: 35531 - RNA, 18 nt, Artificial Sequence
  Synthetic
cccugaguuuuuuuuuau

SEQ ID NO: 35532 - RNA, 19 nt, Artificial Sequence
  Synthetic
ccccugaguuuuuuuuuau

SEQ ID NO: 35533 - RNA, 20 nt, Artificial Sequence
  Synthetic
uccccugaguuuuuuuuuau

SEQ ID NO: 35534 - RNA, 21 nt, Artificial Sequence
  Synthetic
auccccugaguuuuuuuuuau

SEQ ID NO: 35535 - RNA, 22 nt, Artificial Sequence
  Synthetic
aauccccugaguuuuuuuuuau

SEQ ID NO: 35536 - RNA, 23 nt, Artificial Sequence
  Synthetic
aaauccccugaguuuuuuuuuau

SEQ ID NO: 35537 - RNA, 24 nt, Artificial Sequence
  Synthetic
aaaauccccugaguuuuuuuuuau

SEQ ID NO: 35538 - RNA, 18 nt, Artificial Sequence
  Synthetic
cgggggccgucggguacu

SEQ ID NO: 35539 - RNA, 19 nt, Artificial Sequence
  Synthetic
gcgggggccgucggguacu

SEQ ID NO: 35540 - RNA, 20 nt, Artificial Sequence
  Synthetic
cgcgggggccgucggguacu

SEQ ID NO: 35541 - RNA, 21 nt, Artificial Sequence
  Synthetic
acgcgggggccgucggguacu

SEQ ID NO: 35542 - RNA, 22 nt, Artificial Sequence
  Synthetic
gacgcgggggccgucggguacu

SEQ ID NO: 35543 - RNA, 23 nt, Artificial Sequence
  Synthetic
cgacgcgggggccgucggguacu

SEQ ID NO: 35544 - RNA, 24 nt, Artificial Sequence
  Synthetic
ccgacgcgggggccgucggguacu

SEQ ID NO: 35545 - RNA, 18 nt, Artificial Sequence
  Synthetic
gugccgagaccgcaggcu

SEQ ID NO: 35546 - RNA, 19 nt, Artificial Sequence
  Synthetic
ggugccgagaccgcaggcu

SEQ ID NO: 35547 - RNA, 20 nt, Artificial Sequence
  Synthetic
gggugccgagaccgcaggcu

SEQ ID NO: 35548 - RNA, 21 nt, Artificial Sequence
  Synthetic
cgggugccgagaccgcaggcu

SEQ ID NO: 35549 - RNA, 22 nt, Artificial Sequence
  Synthetic
acgggugccgagaccgcaggcu

SEQ ID NO: 35550 - RNA, 23 nt, Artificial Sequence
  Synthetic
cacgggugccgagaccgcaggcu

SEQ ID NO: 35551 - RNA, 24 nt, Artificial Sequence
  Synthetic
ccacgggugccgagaccgcaggcu

SEQ ID NO: 35552 - RNA, 18 nt, Artificial Sequence
  Synthetic
cgucccccggcggucucu

SEQ ID NO: 35553 - RNA, 19 nt, Artificial Sequence
  Synthetic
acgucccccggcggucucu

SEQ ID NO: 35554 - RNA, 20 nt, Artificial Sequence
  Synthetic
cacgucccccggcggucucu

SEQ ID NO: 35555 - RNA, 21 nt, Artificial Sequence
  Synthetic
ccacgucccccggcggucucu

SEQ ID NO: 35556 - RNA, 22 nt, Artificial Sequence
  Synthetic
cccacgucccccggcggucucu

SEQ ID NO: 35557 - RNA, 23 nt, Artificial Sequence
  Synthetic
ccccacgucccccggcggucucu

SEQ ID NO: 35558 - RNA, 24 nt, Artificial Sequence
  Synthetic
accccacgucccccggcggucucu

SEQ ID NO: 35559 - RNA, 18 nt, Artificial Sequence
  Synthetic
cgugguuacccgcggucu

SEQ ID NO: 35560 - RNA, 19 nt, Artificial Sequence
  Synthetic
acgugguuacccgcggucu

SEQ ID NO: 35561 - RNA, 20 nt, Artificial Sequence
  Synthetic
cacgugguuacccgcggucu

SEQ ID NO: 35562 - RNA, 21 nt, Artificial Sequence
  Synthetic
ucacgugguuacccgcggucu

SEQ ID NO: 35563 - RNA, 22 nt, Artificial Sequence
  Synthetic
aucacgugguuacccgcggucu

SEQ ID NO: 35564 - RNA, 23 nt, Artificial Sequence
  Synthetic
caucacgugguuacccgcggucu

SEQ ID NO: 35565 - RNA, 24 nt, Artificial Sequence
  Synthetic
gcaucacgugguuacccgcggucu

SEQ ID NO: 35566 - RNA, 18 nt, Artificial Sequence
  Synthetic
gccagaggccaggucagu

SEQ ID NO: 35567 - RNA, 19 nt, Artificial Sequence
  Synthetic
ggccagaggccaggucagu

SEQ ID NO: 35568 - RNA, 20 nt, Artificial Sequence
  Synthetic
cggccagaggccaggucagu

SEQ ID NO: 35569 - RNA, 21 nt, Artificial Sequence
  Synthetic
gcggccagaggccaggucagu

SEQ ID NO: 35570 - RNA, 22 nt, Artificial Sequence
  Synthetic
ggcggccagaggccaggucagu

SEQ ID NO: 35571 - RNA, 23 nt, Artificial Sequence
  Synthetic
uggcggccagaggccaggucagu

SEQ ID NO: 35572 - RNA, 24 nt, Artificial Sequence
  Synthetic
guggcggccagaggccaggucagu

SEQ ID NO: 35573 - RNA, 18 nt, Artificial Sequence
  Synthetic
gguguggccgacccccuu

SEQ ID NO: 35574 - RNA, 19 nt, Artificial Sequence
  Synthetic
ugguguggccgacccccuu

SEQ ID NO: 35575 - RNA, 20 nt, Artificial Sequence
  Synthetic
gugguguggccgacccccuu

SEQ ID NO: 35576 - RNA, 21 nt, Artificial Sequence
  Synthetic
ugugguguggccgacccccuu

SEQ ID NO: 35577 - RNA, 22 nt, Artificial Sequence
  Synthetic
cugugguguggccgacccccuu

SEQ ID NO: 35578 - RNA, 23 nt, Artificial Sequence
  Synthetic
ucugugguguggccgacccccuu

SEQ ID NO: 35579 - RNA, 24 nt, Artificial Sequence
  Synthetic
gucugugguguggccgacccccuu

SEQ ID NO: 35580 - RNA, 18 nt, Artificial Sequence
  Synthetic
gccaguggcaggaugcuu

SEQ ID NO: 35581 - RNA, 19 nt, Artificial Sequence
  Synthetic
ugccaguggcaggaugcuu

SEQ ID NO: 35582 - RNA, 20 nt, Artificial Sequence
  Synthetic
augccaguggcaggaugcuu

SEQ ID NO: 35583 - RNA, 21 nt, Artificial Sequence
  Synthetic
caugccaguggcaggaugcuu

SEQ ID NO: 35584 - RNA, 22 nt, Artificial Sequence
  Synthetic
ccaugccaguggcaggaugcuu

SEQ ID NO: 35585 - RNA, 23 nt, Artificial Sequence
  Synthetic
uccaugccaguggcaggaugcuu

SEQ ID NO: 35586 - RNA, 24 nt, Artificial Sequence
  Synthetic
cuccaugccaguggcaggaugcuu

SEQ ID NO: 35587 - RNA, 18 nt, Artificial Sequence
  Synthetic
cuccgcguggcgcgucuu

SEQ ID NO: 35588 - RNA, 19 nt, Artificial Sequence
  Synthetic
ucuccgcguggcgcgucuu

SEQ ID NO: 35589 - RNA, 20 nt, Artificial Sequence
  Synthetic
gucuccgcguggcgcgucuu

SEQ ID NO: 35590 - RNA, 21 nt, Artificial Sequence
  Synthetic
agucuccgcguggcgcgucuu

SEQ ID NO: 35591 - RNA, 22 nt, Artificial Sequence
  Synthetic
aagucuccgcguggcgcgucuu

SEQ ID NO: 35592 - RNA, 23 nt, Artificial Sequence
  Synthetic
gaagucuccgcguggcgcgucuu

SEQ ID NO: 35593 - RNA, 24 nt, Artificial Sequence
  Synthetic
ggaagucuccgcguggcgcgucuu

SEQ ID NO: 35594 - RNA, 18 nt, Artificial Sequence
  Synthetic
ccaguggcaggaugcuuu

SEQ ID NO: 35595 - RNA, 19 nt, Artificial Sequence
  Synthetic
gccaguggcaggaugcuuu

SEQ ID NO: 35596 - RNA, 20 nt, Artificial Sequence
  Synthetic
ugccaguggcaggaugcuuu

SEQ ID NO: 35597 - RNA, 21 nt, Artificial Sequence
  Synthetic
augccaguggcaggaugcuuu

SEQ ID NO: 35598 - RNA, 22 nt, Artificial Sequence
  Synthetic
caugccaguggcaggaugcuuu

SEQ ID NO: 35599 - RNA, 23 nt, Artificial Sequence
  Synthetic
ccaugccaguggcaggaugcuuu

SEQ ID NO: 35600 - RNA, 24 nt, Artificial Sequence
  Synthetic
uccaugccaguggcaggaugcuuu

SEQ ID NO: 35601 - RNA, 20 nt, Artificial Sequence
  Synthetic
guguuuuugugccuggcucu

SEQ ID NO: 35602 - RNA, 17 nt, Artificial Sequence
  Synthetic
ccgccacuccuccguau

SEQ ID NO: 35603 - RNA, 20 nt, Artificial Sequence
  Synthetic
cacccgccacuccuccguau

SEQ ID NO: 35604 - RNA, 17 nt, Artificial Sequence
  Synthetic
uuuuugugccuggcucu

SEQ ID NO: 35605 - RNA, 17 nt, Artificial Sequence
  Synthetic
gcuccaugccaguggca

SEQ ID NO: 35606 - RNA, 17 nt, Artificial Sequence
  Synthetic
acuuuuccccuccccga

SEQ ID NO: 35607 - RNA, 17 nt, Artificial Sequence
  Synthetic
cuaauaaaaaaaaacuc

SEQ ID NO: 35608 - RNA, 17 nt, Artificial Sequence
  Synthetic
gcccauccccucgucuc

SEQ ID NO: 35609 - RNA, 17 nt, Artificial Sequence
  Synthetic
accucccucggcccccg

SEQ ID NO: 35610 - RNA, 17 nt, Artificial Sequence
  Synthetic
guaugaaggaggggggg

SEQ ID NO: 35611 - RNA, 20 nt, Artificial Sequence
  Synthetic
cuggcuccaugccaguggca

SEQ ID NO: 35612 - RNA, 20 nt, Artificial Sequence
  Synthetic
uucacuuuuccccuccccga

SEQ ID NO: 35613 - RNA, 20 nt, Artificial Sequence
  Synthetic
gcccuaauaaaaaaaaacuc

SEQ ID NO: 35614 - RNA, 20 nt, Artificial Sequence
  Synthetic
cacgcccauccccucgucuc

SEQ ID NO: 35615 - RNA, 20 nt, Artificial Sequence
  Synthetic
gaaaccucccucggcccccg

SEQ ID NO: 35616 - RNA, 20 nt, Artificial Sequence
  Synthetic
gugguaugaaggaggggggg

SEQ ID NO: 35617 - RNA, 17 nt, Artificial Sequence
  Synthetic
gacgggcgccacaccca

SEQ ID NO: 35618 - RNA, 17 nt, Artificial Sequence
  Synthetic
gcccacgcgguagagga

SEQ ID NO: 35619 - RNA, 17 nt, Artificial Sequence
  Synthetic
gguggauccgaacacgc

SEQ ID NO: 35620 - RNA, 17 nt, Artificial Sequence
  Synthetic
gauacggguuggcucgc

SEQ ID NO: 35621 - RNA, 17 nt, Artificial Sequence
  Synthetic
gucguucccgggggggc

SEQ ID NO: 35622 - RNA, 17 nt, Artificial Sequence
  Synthetic
ggauacggguuggcucg

SEQ ID NO: 35623 - RNA, 17 nt, Artificial Sequence
  Synthetic
ggaacgacgacgggggg

SEQ ID NO: 35624 - RNA, 17 nt, Artificial Sequence
  Synthetic
gaacgacgacggggggg

SEQ ID NO: 35625 - RNA, 17 nt, Artificial Sequence
  Synthetic
gggggugaccggcgcgu

SEQ ID NO: 35626 - RNA, 17 nt, Artificial Sequence
  Synthetic
ggccgggcacgcgccuu

SEQ ID NO: 35627 - RNA, 17 nt, Artificial Sequence
  Synthetic
gccgggcacgcgccuuu

SEQ ID NO: 35628 - RNA, 20 nt, Artificial Sequence
  Synthetic
gcgcccacgcgguagaggaa

SEQ ID NO: 35629 - RNA, 20 nt, Artificial Sequence
  Synthetic
gcccccccgggaacgacgac

SEQ ID NO: 35630 - RNA, 20 nt, Artificial Sequence
  Synthetic
ggggguggauccgaacacgc

SEQ ID NO: 35631 - RNA, 20 nt, Artificial Sequence
  Synthetic
gucgucguucccgggggggc

SEQ ID NO: 35632 - RNA, 20 nt, Artificial Sequence
  Synthetic
gagcuucugcugaggcggcg

SEQ ID NO: 35633 - RNA, 20 nt, Artificial Sequence
  Synthetic
gccucguguuucuugaaagg

SEQ ID NO: 35634 - RNA, 20 nt, Artificial Sequence
  Synthetic
gauacggguuggcucgcggg

SEQ ID NO: 35635 - RNA, 20 nt, Artificial Sequence
  Synthetic
gcgccuuugggguuguuggg

SEQ ID NO: 35636 - RNA, 20 nt, Artificial Sequence
  Synthetic
gggcgccacacccacggcug

SEQ ID NO: 35637 - RNA, 20 nt, Artificial Sequence
  Synthetic
guccccuuccucuaccgcgu

SEQ ID NO: 35638 - RNA, 20 nt, Artificial Sequence
  Synthetic
ggggggggugaccggcgcgu

SEQ ID NO: 35639 - RNA, 20 nt, Artificial Sequence
  Synthetic
gcacgcgccuuugggguugu

SEQ ID NO: 35640 - RNA, 20 nt, Artificial Sequence
  Synthetic
guggccgggcacgcgccuuu

SEQ ID NO: 35641 - RNA, 17 nt, Artificial Sequence
  Synthetic
ccccccgggaacgacga

SEQ ID NO: 35642 - RNA, 17 nt, Artificial Sequence
  Synthetic
cccccgggaacgacgac

SEQ ID NO: 35643 - RNA, 17 nt, Artificial Sequence
  Synthetic
uagguuuagggucguac

SEQ ID NO: 35644 - RNA, 17 nt, Artificial Sequence
  Synthetic
cccccgucgucguuccc

SEQ ID NO: 35645 - RNA, 17 nt, Artificial Sequence
  Synthetic
ccccaaaggcgcgugcc

SEQ ID NO: 35646 - RNA, 17 nt, Artificial Sequence
  Synthetic
ccccccgucgucguucc

SEQ ID NO: 35647 - RNA, 17 nt, Artificial Sequence
  Synthetic
cucuaccgcgugggcgc

SEQ ID NO: 35648 - RNA, 17 nt, Artificial Sequence
  Synthetic
accgcgugggcgcgggc

SEQ ID NO: 35649 - RNA, 17 nt, Artificial Sequence
  Synthetic
uauuauuuucgcggauc

SEQ ID NO: 35650 - RNA, 17 nt, Artificial Sequence
  Synthetic
ccccgggaacgacgacg

SEQ ID NO: 35651 - RNA, 17 nt, Artificial Sequence
  Synthetic
ccccgucgucguucccg

SEQ ID NO: 35652 - RNA, 17 nt, Artificial Sequence
  Synthetic
ccccuuccucuaccgcg

SEQ ID NO: 35653 - RNA, 17 nt, Artificial Sequence
  Synthetic
ucaagaaacacgaggcg

SEQ ID NO: 35654 - RNA, 17 nt, Artificial Sequence
  Synthetic
cccgggaacgacgacgg

SEQ ID NO: 35655 - RNA, 17 nt, Artificial Sequence
  Synthetic
cccgucgucguucccgg

SEQ ID NO: 35656 - RNA, 17 nt, Artificial Sequence
  Synthetic
ccgggaacgacgacggg

SEQ ID NO: 35657 - RNA, 17 nt, Artificial Sequence
  Synthetic
acggguuggcucgcggg

SEQ ID NO: 35658 - RNA, 17 nt, Artificial Sequence
  Synthetic
cgggaacgacgacgggg

SEQ ID NO: 35659 - RNA, 17 nt, Artificial Sequence
  Synthetic
cgucgucguucccgggg

SEQ ID NO: 35660 - RNA, 17 nt, Artificial Sequence
  Synthetic
aacgacgacgggggggg

SEQ ID NO: 35661 - RNA, 17 nt, Artificial Sequence
  Synthetic
ugaccggcgcguggggg

SEQ ID NO: 35662 - RNA, 17 nt, Artificial Sequence
  Synthetic
cgccacacccacggcug

SEQ ID NO: 35663 - RNA, 17 nt, Artificial Sequence
  Synthetic
uuggcucgcgggcggug

SEQ ID NO: 35664 - RNA, 17 nt, Artificial Sequence
  Synthetic
ccgggcacgcgccuuug

SEQ ID NO: 35665 - RNA, 17 nt, Artificial Sequence
  Synthetic
cccuuccucuaccgcgu

SEQ ID NO: 35666 - RNA, 17 nt, Artificial Sequence
  Synthetic
cgcgccuuugggguugu

SEQ ID NO: 35667 - RNA, 17 nt, Artificial Sequence
  Synthetic
cgcggauccggcguguu

SEQ ID NO: 35668 - RNA, 20 nt, Artificial Sequence
  Synthetic
cgaggcgggggucccagaaa

SEQ ID NO: 35669 - RNA, 20 nt, Artificial Sequence
  Synthetic
acgaggcgggggucccagaa

SEQ ID NO: 35670 - RNA, 20 nt, Artificial Sequence
  Synthetic
ugcccccccgggaacgacga

SEQ ID NO: 35671 - RNA, 20 nt, Artificial Sequence
  Synthetic
cgcgcccacgcgguagagga

SEQ ID NO: 35672 - RNA, 20 nt, Artificial Sequence
  Synthetic
acgacgggggggggggaaac

SEQ ID NO: 35673 - RNA, 20 nt, Artificial Sequence
  Synthetic
acgcgguagaggaaggggac

SEQ ID NO: 35674 - RNA, 20 nt, Artificial Sequence
  Synthetic
cgugggggcggugggcguac

SEQ ID NO: 35675 - RNA, 20 nt, Artificial Sequence
  Synthetic
ccccccccgucgucguuccc

SEQ ID NO: 35676 - RNA, 20 nt, Artificial Sequence
  Synthetic
caaccccaaaggcgcgugcc

SEQ ID NO: 35677 - RNA, 20 nt, Artificial Sequence
  Synthetic
cccccccccgucgucguucc

SEQ ID NO: 35678 - RNA, 20 nt, Artificial Sequence
  Synthetic
uuccucuaccgcgugggcgc

SEQ ID NO: 35679 - RNA, 20 nt, Artificial Sequence
  Synthetic
aaggauacggguuggcucgc

SEQ ID NO: 35680 - RNA, 20 nt, Artificial Sequence
  Synthetic
ucuaccgcgugggcgcgggc

SEQ ID NO: 35681 - RNA, 20 nt, Artificial Sequence
  Synthetic
uguuauuauuuucgcggauc

SEQ ID NO: 35682 - RNA, 20 nt, Artificial Sequence
  Synthetic
cgccucguguuucuugaaag

SEQ ID NO: 35683 - RNA, 20 nt, Artificial Sequence
  Synthetic
cgcccacgcgguagaggaag

SEQ ID NO: 35684 - RNA, 20 nt, Artificial Sequence
  Synthetic
cccccccgggaacgacgacg

SEQ ID NO: 35685 - RNA, 20 nt, Artificial Sequence
  Synthetic
cccccccgucgucguucccg

SEQ ID NO: 35686 - RNA, 20 nt, Artificial Sequence
  Synthetic
cguccccuuccucuaccgcg

SEQ ID NO: 35687 - RNA, 20 nt, Artificial Sequence
  Synthetic
cuuucaagaaacacgaggcg

SEQ ID NO: 35688 - RNA, 20 nt, Artificial Sequence
  Synthetic
cuaccgcgugggcgcgggcg

SEQ ID NO: 35689 - RNA, 20 nt, Artificial Sequence
  Synthetic
cuuccucuaccgcgugggcg

SEQ ID NO: 35690 - RNA, 20 nt, Artificial Sequence
  Synthetic
cccuuucaagaaacacgagg

SEQ ID NO: 35691 - RNA, 20 nt, Artificial Sequence
  Synthetic
ccccccgggaacgacgacgg

SEQ ID NO: 35692 - RNA, 20 nt, Artificial Sequence
  Synthetic
ccccccgucgucguucccgg

SEQ ID NO: 35693 - RNA, 20 nt, Artificial Sequence
  Synthetic
ugaccggcgcgugggggcgg

SEQ ID NO: 35694 - RNA, 20 nt, Artificial Sequence
  Synthetic
cccccgggaacgacgacggg

SEQ ID NO: 35695 - RNA, 20 nt, Artificial Sequence
  Synthetic
cccccgucgucguucccggg

SEQ ID NO: 35696 - RNA, 20 nt, Artificial Sequence
  Synthetic
cucuaccgcgugggcgcggg

SEQ ID NO: 35697 - RNA, 20 nt, Artificial Sequence
  Synthetic
ccccgggaacgacgacgggg

SEQ ID NO: 35698 - RNA, 20 nt, Artificial Sequence
  Synthetic
ccccgucgucguucccgggg

SEQ ID NO: 35699 - RNA, 20 nt, Artificial Sequence
  Synthetic
ccgggaacgacgacgggggg

SEQ ID NO: 35700 - RNA, 20 nt, Artificial Sequence
  Synthetic
cgcgccuuugggguuguugg

SEQ ID NO: 35701 - RNA, 20 nt, Artificial Sequence
  Synthetic
uggccgggcacgcgccuuug

SEQ ID NO: 35702 - RNA, 20 nt, Artificial Sequence
  Synthetic
uguggccgggcacgcgccuu

SEQ ID NO: 35703 - RNA, 20 nt, Artificial Sequence
  Synthetic
uuucgcggauccggcguguu

SEQ ID NO: 35704 - RNA, 20 nt, Artificial Sequence
  Synthetic
cacgcgccuuugggguuguu

SEQ ID NO: 35705 - RNA, 17 nt, Artificial Sequence
  Synthetic
ggcgggggucccagaaa

SEQ ID NO: 35706 - RNA, 17 nt, Artificial Sequence
  Synthetic
ggaagaggaaggagaaa

SEQ ID NO: 35707 - RNA, 17 nt, Artificial Sequence
  Synthetic
gacgggggggggggaaa

SEQ ID NO: 35708 - RNA, 17 nt, Artificial Sequence
  Synthetic
gggaagaggaaggagaa

SEQ ID NO: 35709 - RNA, 17 nt, Artificial Sequence
  Synthetic
gccucguguuucuugaa

SEQ ID NO: 35710 - RNA, 17 nt, Artificial Sequence
  Synthetic
gaagagagaagagagca

SEQ ID NO: 35711 - RNA, 17 nt, Artificial Sequence
  Synthetic
gguggaagggaagagga

SEQ ID NO: 35712 - RNA, 17 nt, Artificial Sequence
  Synthetic
gcgguagaggaagggga

SEQ ID NO: 35713 - RNA, 17 nt, Artificial Sequence
  Synthetic
gggggcggugggcguac

SEQ ID NO: 35714 - RNA, 17 nt, Artificial Sequence
  Synthetic
ggaagagagaagagagc

SEQ ID NO: 35715 - RNA, 17 nt, Artificial Sequence
  Synthetic
gcuucugcugaggcggc

SEQ ID NO: 35716 - RNA, 17 nt, Artificial Sequence
  Synthetic
ggggucccagaaagggc

SEQ ID NO: 35717 - RNA, 17 nt, Artificial Sequence
  Synthetic
ggagagggggggggggc

SEQ ID NO: 35718 - RNA, 17 nt, Artificial Sequence
  Synthetic
gggggcaggcgcggguc

SEQ ID NO: 35719 - RNA, 17 nt, Artificial Sequence
  Synthetic
gaccugccugcccuuuc

SEQ ID NO: 35720 - RNA, 17 nt, Artificial Sequence
  Synthetic
gaagaggaaggagaaag

SEQ ID NO: 35721 - RNA, 17 nt, Artificial Sequence
  Synthetic
gguggguggaagggaag

SEQ ID NO: 35722 - RNA, 17 nt, Artificial Sequence
  Synthetic
gcugaggcggcggggag

SEQ ID NO: 35723 - RNA, 17 nt, Artificial Sequence
  Synthetic
gugcccggccacagccg

SEQ ID NO: 35724 - RNA, 17 nt, Artificial Sequence
  Synthetic
ggggggugaccggcgcg

SEQ ID NO: 35725 - RNA, 17 nt, Artificial Sequence
  Synthetic
gaggcggcggggagagg

SEQ ID NO: 35726 - RNA, 17 nt, Artificial Sequence
  Synthetic
gugagcuucugcugagg

SEQ ID NO: 35727 - RNA, 17 nt, Artificial Sequence
  Synthetic
gggggggggggaaacgg

SEQ ID NO: 35728 - RNA, 17 nt, Artificial Sequence
  Synthetic
gcgugggcgcgggcggg

SEQ ID NO: 35729 - RNA, 17 nt, Artificial Sequence
  Synthetic
gagggggggggggcggg

SEQ ID NO: 35730 - RNA, 17 nt, Artificial Sequence
  Synthetic
gaggaaggagaaagggg

SEQ ID NO: 35731 - RNA, 17 nt, Artificial Sequence
  Synthetic
ggcggcggggagagggg

SEQ ID NO: 35732 - RNA, 17 nt, Artificial Sequence
  Synthetic
gcggcggggagaggggg

SEQ ID NO: 35733 - RNA, 17 nt, Artificial Sequence
  Synthetic
ggggggggaaacggggg

SEQ ID NO: 35734 - RNA, 17 nt, Artificial Sequence
  Synthetic
gggaacgacgacggggg

SEQ ID NO: 35735 - RNA, 17 nt, Artificial Sequence
  Synthetic
gaaggagaaaggggggg

SEQ ID NO: 35736 - RNA, 17 nt, Artificial Sequence
  Synthetic
ggcggggagaggggggg

SEQ ID NO: 35737 - RNA, 17 nt, Artificial Sequence
  Synthetic
gggcgcgggcggggggg

SEQ ID NO: 35738 - RNA, 17 nt, Artificial Sequence
  Synthetic
gcggggagagggggggg

SEQ ID NO: 35739 - RNA, 17 nt, Artificial Sequence
  Synthetic
gggagaggggggggggg

SEQ ID NO: 35740 - RNA, 17 nt, Artificial Sequence
  Synthetic
ggggaaacggggguggg

SEQ ID NO: 35741 - RNA, 17 nt, Artificial Sequence
  Synthetic
ggggguggugguagugg

SEQ ID NO: 35742 - RNA, 17 nt, Artificial Sequence
  Synthetic
gggugaccggcgcgugg

SEQ ID NO: 35743 - RNA, 17 nt, Artificial Sequence
  Synthetic
gccuuugggguuguugg

SEQ ID NO: 35744 - RNA, 17 nt, Artificial Sequence
  Synthetic
ggggugaccggcgcgug

SEQ ID NO: 35745 - RNA, 17 nt, Artificial Sequence
  Synthetic
ggccacagccgugggug

SEQ ID NO: 35746 - RNA, 17 nt, Artificial Sequence
  Synthetic
gaagagagcagggguug

SEQ ID NO: 35747 - RNA, 17 nt, Artificial Sequence
  Synthetic
ggggggcaggcgcgggu

SEQ ID NO: 35748 - RNA, 17 nt, Artificial Sequence
  Synthetic
gagaagagagcaggggu

SEQ ID NO: 35749 - RNA, 17 nt, Artificial Sequence
  Synthetic
gggggggaaacgggggu

SEQ ID NO: 35750 - RNA, 17 nt, Artificial Sequence
  Synthetic
gcgccuuugggguuguu

SEQ ID NO: 35751 - RNA, 20 nt, Artificial Sequence
  Synthetic
gacgacgggggggggggaaa

SEQ ID NO: 35752 - RNA, 20 nt, Artificial Sequence
  Synthetic
gaagggaagaggaaggagaa

SEQ ID NO: 35753 - RNA, 20 nt, Artificial Sequence
  Synthetic
ggaaacggggguggguggaa

SEQ ID NO: 35754 - RNA, 20 nt, Artificial Sequence
  Synthetic
ggggacgggcgccacaccca

SEQ ID NO: 35755 - RNA, 20 nt, Artificial Sequence
  Synthetic
gcggaagagagaagagagca

SEQ ID NO: 35756 - RNA, 20 nt, Artificial Sequence
  Synthetic
guggguggaagggaagagga

SEQ ID NO: 35757 - RNA, 20 nt, Artificial Sequence
  Synthetic
gggaaacgggggugggugga

SEQ ID NO: 35758 - RNA, 20 nt, Artificial Sequence
  Synthetic
gcgugggggcggugggcgua

SEQ ID NO: 35759 - RNA, 20 nt, Artificial Sequence
  Synthetic
gguuguugggggggggugac

SEQ ID NO: 35760 - RNA, 20 nt, Artificial Sequence
  Synthetic
ggcggaagagagaagagagc

SEQ ID NO: 35761 - RNA, 20 nt, Artificial Sequence
  Synthetic
guucccgggggggcaggcgc

SEQ ID NO: 35762 - RNA, 20 nt, Artificial Sequence
  Synthetic
gggucccagaaagggcaggc

SEQ ID NO: 35763 - RNA, 20 nt, Artificial Sequence
  Synthetic
gcgggggucccagaaagggc

SEQ ID NO: 35764 - RNA, 20 nt, Artificial Sequence
  Synthetic
gccacacccacggcuguggc

SEQ ID NO: 35765 - RNA, 20 nt, Artificial Sequence
  Synthetic
gcugaccugccugcccuuuc

SEQ ID NO: 35766 - RNA, 20 nt, Artificial Sequence
  Synthetic
ggggguggguggaagggaag

SEQ ID NO: 35767 - RNA, 20 nt, Artificial Sequence
  Synthetic
gggcggggggguggugguag

SEQ ID NO: 35768 - RNA, 20 nt, Artificial Sequence
  Synthetic
gggggggggugaccggcgcg

SEQ ID NO: 35769 - RNA, 20 nt, Artificial Sequence
  Synthetic
gggaagaggaaggagaaagg

SEQ ID NO: 35770 - RNA, 20 nt, Artificial Sequence
  Synthetic
gcugaggcggcggggagagg

SEQ ID NO: 35771 - RNA, 20 nt, Artificial Sequence
  Synthetic
gacgggggggggggaaacgg

SEQ ID NO: 35772 - RNA, 20 nt, Artificial Sequence
  Synthetic
gugagcuucugcugaggcgg

SEQ ID NO: 35773 - RNA, 20 nt, Artificial Sequence
  Synthetic
ggaagaggaaggagaaaggg

SEQ ID NO: 35774 - RNA, 20 nt, Artificial Sequence
  Synthetic
ggagagggggggggggcggg

SEQ ID NO: 35775 - RNA, 20 nt, Artificial Sequence
  Synthetic
gaagaggaaggagaaagggg

SEQ ID NO: 35776 - RNA, 20 nt, Artificial Sequence
  Synthetic
gaggcggcggggagaggggg

SEQ ID NO: 35777 - RNA, 20 nt, Artificial Sequence
  Synthetic
gggggggggggaaacggggg

SEQ ID NO: 35778 - RNA, 20 nt, Artificial Sequence
  Synthetic
gaggaaggagaaaggggggg

SEQ ID NO: 35779 - RNA, 20 nt, Artificial Sequence
  Synthetic
ggcggcggggagaggggggg

SEQ ID NO: 35780 - RNA, 20 nt, Artificial Sequence
  Synthetic
gcggcggggagagggggggg

SEQ ID NO: 35781 - RNA, 20 nt, Artificial Sequence
  Synthetic
gggaacgacgacgggggggg

SEQ ID NO: 35782 - RNA, 20 nt, Artificial Sequence
  Synthetic
gcggggagaggggggggggg

SEQ ID NO: 35783 - RNA, 20 nt, Artificial Sequence
  Synthetic
gggugaccggcgcguggggg

SEQ ID NO: 35784 - RNA, 20 nt, Artificial Sequence
  Synthetic
gccuuugggguuguuggggg

SEQ ID NO: 35785 - RNA, 20 nt, Artificial Sequence
  Synthetic
gggggggaaacggggguggg

SEQ ID NO: 35786 - RNA, 20 nt, Artificial Sequence
  Synthetic
ggggggugaccggcgcgugg

SEQ ID NO: 35787 - RNA, 20 nt, Artificial Sequence
  Synthetic
gggcgcgggcgggggggugg

SEQ ID NO: 35788 - RNA, 20 nt, Artificial Sequence
  Synthetic
gagaagagagcagggguugg

SEQ ID NO: 35789 - RNA, 20 nt, Artificial Sequence
  Synthetic
guacaggugagcuucugcug

SEQ ID NO: 35790 - RNA, 20 nt, Artificial Sequence
  Synthetic
gggggggugaccggcgcgug

SEQ ID NO: 35791 - RNA, 20 nt, Artificial Sequence
  Synthetic
ggguuggcucgcgggcggug

SEQ ID NO: 35792 - RNA, 20 nt, Artificial Sequence
  Synthetic
gcgugcccggccacagccgu

SEQ ID NO: 35793 - RNA, 20 nt, Artificial Sequence
  Synthetic
gaccggcgcgugggggcggu

SEQ ID NO: 35794 - RNA, 20 nt, Artificial Sequence
  Synthetic
ggggggggggaaacgggggu

SEQ ID NO: 35795 - RNA, 20 nt, Artificial Sequence
  Synthetic
gagagaagagagcagggguu

SEQ ID NO: 35796 - RNA, 17 nt, Artificial Sequence
  Synthetic
aaaacaccuagaaaaaa

SEQ ID NO: 35797 - RNA, 17 nt, Artificial Sequence
  Synthetic
ccucguguuucuugaaa

SEQ ID NO: 35798 - RNA, 17 nt, Artificial Sequence
  Synthetic
ccccccaacaaccccaa

SEQ ID NO: 35799 - RNA, 17 nt, Artificial Sequence
  Synthetic
aggcgggggucccagaa

SEQ ID NO: 35800 - RNA, 17 nt, Artificial Sequence
  Synthetic
cccacgcgguagaggaa

SEQ ID NO: 35801 - RNA, 17 nt, Artificial Sequence
  Synthetic
aacggggguggguggaa

SEQ ID NO: 35802 - RNA, 17 nt, Artificial Sequence
  Synthetic
cugaggcggcggggaga

SEQ ID NO: 35803 - RNA, 17 nt, Artificial Sequence
  Synthetic
aaacgggggugggugga

SEQ ID NO: 35804 - RNA, 17 nt, Artificial Sequence
  Synthetic
ccuagaaaaaaaggaua

SEQ ID NO: 35805 - RNA, 17 nt, Artificial Sequence
  Synthetic
ugggggcggugggcgua

SEQ ID NO: 35806 - RNA, 17 nt, Artificial Sequence
  Synthetic
acgggggggggggaaac

SEQ ID NO: 35807 - RNA, 17 nt, Artificial Sequence
  Synthetic
cgguagaggaaggggac

SEQ ID NO: 35808 - RNA, 17 nt, Artificial Sequence
  Synthetic
uguugggggggggugac

SEQ ID NO: 35809 - RNA, 17 nt, Artificial Sequence
  Synthetic
cuagaaaaaaaggauac

SEQ ID NO: 35810 - RNA, 17 nt, Artificial Sequence
  Synthetic
cccgcgccugccccccc

SEQ ID NO: 35811 - RNA, 17 nt, Artificial Sequence
  Synthetic
acccgcgccugcccccc

SEQ ID NO: 35812 - RNA, 17 nt, Artificial Sequence
  Synthetic
cacccacggcuguggcc

SEQ ID NO: 35813 - RNA, 17 nt, Artificial Sequence
  Synthetic
ccaccgcccccacgcgc

SEQ ID NO: 35814 - RNA, 17 nt, Artificial Sequence
  Synthetic
cccgggggggcaggcgc

SEQ ID NO: 35815 - RNA, 17 nt, Artificial Sequence
  Synthetic
ucccagaaagggcaggc

SEQ ID NO: 35816 - RNA, 17 nt, Artificial Sequence
  Synthetic
uucaagaaacacgaggc

SEQ ID NO: 35817 - RNA, 17 nt, Artificial Sequence
  Synthetic
acacccacggcuguggc

SEQ ID NO: 35818 - RNA, 17 nt, Artificial Sequence
  Synthetic
cucguguuucuugaaag

SEQ ID NO: 35819 - RNA, 17 nt, Artificial Sequence
  Synthetic
ccacgcgguagaggaag

SEQ ID NO: 35820 - RNA, 17 nt, Artificial Sequence
  Synthetic
aagagagaagagagcag

SEQ ID NO: 35821 - RNA, 17 nt, Artificial Sequence
  Synthetic
ugaggcggcggggagag

SEQ ID NO: 35822 - RNA, 17 nt, Artificial Sequence
  Synthetic
ccgcgcccacgcgguag

SEQ ID NO: 35823 - RNA, 17 nt, Artificial Sequence
  Synthetic
cggggggguggugguag

SEQ ID NO: 35824 - RNA, 17 nt, Artificial Sequence
  Synthetic
cgggggggggggaaacg

SEQ ID NO: 35825 - RNA, 17 nt, Artificial Sequence
  Synthetic
cccuuucaagaaacacg

SEQ ID NO: 35826 - RNA, 17 nt, Artificial Sequence
  Synthetic
ccccgcccgcgcccacg

SEQ ID NO: 35827 - RNA, 17 nt, Artificial Sequence
  Synthetic
ucccgggggggcaggcg

SEQ ID NO: 35828 - RNA, 17 nt, Artificial Sequence
  Synthetic
cuucugcugaggcggcg

SEQ ID NO: 35829 - RNA, 17 nt, Artificial Sequence
  Synthetic
ccgcgugggcgcgggcg

SEQ ID NO: 35830 - RNA, 17 nt, Artificial Sequence
  Synthetic
ccucuaccgcgugggcg

SEQ ID NO: 35831 - RNA, 17 nt, Artificial Sequence
  Synthetic
uuuuguuauuauuuucg

SEQ ID NO: 35832 - RNA, 17 nt, Artificial Sequence
  Synthetic
aagaggaaggagaaagg

SEQ ID NO: 35833 - RNA, 17 nt, Artificial Sequence
  Synthetic
ucguguuucuugaaagg

SEQ ID NO: 35834 - RNA, 17 nt, Artificial Sequence
  Synthetic
uuucaagaaacacgagg

SEQ ID NO: 35835 - RNA, 17 nt, Artificial Sequence
  Synthetic
caagaaacacgaggcgg

SEQ ID NO: 35836 - RNA, 17 nt, Artificial Sequence
  Synthetic
agcuucugcugaggcgg

SEQ ID NO: 35837 - RNA, 17 nt, Artificial Sequence
  Synthetic
cgcgugggcgcgggcgg

SEQ ID NO: 35838 - RNA, 17 nt, Artificial Sequence
  Synthetic
ccggcgcgugggggcgg

SEQ ID NO: 35839 - RNA, 17 nt, Artificial Sequence
  Synthetic
agaggaaggagaaaggg

SEQ ID NO: 35840 - RNA, 17 nt, Artificial Sequence
  Synthetic
aggcggcggggagaggg

SEQ ID NO: 35841 - RNA, 17 nt, Artificial Sequence
  Synthetic
ccgucgucguucccggg

SEQ ID NO: 35842 - RNA, 17 nt, Artificial Sequence
  Synthetic
uaccgcgugggcgcggg

SEQ ID NO: 35843 - RNA, 17 nt, Artificial Sequence
  Synthetic
cgugggcgcgggcgggg

SEQ ID NO: 35844 - RNA, 17 nt, Artificial Sequence
  Synthetic
uguuucuugaaaggggg

SEQ ID NO: 35845 - RNA, 17 nt, Artificial Sequence
  Synthetic
cggcggggagagggggg

SEQ ID NO: 35846 - RNA, 17 nt, Artificial Sequence
  Synthetic
uugggguuguugggggg

SEQ ID NO: 35847 - RNA, 17 nt, Artificial Sequence
  Synthetic
uuugggguuguuggggg

SEQ ID NO: 35848 - RNA, 17 nt, Artificial Sequence
  Synthetic
cuuugggguuguugggg

SEQ ID NO: 35849 - RNA, 17 nt, Artificial Sequence
  Synthetic
ccuuugggguuguuggg

SEQ ID NO: 35850 - RNA, 17 nt, Artificial Sequence
  Synthetic
cgcgggcgggggggugg

SEQ ID NO: 35851 - RNA, 17 nt, Artificial Sequence
  Synthetic
aagagagcagggguugg

SEQ ID NO: 35852 - RNA, 17 nt, Artificial Sequence
  Synthetic
caggugagcuucugcug

SEQ ID NO: 35853 - RNA, 17 nt, Artificial Sequence
  Synthetic
cgccuuugggguuguug

SEQ ID NO: 35854 - RNA, 17 nt, Artificial Sequence
  Synthetic
accugccugcccuuucu

SEQ ID NO: 35855 - RNA, 17 nt, Artificial Sequence
  Synthetic
ccguauccuuuuuuucu

SEQ ID NO: 35856 - RNA, 17 nt, Artificial Sequence
  Synthetic
ugcccggccacagccgu

SEQ ID NO: 35857 - RNA, 17 nt, Artificial Sequence
  Synthetic
cggcgcgugggggcggu

SEQ ID NO: 35858 - RNA, 17 nt, Artificial Sequence
  Synthetic
aaaaaaaggauacgggu

SEQ ID NO: 35859 - RNA, 17 nt, Artificial Sequence
  Synthetic
agaagagagcagggguu

SEQ ID NO: 35860 - RNA, 20 nt, Artificial Sequence
  Synthetic
acaaaaacaccuagaaaaaa

SEQ ID NO: 35861 - RNA, 20 nt, Artificial Sequence
  Synthetic
aagggaagaggaaggagaaa

SEQ ID NO: 35862 - RNA, 20 nt, Artificial Sequence
  Synthetic
ccgccucguguuucuugaaa

SEQ ID NO: 35863 - RNA, 20 nt, Artificial Sequence
  Synthetic
cccccccccaacaaccccaa

SEQ ID NO: 35864 - RNA, 20 nt, Artificial Sequence
  Synthetic
cccgccucguguuucuugaa

SEQ ID NO: 35865 - RNA, 20 nt, Artificial Sequence
  Synthetic
cugcugaggcggcggggaga

SEQ ID NO: 35866 - RNA, 20 nt, Artificial Sequence
  Synthetic
cacgcgguagaggaagggga

SEQ ID NO: 35867 - RNA, 20 nt, Artificial Sequence
  Synthetic
acaccuagaaaaaaaggaua

SEQ ID NO: 35868 - RNA, 20 nt, Artificial Sequence
  Synthetic
caccuagaaaaaaaggauac

SEQ ID NO: 35869 - RNA, 20 nt, Artificial Sequence
  Synthetic
cgacccgcgccugccccccc

SEQ ID NO: 35870 - RNA, 20 nt, Artificial Sequence
  Synthetic
ccgacccgcgccugcccccc

SEQ ID NO: 35871 - RNA, 20 nt, Artificial Sequence
  Synthetic
ccacacccacggcuguggcc

SEQ ID NO: 35872 - RNA, 20 nt, Artificial Sequence
  Synthetic
cgcccaccgcccccacgcgc

SEQ ID NO: 35873 - RNA, 20 nt, Artificial Sequence
  Synthetic
ccuuucaagaaacacgaggc

SEQ ID NO: 35874 - RNA, 20 nt, Artificial Sequence
  Synthetic
ugagcuucugcugaggcggc

SEQ ID NO: 35875 - RNA, 20 nt, Artificial Sequence
  Synthetic
cggggagagggggggggggc

SEQ ID NO: 35876 - RNA, 20 nt, Artificial Sequence
  Synthetic
cgggggggcaggcgcggguc

SEQ ID NO: 35877 - RNA, 20 nt, Artificial Sequence
  Synthetic
agggaagaggaaggagaaag

SEQ ID NO: 35878 - RNA, 20 nt, Artificial Sequence
  Synthetic
cggaagagagaagagagcag

SEQ ID NO: 35879 - RNA, 20 nt, Artificial Sequence
  Synthetic
ugcugaggcggcggggagag

SEQ ID NO: 35880 - RNA, 20 nt, Artificial Sequence
  Synthetic
ucugcugaggcggcggggag

SEQ ID NO: 35881 - RNA, 20 nt, Artificial Sequence
  Synthetic
cgcccgcgcccacgcgguag

SEQ ID NO: 35882 - RNA, 20 nt, Artificial Sequence
  Synthetic
cgacgggggggggggaaacg

SEQ ID NO: 35883 - RNA, 20 nt, Artificial Sequence
  Synthetic
ucccccuuucaagaaacacg

SEQ ID NO: 35884 - RNA, 20 nt, Artificial Sequence
  Synthetic
cccccccgcccgcgcccacg

SEQ ID NO: 35885 - RNA, 20 nt, Artificial Sequence
  Synthetic
cgcgugcccggccacagccg

SEQ ID NO: 35886 - RNA, 20 nt, Artificial Sequence
  Synthetic
cguucccgggggggcaggcg

SEQ ID NO: 35887 - RNA, 20 nt, Artificial Sequence
  Synthetic
aaaggauacggguuggcucg

SEQ ID NO: 35888 - RNA, 20 nt, Artificial Sequence
  Synthetic
uuguuuuguuauuauuuucg

SEQ ID NO: 35889 - RNA, 20 nt, Artificial Sequence
  Synthetic
caggugagcuucugcugagg

SEQ ID NO: 35890 - RNA, 20 nt, Artificial Sequence
  Synthetic
uuucaagaaacacgaggcgg

SEQ ID NO: 35891 - RNA, 20 nt, Artificial Sequence
  Synthetic
uaccgcgugggcgcgggcgg

SEQ ID NO: 35892 - RNA, 20 nt, Artificial Sequence
  Synthetic
cugaggcggcggggagaggg

SEQ ID NO: 35893 - RNA, 20 nt, Artificial Sequence
  Synthetic
accgcgugggcgcgggcggg

SEQ ID NO: 35894 - RNA, 20 nt, Artificial Sequence
  Synthetic
ugaggcggcggggagagggg

SEQ ID NO: 35895 - RNA, 20 nt, Artificial Sequence
  Synthetic
ccgcgugggcgcgggcgggg

SEQ ID NO: 35896 - RNA, 20 nt, Artificial Sequence
  Synthetic
ucguguuucuugaaaggggg

SEQ ID NO: 35897 - RNA, 20 nt, Artificial Sequence
  Synthetic
cccgggaacgacgacggggg

SEQ ID NO: 35898 - RNA, 20 nt, Artificial Sequence
  Synthetic
aggcggcggggagagggggg

SEQ ID NO: 35899 - RNA, 20 nt, Artificial Sequence
  Synthetic
cgggaacgacgacggggggg

SEQ ID NO: 35900 - RNA, 20 nt, Artificial Sequence
  Synthetic
cgugggcgcgggcggggggg

SEQ ID NO: 35901 - RNA, 20 nt, Artificial Sequence
  Synthetic
ccuuugggguuguugggggg

SEQ ID NO: 35902 - RNA, 20 nt, Artificial Sequence
  Synthetic
cgccuuugggguuguugggg

SEQ ID NO: 35903 - RNA, 20 nt, Artificial Sequence
  Synthetic
cggggggguggugguagugg

SEQ ID NO: 35904 - RNA, 20 nt, Artificial Sequence
  Synthetic
cccggccacagccgugggug

SEQ ID NO: 35905 - RNA, 20 nt, Artificial Sequence
  Synthetic
agagaagagagcagggguug

SEQ ID NO: 35906 - RNA, 20 nt, Artificial Sequence
  Synthetic
acgcgccuuugggguuguug

SEQ ID NO: 35907 - RNA, 20 nt, Artificial Sequence
  Synthetic
cugaccugccugcccuuucu

SEQ ID NO: 35908 - RNA, 20 nt, Artificial Sequence
  Synthetic
aacccguauccuuuuuuucu

SEQ ID NO: 35909 - RNA, 20 nt, Artificial Sequence
  Synthetic
uagaaaaaaaggauacgggu

SEQ ID NO: 35910 - RNA, 20 nt, Artificial Sequence
  Synthetic
ccgggggggcaggcgcgggu

SEQ ID NO: 35911 - RNA, 20 nt, Artificial Sequence
  Synthetic
agagagaagagagcaggggu

SEQ ID NO: 35912 - RNA, 17 nt, Artificial Sequence
  Synthetic
cgggggagcugcaucaa

SEQ ID NO: 35913 - RNA, 17 nt, Artificial Sequence
  Synthetic
cacccuggcugggagaa

SEQ ID NO: 35914 - RNA, 17 nt, Artificial Sequence
  Synthetic
ccggggccgcuagggaa

SEQ ID NO: 35915 - RNA, 17 nt, Artificial Sequence
  Synthetic
ccggggaugggggggaa

SEQ ID NO: 35916 - RNA, 17 nt, Artificial Sequence
  Synthetic
cacggcccaccacaaca

SEQ ID NO: 35917 - RNA, 17 nt, Artificial Sequence
  Synthetic
cccccucccugucaaca

SEQ ID NO: 35918 - RNA, 17 nt, Artificial Sequence
  Synthetic
uccucaaguuuucaaca

SEQ ID NO: 35919 - RNA, 17 nt, Artificial Sequence
  Synthetic
caccacaccacaccaca

SEQ ID NO: 35920 - RNA, 17 nt, Artificial Sequence
  Synthetic
gcccacccaccaagaca

SEQ ID NO: 35921 - RNA, 17 nt, Artificial Sequence
  Synthetic
ggggggggggacggaca

SEQ ID NO: 35922 - RNA, 17 nt, Artificial Sequence
  Synthetic
ccugcccguccuggaca

SEQ ID NO: 35923 - RNA, 17 nt, Artificial Sequence
  Synthetic
guguguccguguugaca

SEQ ID NO: 35924 - RNA, 17 nt, Artificial Sequence
  Synthetic
guccagcgcgcccacca

SEQ ID NO: 35925 - RNA, 17 nt, Artificial Sequence
  Synthetic
cccugcucccgagacca

SEQ ID NO: 35926 - RNA, 17 nt, Artificial Sequence
  Synthetic
aacaugcucuuugacca

SEQ ID NO: 35927 - RNA, 17 nt, Artificial Sequence
  Synthetic
ccugcccaccaccccca

SEQ ID NO: 35928 - RNA, 17 nt, Artificial Sequence
  Synthetic
ccaccggcgcgaagcca

SEQ ID NO: 35929 - RNA, 17 nt, Artificial Sequence
  Synthetic
cuccuuucucccagcca

SEQ ID NO: 35930 - RNA, 17 nt, Artificial Sequence
  Synthetic
gagucuccccgcagcca

SEQ ID NO: 35931 - RNA, 17 nt, Artificial Sequence
  Synthetic
guucacguaaggcgcca

SEQ ID NO: 35932 - RNA, 17 nt, Artificial Sequence
  Synthetic
gacgcccccgcgggcca

SEQ ID NO: 35933 - RNA, 17 nt, Artificial Sequence
  Synthetic
cgcgaagccaggggcca

SEQ ID NO: 35934 - RNA, 17 nt, Artificial Sequence
  Synthetic
ggcgcgcuggacuucca

SEQ ID NO: 35935 - RNA, 17 nt, Artificial Sequence
  Synthetic
ccguggucucgggagca

SEQ ID NO: 35936 - RNA, 17 nt, Artificial Sequence
  Synthetic
cgcgugcucggggagca

SEQ ID NO: 35937 - RNA, 17 nt, Artificial Sequence
  Synthetic
ugcagcucccccgcgca

SEQ ID NO: 35938 - RNA, 17 nt, Artificial Sequence
  Synthetic
gaggcgccucgggggca

SEQ ID NO: 35939 - RNA, 17 nt, Artificial Sequence
  Synthetic
cggggcgggggugggca

SEQ ID NO: 35940 - RNA, 17 nt, Artificial Sequence
  Synthetic
cgugaacaagacgguca

SEQ ID NO: 35941 - RNA, 17 nt, Artificial Sequence
  Synthetic
guggggggggggaaaga

SEQ ID NO: 35942 - RNA, 17 nt, Artificial Sequence
  Synthetic
gccuuacgugaacaaga

SEQ ID NO: 35943 - RNA, 17 nt, Artificial Sequence
  Synthetic
gguccucguggaccaga

SEQ ID NO: 35944 - RNA, 17 nt, Artificial Sequence
  Synthetic
ccguccccgggggcaga

SEQ ID NO: 35945 - RNA, 17 nt, Artificial Sequence
  Synthetic
gggaacuuugauagaga

SEQ ID NO: 35946 - RNA, 17 nt, Artificial Sequence
  Synthetic
cguccuggacauggaga

SEQ ID NO: 35947 - RNA, 17 nt, Artificial Sequence
  Synthetic
gagcccccucgccccga

SEQ ID NO: 35948 - RNA, 17 nt, Artificial Sequence
  Synthetic
cucggcuugcugcccga

SEQ ID NO: 35949 - RNA, 17 nt, Artificial Sequence
  Synthetic
agcagcgcgggggccga

SEQ ID NO: 35950 - RNA, 17 nt, Artificial Sequence
  Synthetic
gcucgagacccccgcga

SEQ ID NO: 35951 - RNA, 17 nt, Artificial Sequence
  Synthetic
gacucccaucggggcga

SEQ ID NO: 35952 - RNA, 17 nt, Artificial Sequence
  Synthetic
aaguggggcgggggcga

SEQ ID NO: 35953 - RNA, 17 nt, Artificial Sequence
  Synthetic
cgcagccaggguaagga

SEQ ID NO: 35954 - RNA, 17 nt, Artificial Sequence
  Synthetic
cgucuccauguccagga

SEQ ID NO: 35955 - RNA, 17 nt, Artificial Sequence
  Synthetic
ggugggaggaaggagga

SEQ ID NO: 35956 - RNA, 17 nt, Artificial Sequence
  Synthetic
ggaagggaggaggagga

SEQ ID NO: 35957 - RNA, 17 nt, Artificial Sequence
  Synthetic
ggcucggggagggagga

SEQ ID NO: 35958 - RNA, 17 nt, Artificial Sequence
  Synthetic
ggggacgggugggagga

SEQ ID NO: 35959 - RNA, 17 nt, Artificial Sequence
  Synthetic
cccagccagggugagga

SEQ ID NO: 35960 - RNA, 17 nt, Artificial Sequence
  Synthetic
aagacgcgccacgcgga

SEQ ID NO: 35961 - RNA, 17 nt, Artificial Sequence
  Synthetic
guccguguugacaggga

SEQ ID NO: 35962 - RNA, 17 nt, Artificial Sequence
  Synthetic
cccucugcccccgggga

SEQ ID NO: 35963 - RNA, 17 nt, Artificial Sequence
  Synthetic
cgcaggggggccgggga

SEQ ID NO: 35964 - RNA, 17 nt, Artificial Sequence
  Synthetic
ggcgccuggcucgggga

SEQ ID NO: 35965 - RNA, 17 nt, Artificial Sequence
  Synthetic
ggaguggggggggggga

SEQ ID NO: 35966 - RNA, 17 nt, Artificial Sequence
  Synthetic
gccggggauggggggga

SEQ ID NO: 35967 - RNA, 17 nt, Artificial Sequence
  Synthetic
ggugggcaggaguggga

SEQ ID NO: 35968 - RNA, 17 nt, Artificial Sequence
  Synthetic
uggagacgggccacaua

SEQ ID NO: 35969 - RNA, 17 nt, Artificial Sequence
  Synthetic
gggggccggggccgcua

SEQ ID NO: 35970 - RNA, 17 nt, Artificial Sequence
  Synthetic
gcgggccacggggagua

SEQ ID NO: 35971 - RNA, 17 nt, Artificial Sequence
  Synthetic
accgucuuguucacgua

SEQ ID NO: 35972 - RNA, 17 nt, Artificial Sequence
  Synthetic
uccccgcagccagggua

SEQ ID NO: 35973 - RNA, 17 nt, Artificial Sequence
  Synthetic
acaccagcauuuuguua

SEQ ID NO: 35974 - RNA, 17 nt, Artificial Sequence
  Synthetic
cuaugauaaagaccaac

SEQ ID NO: 35975 - RNA, 17 nt, Artificial Sequence
  Synthetic
ggggucagccgcaccac

SEQ ID NO: 35976 - RNA, 17 nt, Artificial Sequence
  Synthetic
ccugcucccgagaccac

SEQ ID NO: 35977 - RNA, 17 nt, Artificial Sequence
  Synthetic
gccccccaccggaccac

SEQ ID NO: 35978 - RNA, 17 nt, Artificial Sequence
  Synthetic
aggaagccgccccccac

SEQ ID NO: 35979 - RNA, 17 nt, Artificial Sequence
  Synthetic
aagagcauguugcccac

SEQ ID NO: 35980 - RNA, 17 nt, Artificial Sequence
  Synthetic
acgcccccgcgggccac

SEQ ID NO: 35981 - RNA, 17 nt, Artificial Sequence
  Synthetic
ggggcgggggugggcac

SEQ ID NO: 35982 - RNA, 17 nt, Artificial Sequence
  Synthetic
gugaacaagacggucac

SEQ ID NO: 35983 - RNA, 17 nt, Artificial Sequence
  Synthetic
uggggggggggaaagac

SEQ ID NO: 35984 - RNA, 17 nt, Artificial Sequence
  Synthetic
cgcccacccaccaagac

SEQ ID NO: 35985 - RNA, 17 nt, Artificial Sequence
  Synthetic
guccucguggaccagac

SEQ ID NO: 35986 - RNA, 17 nt, Artificial Sequence
  Synthetic
aaagacggggaggagac

SEQ ID NO: 35987 - RNA, 17 nt, Artificial Sequence
  Synthetic
guccuggacauggagac

SEQ ID NO: 35988 - RNA, 17 nt, Artificial Sequence
  Synthetic
accacggguggcgcgac

SEQ ID NO: 35989 - RNA, 17 nt, Artificial Sequence
  Synthetic
gucuccauguccaggac

SEQ ID NO: 35990 - RNA, 17 nt, Artificial Sequence
  Synthetic
ccucugcccccggggac

SEQ ID NO: 35991 - RNA, 17 nt, Artificial Sequence
  Synthetic
aguguguccguguugac

SEQ ID NO: 35992 - RNA, 17 nt, Artificial Sequence
  Synthetic
aguccagcgcgcccacc

SEQ ID NO: 35993 - RNA, 17 nt, Artificial Sequence
  Synthetic
agagcauguugcccacc

SEQ ID NO: 35994 - RNA, 17 nt, Artificial Sequence
  Synthetic
gcccggggcccgcgacc

SEQ ID NO: 35995 - RNA, 17 nt, Artificial Sequence
  Synthetic
caacaugcucuuugacc

SEQ ID NO: 35996 - RNA, 17 nt, Artificial Sequence
  Synthetic
cuuugaccagggcaccc

SEQ ID NO: 35997 - RNA, 17 nt, Artificial Sequence
  Synthetic
cccgccccuccucaccc

SEQ ID NO: 35998 - RNA, 17 nt, Artificial Sequence
  Synthetic
ucuggccggccagaccc

SEQ ID NO: 35999 - RNA, 17 nt, Artificial Sequence
  Synthetic
cagccucuggaugaccc

SEQ ID NO: 36000 - RNA, 17 nt, Artificial Sequence
  Synthetic
cccgccccuccuuaccc

SEQ ID NO: 36001 - RNA, 17 nt, Artificial Sequence
  Synthetic
uccugcccaccaccccc

SEQ ID NO: 36002 - RNA, 17 nt, Artificial Sequence
  Synthetic
gcacgcccucugccccc

SEQ ID NO: 36003 - RNA, 17 nt, Artificial Sequence
  Synthetic
cuagcggccccggcccc

SEQ ID NO: 36004 - RNA, 17 nt, Artificial Sequence
  Synthetic
gccgggucgcgggcccc

SEQ ID NO: 36005 - RNA, 17 nt, Artificial Sequence
  Synthetic
caaaguucccuggcccc

SEQ ID NO: 36006 - RNA, 17 nt, Artificial Sequence
  Synthetic
ugcacgcccucugcccc

SEQ ID NO: 36007 - RNA, 17 nt, Artificial Sequence
  Synthetic
uccucccacccgucccc

SEQ ID NO: 36008 - RNA, 17 nt, Artificial Sequence
  Synthetic
agggcggccccgagccc

SEQ ID NO: 36009 - RNA, 17 nt, Artificial Sequence
  Synthetic
cgugcccacccccgccc

SEQ ID NO: 36010 - RNA, 17 nt, Artificial Sequence
  Synthetic
ccuuucccuagcggccc

SEQ ID NO: 36011 - RNA, 17 nt, Artificial Sequence
  Synthetic
agaacgaggccgggccc

SEQ ID NO: 36012 - RNA, 17 nt, Artificial Sequence
  Synthetic
cgccgggucgcgggccc

SEQ ID NO: 36013 - RNA, 17 nt, Artificial Sequence
  Synthetic
cucgagcgucguggccc

SEQ ID NO: 36014 - RNA, 17 nt, Artificial Sequence
  Synthetic
cgcccaccagggugccc

SEQ ID NO: 36015 - RNA, 17 nt, Artificial Sequence
  Synthetic
cccuucccccccauccc

SEQ ID NO: 36016 - RNA, 17 nt, Artificial Sequence
  Synthetic
uuccucccacccguccc

SEQ ID NO: 36017 - RNA, 17 nt, Artificial Sequence
  Synthetic
ucucuaucaaaguuccc

SEQ ID NO: 36018 - RNA, 17 nt, Artificial Sequence
  Synthetic
accaccggcgcgaagcc

SEQ ID NO: 36019 - RNA, 17 nt, Artificial Sequence
  Synthetic
ccuccuuucucccagcc

SEQ ID NO: 36020 - RNA, 17 nt, Artificial Sequence
  Synthetic
ggagucuccccgcagcc

SEQ ID NO: 36021 - RNA, 17 nt, Artificial Sequence
  Synthetic
uaucauagaacagagcc

SEQ ID NO: 36022 - RNA, 17 nt, Artificial Sequence
  Synthetic
gagggcggccccgagcc

SEQ ID NO: 36023 - RNA, 17 nt, Artificial Sequence
  Synthetic
uccucccuccccgagcc

SEQ ID NO: 36024 - RNA, 17 nt, Artificial Sequence
  Synthetic
uguucacguaaggcgcc

SEQ ID NO: 36025 - RNA, 17 nt, Artificial Sequence
  Synthetic
gcccgcgacccggcgcc

SEQ ID NO: 36026 - RNA, 17 nt, Artificial Sequence
  Synthetic
aggagugggagggcgcc

SEQ ID NO: 36027 - RNA, 17 nt, Artificial Sequence
  Synthetic
gcgugaggccgggcgcc

SEQ ID NO: 36028 - RNA, 17 nt, Artificial Sequence
  Synthetic
cgggcggggugggcgcc

SEQ ID NO: 36029 - RNA, 17 nt, Artificial Sequence
  Synthetic
ggagccagaacgaggcc

SEQ ID NO: 36030 - RNA, 17 nt, Artificial Sequence
  Synthetic
agguagcgcgugaggcc

SEQ ID NO: 36031 - RNA, 17 nt, Artificial Sequence
  Synthetic
gcgcgaagccaggggcc

SEQ ID NO: 36032 - RNA, 17 nt, Artificial Sequence
  Synthetic
agaacagagccggggcc

SEQ ID NO: 36033 - RNA, 17 nt, Artificial Sequence
  Synthetic
gaaacgggccgggggcc

SEQ ID NO: 36034 - RNA, 17 nt, Artificial Sequence
  Synthetic
ccccgcgcaggggggcc

SEQ ID NO: 36035 - RNA, 17 nt, Artificial Sequence
  Synthetic
ggccgaggaagugugcc

SEQ ID NO: 36036 - RNA, 17 nt, Artificial Sequence
  Synthetic
ggacugccugcccgucc

SEQ ID NO: 36037 - RNA, 17 nt, Artificial Sequence
  Synthetic
ggcccgucuccaugucc

SEQ ID NO: 36038 - RNA, 17 nt, Artificial Sequence
  Synthetic
cgcguggcgcgucuucc

SEQ ID NO: 36039 - RNA, 17 nt, Artificial Sequence
  Synthetic
gggccgcggcccgcagc

SEQ ID NO: 36040 - RNA, 17 nt, Artificial Sequence
  Synthetic
uuaucauagaacagagc

SEQ ID NO: 36041 - RNA, 17 nt, Artificial Sequence
  Synthetic
gagaaaggaggaggagc

SEQ ID NO: 36042 - RNA, 17 nt, Artificial Sequence
  Synthetic
cccguggucucgggagc

SEQ ID NO: 36043 - RNA, 17 nt, Artificial Sequence
  Synthetic
gcgcgugcucggggagc

SEQ ID NO: 36044 - RNA, 17 nt, Artificial Sequence
  Synthetic
gugcggcggcuccacgc

SEQ ID NO: 36045 - RNA, 17 nt, Artificial Sequence
  Synthetic
cuguuccacuccgacgc

SEQ ID NO: 36046 - RNA, 17 nt, Artificial Sequence
  Synthetic
gccggcgacgcccccgc

SEQ ID NO: 36047 - RNA, 17 nt, Artificial Sequence
  Synthetic
uacuccccguggcccgc

SEQ ID NO: 36048 - RNA, 17 nt, Artificial Sequence
  Synthetic
ccgcgcugcugcgccgc

SEQ ID NO: 36049 - RNA, 17 nt, Artificial Sequence
  Synthetic
ucgucucuccccagcgc

SEQ ID NO: 36050 - RNA, 17 nt, Artificial Sequence
  Synthetic
ccgcggcgcagcagcgc

SEQ ID NO: 36051 - RNA, 17 nt, Artificial Sequence
  Synthetic
augcagcucccccgcgc

SEQ ID NO: 36052 - RNA, 17 nt, Artificial Sequence
  Synthetic
gcagggcgcgcccgcgc

SEQ ID NO: 36053 - RNA, 17 nt, Artificial Sequence
  Synthetic
cacccuggugggcgcgc

SEQ ID NO: 36054 - RNA, 17 nt, Artificial Sequence
  Synthetic
ggccccuggcuucgcgc

SEQ ID NO: 36055 - RNA, 17 nt, Artificial Sequence
  Synthetic
gcgucgccggccggcgc

SEQ ID NO: 36056 - RNA, 17 nt, Artificial Sequence
  Synthetic
gcguccgcguccggcgc

SEQ ID NO: 36057 - RNA, 17 nt, Artificial Sequence
  Synthetic
cgcgugaggccgggcgc

SEQ ID NO: 36058 - RNA, 17 nt, Artificial Sequence
  Synthetic
gcgggcggggugggcgc

SEQ ID NO: 36059 - RNA, 17 nt, Artificial Sequence
  Synthetic
ccccggccccccugcgc

SEQ ID NO: 36060 - RNA, 17 nt, Artificial Sequence
  Synthetic
cgcuaccugcccaucgc

SEQ ID NO: 36061 - RNA, 17 nt, Artificial Sequence
  Synthetic
gcccgcgggggcgucgc

SEQ ID NO: 36062 - RNA, 17 nt, Artificial Sequence
  Synthetic
gccgggcgccgggucgc

SEQ ID NO: 36063 - RNA, 17 nt, Artificial Sequence
  Synthetic
gggagccagaacgaggc

SEQ ID NO: 36064 - RNA, 17 nt, Artificial Sequence
  Synthetic
cagguagcgcgugaggc

SEQ ID NO: 36065 - RNA, 17 nt, Artificial Sequence
  Synthetic
ggcgcgcccgcgccggc

SEQ ID NO: 36066 - RNA, 17 nt, Artificial Sequence
  Synthetic
gcgggggcgucgccggc

SEQ ID NO: 36067 - RNA, 17 nt, Artificial Sequence
  Synthetic
ccccgaggcgccucggc

SEQ ID NO: 36068 - RNA, 17 nt, Artificial Sequence
  Synthetic
ccauguccaggacgggc

SEQ ID NO: 36069 - RNA, 17 nt, Artificial Sequence
  Synthetic
uuggugggugggcgggc

SEQ ID NO: 36070 - RNA, 17 nt, Artificial Sequence
  Synthetic
gggcgggcguggcgggc

SEQ ID NO: 36071 - RNA, 17 nt, Artificial Sequence
  Synthetic
ccucuuccucugcgggc

SEQ ID NO: 36072 - RNA, 17 nt, Artificial Sequence
  Synthetic
cgggcaggugugcgggc

SEQ ID NO: 36073 - RNA, 17 nt, Artificial Sequence
  Synthetic
ccaggguaaggaggggc

SEQ ID NO: 36074 - RNA, 17 nt, Artificial Sequence
  Synthetic
ccagggugaggaggggc

SEQ ID NO: 36075 - RNA, 17 nt, Artificial Sequence
  Synthetic
ggggugggcgccggggc

SEQ ID NO: 36076 - RNA, 17 nt, Artificial Sequence
  Synthetic
uccucugcgggcggggc

SEQ ID NO: 36077 - RNA, 17 nt, Artificial Sequence
  Synthetic
ggaaacgggccgggggc

SEQ ID NO: 36078 - RNA, 17 nt, Artificial Sequence
  Synthetic
cgaggcgccucgggggc

SEQ ID NO: 36079 - RNA, 17 nt, Artificial Sequence
  Synthetic
cccccgcgcaggggggc

SEQ ID NO: 36080 - RNA, 17 nt, Artificial Sequence
  Synthetic
ggaggaggagggggggc

SEQ ID NO: 36081 - RNA, 17 nt, Artificial Sequence
  Synthetic
aggggggaaaguggggc

SEQ ID NO: 36082 - RNA, 17 nt, Artificial Sequence
  Synthetic
agacccccgcgaugggc

SEQ ID NO: 36083 - RNA, 17 nt, Artificial Sequence
  Synthetic
ugucuuggugggugggc

SEQ ID NO: 36084 - RNA, 17 nt, Artificial Sequence
  Synthetic
cccuggggguggugggc

SEQ ID NO: 36085 - RNA, 17 nt, Artificial Sequence
  Synthetic
ccccuccucacccuggc

SEQ ID NO: 36086 - RNA, 17 nt, Artificial Sequence
  Synthetic
ugggugggcgggcuggc

SEQ ID NO: 36087 - RNA, 17 nt, Artificial Sequence
  Synthetic
ugggcgggcuggcuggc

SEQ ID NO: 36088 - RNA, 17 nt, Artificial Sequence
  Synthetic
gagcacgcacgucuggc

SEQ ID NO: 36089 - RNA, 17 nt, Artificial Sequence
  Synthetic
cacccccagggucuggc

SEQ ID NO: 36090 - RNA, 17 nt, Artificial Sequence
  Synthetic
ggaggggcgggcguggc

SEQ ID NO: 36091 - RNA, 17 nt, Artificial Sequence
  Synthetic
aguccauaacaaaaugc

SEQ ID NO: 36092 - RNA, 17 nt, Artificial Sequence
  Synthetic
cuccuuacccuggcugc

SEQ ID NO: 36093 - RNA, 17 nt, Artificial Sequence
  Synthetic
cguggcggaccugcugc

SEQ ID NO: 36094 - RNA, 17 nt, Artificial Sequence
  Synthetic
uccgccucuuccucugc

SEQ ID NO: 36095 - RNA, 17 nt, Artificial Sequence
  Synthetic
ggcacgggcguaagugc

SEQ ID NO: 36096 - RNA, 17 nt, Artificial Sequence
  Synthetic
guggcgggcaggugugc

SEQ ID NO: 36097 - RNA, 17 nt, Artificial Sequence
  Synthetic
gacacgacgcguuuugc

SEQ ID NO: 36098 - RNA, 17 nt, Artificial Sequence
  Synthetic
gcggggagacucccauc

SEQ ID NO: 36099 - RNA, 17 nt, Artificial Sequence
  Synthetic
gcgugcucugcacgauc

SEQ ID NO: 36100 - RNA, 17 nt, Artificial Sequence
  Synthetic
cggaguggaacagccuc

SEQ ID NO: 36101 - RNA, 17 nt, Artificial Sequence
  Synthetic
accggccgaggcgccuc

SEQ ID NO: 36102 - RNA, 17 nt, Artificial Sequence
  Synthetic
aaagaccaacaggccuc

SEQ ID NO: 36103 - RNA, 17 nt, Artificial Sequence
  Synthetic
uggacuuccacggccuc

SEQ ID NO: 36104 - RNA, 17 nt, Artificial Sequence
  Synthetic
gugcgggugcaugccuc

SEQ ID NO: 36105 - RNA, 17 nt, Artificial Sequence
  Synthetic
gugcgguugcaugccuc

SEQ ID NO: 36106 - RNA, 17 nt, Artificial Sequence
  Synthetic
ucgcgggccccgggcuc

SEQ ID NO: 36107 - RNA, 17 nt, Artificial Sequence
  Synthetic
gggagggcgccuggcuc

SEQ ID NO: 36108 - RNA, 17 nt, Artificial Sequence
  Synthetic
caguugcgcgcgugcuc

SEQ ID NO: 36109 - RNA, 17 nt, Artificial Sequence
  Synthetic
gcgccacccguggucuc

SEQ ID NO: 36110 - RNA, 17 nt, Artificial Sequence
  Synthetic
gggggcgucggguaguc

SEQ ID NO: 36111 - RNA, 17 nt, Artificial Sequence
  Synthetic
ugcagagcacgcacguc

SEQ ID NO: 36112 - RNA, 17 nt, Artificial Sequence
  Synthetic
ccgccacguuccccguc

SEQ ID NO: 36113 - RNA, 17 nt, Artificial Sequence
  Synthetic
agcgucgcguccgcguc

SEQ ID NO: 36114 - RNA, 17 nt, Artificial Sequence
  Synthetic
ccgacgcggggggcguc

SEQ ID NO: 36115 - RNA, 17 nt, Artificial Sequence
  Synthetic
ccaccacccccaggguc

SEQ ID NO: 36116 - RNA, 17 nt, Artificial Sequence
  Synthetic
cgccucggccggugguc

SEQ ID NO: 36117 - RNA, 17 nt, Artificial Sequence
  Synthetic
ggggggcggcuuccuuc

SEQ ID NO: 36118 - RNA, 17 nt, Artificial Sequence
  Synthetic
ggggcccggccucguuc

SEQ ID NO: 36119 - RNA, 17 nt, Artificial Sequence
  Synthetic
gguguguguugcuguuc

SEQ ID NO: 36120 - RNA, 17 nt, Artificial Sequence
  Synthetic
uuuuguuauggacuuuc

SEQ ID NO: 36121 - RNA, 17 nt, Artificial Sequence
  Synthetic
auagagaggggggaaag

SEQ ID NO: 36122 - RNA, 17 nt, Artificial Sequence
  Synthetic
ggggaggagacaggaag

SEQ ID NO: 36123 - RNA, 17 nt, Artificial Sequence
  Synthetic
ggaggaggagcaggaag

SEQ ID NO: 36124 - RNA, 17 nt, Artificial Sequence
  Synthetic
cccgcccgcagaggaag

SEQ ID NO: 36125 - RNA, 17 nt, Artificial Sequence
  Synthetic
caccggcgcgaagccag

SEQ ID NO: 36126 - RNA, 17 nt, Artificial Sequence
  Synthetic
ccaccggggucauccag

SEQ ID NO: 36127 - RNA, 17 nt, Artificial Sequence
  Synthetic
accagccccgcccgcag

SEQ ID NO: 36128 - RNA, 17 nt, Artificial Sequence
  Synthetic
gcagcucccccgcgcag

SEQ ID NO: 36129 - RNA, 17 nt, Artificial Sequence
  Synthetic
cccguccccgggggcag

SEQ ID NO: 36130 - RNA, 17 nt, Artificial Sequence
  Synthetic
aggcgccucgggggcag

SEQ ID NO: 36131 - RNA, 17 nt, Artificial Sequence
  Synthetic
ggaacuuugauagagag

SEQ ID NO: 36132 - RNA, 17 nt, Artificial Sequence
  Synthetic
agggaacuuugauagag

SEQ ID NO: 36133 - RNA, 17 nt, Artificial Sequence
  Synthetic
acucccaucggggcgag

SEQ ID NO: 36134 - RNA, 17 nt, Artificial Sequence
  Synthetic
gcagccaggguaaggag

SEQ ID NO: 36135 - RNA, 17 nt, Artificial Sequence
  Synthetic
gggguggugggcaggag

SEQ ID NO: 36136 - RNA, 17 nt, Artificial Sequence
  Synthetic
gaagggaggaggaggag

SEQ ID NO: 36137 - RNA, 17 nt, Artificial Sequence
  Synthetic
gcucggggagggaggag

SEQ ID NO: 36138 - RNA, 17 nt, Artificial Sequence
  Synthetic
ccagccagggugaggag

SEQ ID NO: 36139 - RNA, 17 nt, Artificial Sequence
  Synthetic
cgccccccgcgucggag

SEQ ID NO: 36140 - RNA, 17 nt, Artificial Sequence
  Synthetic
uccguguugacagggag

SEQ ID NO: 36141 - RNA, 17 nt, Artificial Sequence
  Synthetic
ggaagugggggugggag

SEQ ID NO: 36142 - RNA, 17 nt, Artificial Sequence
  Synthetic
ggagacgggccacauag

SEQ ID NO: 36143 - RNA, 17 nt, Artificial Sequence
  Synthetic
ugccuaccuuucccuag

SEQ ID NO: 36144 - RNA, 17 nt, Artificial Sequence
  Synthetic
cgggccacggggaguag

SEQ ID NO: 36145 - RNA, 17 nt, Artificial Sequence
  Synthetic
gacagggagccagaacg

SEQ ID NO: 36146 - RNA, 17 nt, Artificial Sequence
  Synthetic
ggaccagacggggaacg

SEQ ID NO: 36147 - RNA, 17 nt, Artificial Sequence
  Synthetic
caggaagacgcgccacg

SEQ ID NO: 36148 - RNA, 17 nt, Artificial Sequence
  Synthetic
cgcccccgcgggccacg

SEQ ID NO: 36149 - RNA, 17 nt, Artificial Sequence
  Synthetic
ggugcggcggcuccacg

SEQ ID NO: 36150 - RNA, 17 nt, Artificial Sequence
  Synthetic
uccccgucugguccacg

SEQ ID NO: 36151 - RNA, 17 nt, Artificial Sequence
  Synthetic
ugaacaagacggucacg

SEQ ID NO: 36152 - RNA, 17 nt, Artificial Sequence
  Synthetic
ggggggggggaaagacg

SEQ ID NO: 36153 - RNA, 17 nt, Artificial Sequence
  Synthetic
uccucguggaccagacg

SEQ ID NO: 36154 - RNA, 17 nt, Artificial Sequence
  Synthetic
gcuguuccacuccgacg

SEQ ID NO: 36155 - RNA, 17 nt, Artificial Sequence
  Synthetic
cuccccagcgccggacg

SEQ ID NO: 36156 - RNA, 17 nt, Artificial Sequence
  Synthetic
ccacauaggggccuacg

SEQ ID NO: 36157 - RNA, 17 nt, Artificial Sequence
  Synthetic
gagcauguugcccaccg

SEQ ID NO: 36158 - RNA, 17 nt, Artificial Sequence
  Synthetic
uccggucgcgccacccg

SEQ ID NO: 36159 - RNA, 17 nt, Artificial Sequence
  Synthetic
ggagaagagaagacccg

SEQ ID NO: 36160 - RNA, 17 nt, Artificial Sequence
  Synthetic
caggaagaggagacccg

SEQ ID NO: 36161 - RNA, 17 nt, Artificial Sequence
  Synthetic
agccgcccccacccccg

SEQ ID NO: 36162 - RNA, 17 nt, Artificial Sequence
  Synthetic
ggccggcgacgcccccg

SEQ ID NO: 36163 - RNA, 17 nt, Artificial Sequence
  Synthetic
cacuuccucggcccccg

SEQ ID NO: 36164 - RNA, 17 nt, Artificial Sequence
  Synthetic
accucccccugcccccg

SEQ ID NO: 36165 - RNA, 17 nt, Artificial Sequence
  Synthetic
cacgcccucugcccccg

SEQ ID NO: 36166 - RNA, 17 nt, Artificial Sequence
  Synthetic
gcucccccuacuccccg

SEQ ID NO: 36167 - RNA, 17 nt, Artificial Sequence
  Synthetic
ccucccacccguccccg

SEQ ID NO: 36168 - RNA, 17 nt, Artificial Sequence
  Synthetic
gggcggccccgagcccg

SEQ ID NO: 36169 - RNA, 17 nt, Artificial Sequence
  Synthetic
cuacuccccguggcccg

SEQ ID NO: 36170 - RNA, 17 nt, Artificial Sequence
  Synthetic
aucauagaacagagccg

SEQ ID NO: 36171 - RNA, 17 nt, Artificial Sequence
  Synthetic
gggcggggugggcgccg

SEQ ID NO: 36172 - RNA, 17 nt, Artificial Sequence
  Synthetic
cccgcgcugcugcgccg

SEQ ID NO: 36173 - RNA, 17 nt, Artificial Sequence
  Synthetic
ggcgcgaccggaggccg

SEQ ID NO: 36174 - RNA, 17 nt, Artificial Sequence
  Synthetic
caccggaccaccggccg

SEQ ID NO: 36175 - RNA, 17 nt, Artificial Sequence
  Synthetic
cggaaggaaacgggccg

SEQ ID NO: 36176 - RNA, 17 nt, Artificial Sequence
  Synthetic
ggaccugcugcgggccg

SEQ ID NO: 36177 - RNA, 17 nt, Artificial Sequence
  Synthetic
aaacgggccgggggccg

SEQ ID NO: 36178 - RNA, 17 nt, Artificial Sequence
  Synthetic
gcuccacgcgggggccg

SEQ ID NO: 36179 - RNA, 17 nt, Artificial Sequence
  Synthetic
cugcgccgcgggggccg

SEQ ID NO: 36180 - RNA, 17 nt, Artificial Sequence
  Synthetic
cagcagcgcgggggccg

SEQ ID NO: 36181 - RNA, 17 nt, Artificial Sequence
  Synthetic
cccgcgcaggggggccg

SEQ ID NO: 36182 - RNA, 17 nt, Artificial Sequence
  Synthetic
cccgcggcgcagcagcg

SEQ ID NO: 36183 - RNA, 17 nt, Artificial Sequence
  Synthetic
ugcggcggcuccacgcg

SEQ ID NO: 36184 - RNA, 17 nt, Artificial Sequence
  Synthetic
uguuccacuccgacgcg

SEQ ID NO: 36185 - RNA, 17 nt, Artificial Sequence
  Synthetic
gggccgcggcccccgcg

SEQ ID NO: 36186 - RNA, 17 nt, Artificial Sequence
  Synthetic
acuccccguggcccgcg

SEQ ID NO: 36187 - RNA, 17 nt, Artificial Sequence
  Synthetic
cgcgcugcugcgccgcg

SEQ ID NO: 36188 - RNA, 17 nt, Artificial Sequence
  Synthetic
cggggccgcccuccgcg

SEQ ID NO: 36189 - RNA, 17 nt, Artificial Sequence
  Synthetic
cgcggcgcagcagcgcg

SEQ ID NO: 36190 - RNA, 17 nt, Artificial Sequence
  Synthetic
aaagguaggcacgcgcg

SEQ ID NO: 36191 - RNA, 17 nt, Artificial Sequence
  Synthetic
cccggccccccugcgcg

SEQ ID NO: 36192 - RNA, 17 nt, Artificial Sequence
  Synthetic
gcuaccugcccaucgcg

SEQ ID NO: 36193 - RNA, 17 nt, Artificial Sequence
  Synthetic
ggcgucgccggccggcg

SEQ ID NO: 36194 - RNA, 17 nt, Artificial Sequence
  Synthetic
guaaggaggggcgggcg

SEQ ID NO: 36195 - RNA, 17 nt, Artificial Sequence
  Synthetic
gugaggaggggcgggcg

SEQ ID NO: 36196 - RNA, 17 nt, Artificial Sequence
  Synthetic
cucuuccucugcgggcg

SEQ ID NO: 36197 - RNA, 17 nt, Artificial Sequence
  Synthetic
gggcaggugugcgggcg

SEQ ID NO: 36198 - RNA, 17 nt, Artificial Sequence
  Synthetic
gggugggcgccggggcg

SEQ ID NO: 36199 - RNA, 17 nt, Artificial Sequence
  Synthetic
agacucccaucggggcg

SEQ ID NO: 36200 - RNA, 17 nt, Artificial Sequence
  Synthetic
aaaguggggcgggggcg

SEQ ID NO: 36201 - RNA, 17 nt, Artificial Sequence
  Synthetic
ggggggaaaguggggcg

SEQ ID NO: 36202 - RNA, 17 nt, Artificial Sequence
  Synthetic
uccccggccccccugcg

SEQ ID NO: 36203 - RNA, 17 nt, Artificial Sequence
  Synthetic
uccuuacccuggcugcg

SEQ ID NO: 36204 - RNA, 17 nt, Artificial Sequence
  Synthetic
acacgacgcguuuugcg

SEQ ID NO: 36205 - RNA, 17 nt, Artificial Sequence
  Synthetic
gcgcuaccugcccaucg

SEQ ID NO: 36206 - RNA, 17 nt, Artificial Sequence
  Synthetic
cggggagacucccaucg

SEQ ID NO: 36207 - RNA, 17 nt, Artificial Sequence
  Synthetic
ccggccgaggcgccucg

SEQ ID NO: 36208 - RNA, 17 nt, Artificial Sequence
  Synthetic
aagaccaacaggccucg

SEQ ID NO: 36209 - RNA, 17 nt, Artificial Sequence
  Synthetic
ggccuacgugguccucg

SEQ ID NO: 36210 - RNA, 17 nt, Artificial Sequence
  Synthetic
cgcgggccccgggcucg

SEQ ID NO: 36211 - RNA, 17 nt, Artificial Sequence
  Synthetic
ggagggcgccuggcucg

SEQ ID NO: 36212 - RNA, 17 nt, Artificial Sequence
  Synthetic
aguugcgcgcgugcucg

SEQ ID NO: 36213 - RNA, 17 nt, Artificial Sequence
  Synthetic
ggggcgucggguagucg

SEQ ID NO: 36214 - RNA, 17 nt, Artificial Sequence
  Synthetic
gggggucucgagcgucg

SEQ ID NO: 36215 - RNA, 17 nt, Artificial Sequence
  Synthetic
ggccgggcgccgggucg

SEQ ID NO: 36216 - RNA, 17 nt, Artificial Sequence
  Synthetic
cgugucguguugugucg

SEQ ID NO: 36217 - RNA, 17 nt, Artificial Sequence
  Synthetic
guguguguugcuguucg

SEQ ID NO: 36218 - RNA, 17 nt, Artificial Sequence
  Synthetic
ccuggcugggagaaagg

SEQ ID NO: 36219 - RNA, 17 nt, Artificial Sequence
  Synthetic
gacgggugggaggaagg

SEQ ID NO: 36220 - RNA, 17 nt, Artificial Sequence
  Synthetic
ccgcagccaggguaagg

SEQ ID NO: 36221 - RNA, 17 nt, Artificial Sequence
  Synthetic
cagcucccccgcgcagg

SEQ ID NO: 36222 - RNA, 17 nt, Artificial Sequence
  Synthetic
ggcgccucgggggcagg

SEQ ID NO: 36223 - RNA, 17 nt, Artificial Sequence
  Synthetic
gcccgcagaggaagagg

SEQ ID NO: 36224 - RNA, 17 nt, Artificial Sequence
  Synthetic
gaacuuugauagagagg

SEQ ID NO: 36225 - RNA, 17 nt, Artificial Sequence
  Synthetic
cucccaucggggcgagg

SEQ ID NO: 36226 - RNA, 17 nt, Artificial Sequence
  Synthetic
ggcugggagaaaggagg

SEQ ID NO: 36227 - RNA, 17 nt, Artificial Sequence
  Synthetic
gggugggaggaaggagg

SEQ ID NO: 36228 - RNA, 17 nt, Artificial Sequence
  Synthetic
ggcggaggaggaggagg

SEQ ID NO: 36229 - RNA, 17 nt, Artificial Sequence
  Synthetic
aagggaggaggaggagg

SEQ ID NO: 36230 - RNA, 17 nt, Artificial Sequence
  Synthetic
agaggcggaggaggagg

SEQ ID NO: 36231 - RNA, 17 nt, Artificial Sequence
  Synthetic
ggaggcggaggaggagg

SEQ ID NO: 36232 - RNA, 17 nt, Artificial Sequence
  Synthetic
gggaagggaggaggagg

SEQ ID NO: 36233 - RNA, 17 nt, Artificial Sequence
  Synthetic
ggaagaggcggaggagg

SEQ ID NO: 36234 - RNA, 17 nt, Artificial Sequence
  Synthetic
ggaggaggcggaggagg

SEQ ID NO: 36235 - RNA, 17 nt, Artificial Sequence
  Synthetic
ggggggaagggaggagg

SEQ ID NO: 36236 - RNA, 17 nt, Artificial Sequence
  Synthetic
cucggggagggaggagg

SEQ ID NO: 36237 - RNA, 17 nt, Artificial Sequence
  Synthetic
agaggaagaggcggagg

SEQ ID NO: 36238 - RNA, 17 nt, Artificial Sequence
  Synthetic
ggaggaggaggcggagg

SEQ ID NO: 36239 - RNA, 17 nt, Artificial Sequence
  Synthetic
augggggggaagggagg

SEQ ID NO: 36240 - RNA, 17 nt, Artificial Sequence
  Synthetic
ccguguugacagggagg

SEQ ID NO: 36241 - RNA, 17 nt, Artificial Sequence
  Synthetic
uggcucggggagggagg

SEQ ID NO: 36242 - RNA, 17 nt, Artificial Sequence
  Synthetic
ucgggggcagggggagg

SEQ ID NO: 36243 - RNA, 17 nt, Artificial Sequence
  Synthetic
ucccagccagggugagg

SEQ ID NO: 36244 - RNA, 17 nt, Artificial Sequence
  Synthetic
gggccacggggaguagg

SEQ ID NO: 36245 - RNA, 17 nt, Artificial Sequence
  Synthetic
gaacaagacggucacgg

SEQ ID NO: 36246 - RNA, 17 nt, Artificial Sequence
  Synthetic
acggguggcgcgaccgg

SEQ ID NO: 36247 - RNA, 17 nt, Artificial Sequence
  Synthetic
ccucuggaugaccccgg

SEQ ID NO: 36248 - RNA, 17 nt, Artificial Sequence
  Synthetic
cucccacccguccccgg

SEQ ID NO: 36249 - RNA, 17 nt, Artificial Sequence
  Synthetic
cccuggcuucgcgccgg

SEQ ID NO: 36250 - RNA, 17 nt, Artificial Sequence
  Synthetic
cgaggcgccucggccgg

SEQ ID NO: 36251 - RNA, 17 nt, Artificial Sequence
  Synthetic
ggaaggaaacgggccgg

SEQ ID NO: 36252 - RNA, 17 nt, Artificial Sequence
  Synthetic
cucggccggugguccgg

SEQ ID NO: 36253 - RNA, 17 nt, Artificial Sequence
  Synthetic
gaagacgcgccacgcgg

SEQ ID NO: 36254 - RNA, 17 nt, Artificial Sequence
  Synthetic
gcggcggcuccacgcgg

SEQ ID NO: 36255 - RNA, 17 nt, Artificial Sequence
  Synthetic
guuccacuccgacgcgg

SEQ ID NO: 36256 - RNA, 17 nt, Artificial Sequence
  Synthetic
cuccccguggcccgcgg

SEQ ID NO: 36257 - RNA, 17 nt, Artificial Sequence
  Synthetic
gcgcugcugcgccgcgg

SEQ ID NO: 36258 - RNA, 17 nt, Artificial Sequence
  Synthetic
gcggcgcagcagcgcgg

SEQ ID NO: 36259 - RNA, 17 nt, Artificial Sequence
  Synthetic
ccggccccccugcgcgg

SEQ ID NO: 36260 - RNA, 17 nt, Artificial Sequence
  Synthetic
cuaccugcccaucgcgg

SEQ ID NO: 36261 - RNA, 17 nt, Artificial Sequence
  Synthetic
cgcagaggaagaggcgg

SEQ ID NO: 36262 - RNA, 17 nt, Artificial Sequence
  Synthetic
ggaggaggaggaggcgg

SEQ ID NO: 36263 - RNA, 17 nt, Artificial Sequence
  Synthetic
ggugggcgccggggcgg

SEQ ID NO: 36264 - RNA, 17 nt, Artificial Sequence
  Synthetic
gggggaaaguggggcgg

SEQ ID NO: 36265 - RNA, 17 nt, Artificial Sequence
  Synthetic
cggggagcagggugcgg

SEQ ID NO: 36266 - RNA, 17 nt, Artificial Sequence
  Synthetic
cggccgaggcgccucgg

SEQ ID NO: 36267 - RNA, 17 nt, Artificial Sequence
  Synthetic
agaccaacaggccucgg

SEQ ID NO: 36268 - RNA, 17 nt, Artificial Sequence
  Synthetic
gggcgucggguagucgg

SEQ ID NO: 36269 - RNA, 17 nt, Artificial Sequence
  Synthetic
gggaugggggggaaggg

SEQ ID NO: 36270 - RNA, 17 nt, Artificial Sequence
  Synthetic
uguccguguugacaggg

SEQ ID NO: 36271 - RNA, 17 nt, Artificial Sequence
  Synthetic
agcucccccgcgcaggg

SEQ ID NO: 36272 - RNA, 17 nt, Artificial Sequence
  Synthetic
aacuuugauagagaggg

SEQ ID NO: 36273 - RNA, 17 nt, Artificial Sequence
  Synthetic
agcgcgggggccgaggg

SEQ ID NO: 36274 - RNA, 17 nt, Artificial Sequence
  Synthetic
uggggcgggggcgaggg

SEQ ID NO: 36275 - RNA, 17 nt, Artificial Sequence
  Synthetic
agggaggaggaggaggg

SEQ ID NO: 36276 - RNA, 17 nt, Artificial Sequence
  Synthetic
ucggggagggaggaggg

SEQ ID NO: 36277 - RNA, 17 nt, Artificial Sequence
  Synthetic
acgcgccacgcggaggg

SEQ ID NO: 36278 - RNA, 17 nt, Artificial Sequence
  Synthetic
cguguugacagggaggg

SEQ ID NO: 36279 - RNA, 17 nt, Artificial Sequence
  Synthetic
gccuggcucggggaggg

SEQ ID NO: 36280 - RNA, 17 nt, Artificial Sequence
  Synthetic
gcucccgagaccacggg

SEQ ID NO: 36281 - RNA, 17 nt, Artificial Sequence
  Synthetic
cugcccccggggacggg

SEQ ID NO: 36282 - RNA, 17 nt, Artificial Sequence
  Synthetic
uuccacuccgacgcggg

SEQ ID NO: 36283 - RNA, 17 nt, Artificial Sequence
  Synthetic
gccucuuccucugcggg

SEQ ID NO: 36284 - RNA, 17 nt, Artificial Sequence
  Synthetic
gcgggcaggugugcggg

SEQ ID NO: 36285 - RNA, 17 nt, Artificial Sequence
  Synthetic
ggcgucggguagucggg

SEQ ID NO: 36286 - RNA, 17 nt, Artificial Sequence
  Synthetic
gccaggguaaggagggg

SEQ ID NO: 36287 - RNA, 17 nt, Artificial Sequence
  Synthetic
gggaggaggaggagggg

SEQ ID NO: 36288 - RNA, 17 nt, Artificial Sequence
  Synthetic
cggggagggaggagggg

SEQ ID NO: 36289 - RNA, 17 nt, Artificial Sequence
  Synthetic
gccagggugaggagggg

SEQ ID NO: 36290 - RNA, 17 nt, Artificial Sequence
  Synthetic
gggggggaaagacgggg

SEQ ID NO: 36291 - RNA, 17 nt, Artificial Sequence
  Synthetic
cggggugggcgccgggg

SEQ ID NO: 36292 - RNA, 17 nt, Artificial Sequence
  Synthetic
caggugugcgggcgggg

SEQ ID NO: 36293 - RNA, 17 nt, Artificial Sequence
  Synthetic
gggcgccuggcucgggg

SEQ ID NO: 36294 - RNA, 17 nt, Artificial Sequence
  Synthetic
gccucgggggcaggggg

SEQ ID NO: 36295 - RNA, 17 nt, Artificial Sequence
  Synthetic
ggggagggaggaggggg

SEQ ID NO: 36296 - RNA, 17 nt, Artificial Sequence
  Synthetic
gggcgccggggcggggg

SEQ ID NO: 36297 - RNA, 17 nt, Artificial Sequence
  Synthetic
ccaacaggccucggggg

SEQ ID NO: 36298 - RNA, 17 nt, Artificial Sequence
  Synthetic
gggagggaggagggggg

SEQ ID NO: 36299 - RNA, 17 nt, Artificial Sequence
  Synthetic
aggaggaggaggggggg

SEQ ID NO: 36300 - RNA, 17 nt, Artificial Sequence
  Synthetic
ggugggagugggggggg

SEQ ID NO: 36301 - RNA, 17 nt, Artificial Sequence
  Synthetic
gggugggaguggggggg

SEQ ID NO: 36302 - RNA, 17 nt, Artificial Sequence
  Synthetic
agggggagguggggggg

SEQ ID NO: 36303 - RNA, 17 nt, Artificial Sequence
  Synthetic
ggggugggagugggggg

SEQ ID NO: 36304 - RNA, 17 nt, Artificial Sequence
  Synthetic
cagggggaggugggggg

SEQ ID NO: 36305 - RNA, 17 nt, Artificial Sequence
  Synthetic
ggugguccggugggggg

SEQ ID NO: 36306 - RNA, 17 nt, Artificial Sequence
  Synthetic
cggccagacccuggggg

SEQ ID NO: 36307 - RNA, 17 nt, Artificial Sequence
  Synthetic
gagacaggaaguggggg

SEQ ID NO: 36308 - RNA, 17 nt, Artificial Sequence
  Synthetic
gggggugggaguggggg

SEQ ID NO: 36309 - RNA, 17 nt, Artificial Sequence
  Synthetic
gcagggggagguggggg

SEQ ID NO: 36310 - RNA, 17 nt, Artificial Sequence
  Synthetic
ggccucggggguggggg

SEQ ID NO: 36311 - RNA, 17 nt, Artificial Sequence
  Synthetic
gggggccggggaugggg

SEQ ID NO: 36312 - RNA, 17 nt, Artificial Sequence
  Synthetic
gaggggggaaagugggg

SEQ ID NO: 36313 - RNA, 17 nt, Artificial Sequence
  Synthetic
ugggggugggagugggg

SEQ ID NO: 36314 - RNA, 17 nt, Artificial Sequence
  Synthetic
ggcagggggaggugggg

SEQ ID NO: 36315 - RNA, 17 nt, Artificial Sequence
  Synthetic
ggggggccggggauggg

SEQ ID NO: 36316 - RNA, 17 nt, Artificial Sequence
  Synthetic
uggugggcaggaguggg

SEQ ID NO: 36317 - RNA, 17 nt, Artificial Sequence
  Synthetic
gugggggugggaguggg

SEQ ID NO: 36318 - RNA, 17 nt, Artificial Sequence
  Synthetic
gggcagggggagguggg

SEQ ID NO: 36319 - RNA, 17 nt, Artificial Sequence
  Synthetic
gccggugguccgguggg

SEQ ID NO: 36320 - RNA, 17 nt, Artificial Sequence
  Synthetic
ccccggggacggguggg

SEQ ID NO: 36321 - RNA, 17 nt, Artificial Sequence
  Synthetic
cugucuugguggguggg

SEQ ID NO: 36322 - RNA, 17 nt, Artificial Sequence
  Synthetic
cucccugucuugguggg

SEQ ID NO: 36323 - RNA, 17 nt, Artificial Sequence
  Synthetic
aggggggccggggaugg

SEQ ID NO: 36324 - RNA, 17 nt, Artificial Sequence
  Synthetic
ugaccagggcacccugg

SEQ ID NO: 36325 - RNA, 17 nt, Artificial Sequence
  Synthetic
ggccggccagacccugg

SEQ ID NO: 36326 - RNA, 17 nt, Artificial Sequence
  Synthetic
ucugcgggcggggcugg

SEQ ID NO: 36327 - RNA, 17 nt, Artificial Sequence
  Synthetic
gugggcgggcuggcugg

SEQ ID NO: 36328 - RNA, 17 nt, Artificial Sequence
  Synthetic
gaggagacaggaagugg

SEQ ID NO: 36329 - RNA, 17 nt, Artificial Sequence
  Synthetic
agugggggugggagugg

SEQ ID NO: 36330 - RNA, 17 nt, Artificial Sequence
  Synthetic
ccagacggggaacgugg

SEQ ID NO: 36331 - RNA, 17 nt, Artificial Sequence
  Synthetic
aggaggggcgggcgugg

SEQ ID NO: 36332 - RNA, 17 nt, Artificial Sequence
  Synthetic
gucguguugugucgugg

SEQ ID NO: 36333 - RNA, 17 nt, Artificial Sequence
  Synthetic
ggggcagggggaggugg

SEQ ID NO: 36334 - RNA, 17 nt, Artificial Sequence
  Synthetic
ggccggugguccggugg

SEQ ID NO: 36335 - RNA, 17 nt, Artificial Sequence
  Synthetic
acaggccucgggggugg

SEQ ID NO: 36336 - RNA, 17 nt, Artificial Sequence
  Synthetic
ccagacccugggggugg

SEQ ID NO: 36337 - RNA, 17 nt, Artificial Sequence
  Synthetic
ggugggccguguugugg

SEQ ID NO: 36338 - RNA, 17 nt, Artificial Sequence
  Synthetic
cuggcucccugucuugg

SEQ ID NO: 36339 - RNA, 17 nt, Artificial Sequence
  Synthetic
caggggggccggggaug

SEQ ID NO: 36340 - RNA, 17 nt, Artificial Sequence
  Synthetic
ccacguaggccccuaug

SEQ ID NO: 36341 - RNA, 17 nt, Artificial Sequence
  Synthetic
uggccggccagacccug

SEQ ID NO: 36342 - RNA, 17 nt, Artificial Sequence
  Synthetic
guccgcguccggcgcug

SEQ ID NO: 36343 - RNA, 17 nt, Artificial Sequence
  Synthetic
ccuccuuacccuggcug

SEQ ID NO: 36344 - RNA, 17 nt, Artificial Sequence
  Synthetic
acguggcggaccugcug

SEQ ID NO: 36345 - RNA, 17 nt, Artificial Sequence
  Synthetic
cuccgccucuuccucug

SEQ ID NO: 36346 - RNA, 17 nt, Artificial Sequence
  Synthetic
agagaggggggaaagug

SEQ ID NO: 36347 - RNA, 17 nt, Artificial Sequence
  Synthetic
ggaggagacaggaagug

SEQ ID NO: 36348 - RNA, 17 nt, Artificial Sequence
  Synthetic
gggcacgggcguaagug

SEQ ID NO: 36349 - RNA, 17 nt, Artificial Sequence
  Synthetic
aagugggggugggagug

SEQ ID NO: 36350 - RNA, 17 nt, Artificial Sequence
  Synthetic
gcgggguggggugagug

SEQ ID NO: 36351 - RNA, 17 nt, Artificial Sequence
  Synthetic
uguuguggugggccgug

SEQ ID NO: 36352 - RNA, 17 nt, Artificial Sequence
  Synthetic
ugggcagguagcgcgug

SEQ ID NO: 36353 - RNA, 17 nt, Artificial Sequence
  Synthetic
acgcgcgcaacugcgug

SEQ ID NO: 36354 - RNA, 17 nt, Artificial Sequence
  Synthetic
gggggcagggggaggug

SEQ ID NO: 36355 - RNA, 17 nt, Artificial Sequence
  Synthetic
cggccggugguccggug

SEQ ID NO: 36356 - RNA, 17 nt, Artificial Sequence
  Synthetic
uucucccagccagggug

SEQ ID NO: 36357 - RNA, 17 nt, Artificial Sequence
  Synthetic
gcucggggagcagggug

SEQ ID NO: 36358 - RNA, 17 nt, Artificial Sequence
  Synthetic
ggugugcgggcggggug

SEQ ID NO: 36359 - RNA, 17 nt, Artificial Sequence
  Synthetic
aacaggccucgggggug

SEQ ID NO: 36360 - RNA, 17 nt, Artificial Sequence
  Synthetic
gcuucgcgccgguggug

SEQ ID NO: 36361 - RNA, 17 nt, Artificial Sequence
  Synthetic
uggugggccguguggug

SEQ ID NO: 36362 - RNA, 17 nt, Artificial Sequence
  Synthetic
ggccgugugguguggug

SEQ ID NO: 36363 - RNA, 17 nt, Artificial Sequence
  Synthetic
cguggcgggcaggugug

SEQ ID NO: 36364 - RNA, 17 nt, Artificial Sequence
  Synthetic
gccuuguugaaaacuug

SEQ ID NO: 36365 - RNA, 17 nt, Artificial Sequence
  Synthetic
cguggugggccguguug

SEQ ID NO: 36366 - RNA, 17 nt, Artificial Sequence
  Synthetic
cgacacgacgcguuuug

SEQ ID NO: 36367 - RNA, 17 nt, Artificial Sequence
  Synthetic
auggagacgggccacau

SEQ ID NO: 36368 - RNA, 17 nt, Artificial Sequence
  Synthetic
ugcggggagacucccau

SEQ ID NO: 36369 - RNA, 17 nt, Artificial Sequence
  Synthetic
ugcgugcucugcacgau

SEQ ID NO: 36370 - RNA, 17 nt, Artificial Sequence
  Synthetic
agcccccucgccccgau

SEQ ID NO: 36371 - RNA, 17 nt, Artificial Sequence
  Synthetic
cucgagacccccgcgau

SEQ ID NO: 36372 - RNA, 17 nt, Artificial Sequence
  Synthetic
gcaggggggccggggau

SEQ ID NO: 36373 - RNA, 17 nt, Artificial Sequence
  Synthetic
uagggggagcuaacacu

SEQ ID NO: 36374 - RNA, 17 nt, Artificial Sequence
  Synthetic
cuggccggccagacccu

SEQ ID NO: 36375 - RNA, 17 nt, Artificial Sequence
  Synthetic
agacgagaaaccucccu

SEQ ID NO: 36376 - RNA, 17 nt, Artificial Sequence
  Synthetic
cugcccccgaggcgccu

SEQ ID NO: 36377 - RNA, 17 nt, Artificial Sequence
  Synthetic
caccggccgaggcgccu

SEQ ID NO: 36378 - RNA, 17 nt, Artificial Sequence
  Synthetic
uaaagaccaacaggccu

SEQ ID NO: 36379 - RNA, 17 nt, Artificial Sequence
  Synthetic
agugcgggugcaugccu

SEQ ID NO: 36380 - RNA, 17 nt, Artificial Sequence
  Synthetic
agugcgguugcaugccu

SEQ ID NO: 36381 - RNA, 17 nt, Artificial Sequence
  Synthetic
uuccuggcacacuuccu

SEQ ID NO: 36382 - RNA, 17 nt, Artificial Sequence
  Synthetic
cgggggccggggccgcu

SEQ ID NO: 36383 - RNA, 17 nt, Artificial Sequence
  Synthetic
cguccgcguccggcgcu

SEQ ID NO: 36384 - RNA, 17 nt, Artificial Sequence
  Synthetic
gucgcgggccccgggcu

SEQ ID NO: 36385 - RNA, 17 nt, Artificial Sequence
  Synthetic
cccuccucacccuggcu

SEQ ID NO: 36386 - RNA, 17 nt, Artificial Sequence
  Synthetic
ugggagggcgccuggcu

SEQ ID NO: 36387 - RNA, 17 nt, Artificial Sequence
  Synthetic
gcaguugcgcgcgugcu

SEQ ID NO: 36388 - RNA, 17 nt, Artificial Sequence
  Synthetic
cgcgccacccguggucu

SEQ ID NO: 36389 - RNA, 17 nt, Artificial Sequence
  Synthetic
guucuggcucccugucu

SEQ ID NO: 36390 - RNA, 17 nt, Artificial Sequence
  Synthetic
uagagaggggggaaagu

SEQ ID NO: 36391 - RNA, 17 nt, Artificial Sequence
  Synthetic
gggaggagacaggaagu

SEQ ID NO: 36392 - RNA, 17 nt, Artificial Sequence
  Synthetic
ggguggugggcaggagu

SEQ ID NO: 36393 - RNA, 17 nt, Artificial Sequence
  Synthetic
cgcgggccacggggagu

SEQ ID NO: 36394 - RNA, 17 nt, Artificial Sequence
  Synthetic
gaagugggggugggagu

SEQ ID NO: 36395 - RNA, 17 nt, Artificial Sequence
  Synthetic
ggggggcgucggguagu

SEQ ID NO: 36396 - RNA, 17 nt, Artificial Sequence
  Synthetic
guccacgaggaccacgu

SEQ ID NO: 36397 - RNA, 17 nt, Artificial Sequence
  Synthetic
cccgacgccccccgcgu

SEQ ID NO: 36398 - RNA, 17 nt, Artificial Sequence
  Synthetic
uccgacgcggggggcgu

SEQ ID NO: 36399 - RNA, 17 nt, Artificial Sequence
  Synthetic
ggccgcuagggaaaggu

SEQ ID NO: 36400 - RNA, 17 nt, Artificial Sequence
  Synthetic
cgggggcagggggaggu

SEQ ID NO: 36401 - RNA, 17 nt, Artificial Sequence
  Synthetic
cucuggaugaccccggu

SEQ ID NO: 36402 - RNA, 17 nt, Artificial Sequence
  Synthetic
ucggccggugguccggu

SEQ ID NO: 36403 - RNA, 17 nt, Artificial Sequence
  Synthetic
ugcccccggggacgggu

SEQ ID NO: 36404 - RNA, 17 nt, Artificial Sequence
  Synthetic
aggugugcgggcggggu

SEQ ID NO: 36405 - RNA, 17 nt, Artificial Sequence
  Synthetic
ggcgccggggcgggggu

SEQ ID NO: 36406 - RNA, 17 nt, Artificial Sequence
  Synthetic
caacaggccucgggggu

SEQ ID NO: 36407 - RNA, 17 nt, Artificial Sequence
  Synthetic
agacaggaagugggggu

SEQ ID NO: 36408 - RNA, 17 nt, Artificial Sequence
  Synthetic
ucccugucuuggugggu

SEQ ID NO: 36409 - RNA, 17 nt, Artificial Sequence
  Synthetic
gaccagggcacccuggu

SEQ ID NO: 36410 - RNA, 17 nt, Artificial Sequence
  Synthetic
cugcgggcggggcuggu

SEQ ID NO: 36411 - RNA, 17 nt, Artificial Sequence
  Synthetic
ucguguugugucguggu

SEQ ID NO: 36412 - RNA, 17 nt, Artificial Sequence
  Synthetic
cagacccuggggguggu

SEQ ID NO: 36413 - RNA, 17 nt, Artificial Sequence
  Synthetic
gugggccguguuguggu

SEQ ID NO: 36414 - RNA, 17 nt, Artificial Sequence
  Synthetic
uggcucccugucuuggu

SEQ ID NO: 36415 - RNA, 17 nt, Artificial Sequence
  Synthetic
ccacccccgaggccugu

SEQ ID NO: 36416 - RNA, 17 nt, Artificial Sequence
  Synthetic
uugacacacuuuguugu

SEQ ID NO: 36417 - RNA, 17 nt, Artificial Sequence
  Synthetic
uggggggcggcuuccuu

SEQ ID NO: 36418 - RNA, 17 nt, Artificial Sequence
  Synthetic
ugguguguguugcuguu

SEQ ID NO: 36419 - RNA, 20 nt, Artificial Sequence
  Synthetic
gcgcgggggagcugcaucaa

SEQ ID NO: 36420 - RNA, 20 nt, Artificial Sequence
  Synthetic
ccucacccuggcugggagaa

SEQ ID NO: 36421 - RNA, 20 nt, Artificial Sequence
  Synthetic
gggccggggccgcuagggaa

SEQ ID NO: 36422 - RNA, 20 nt, Artificial Sequence
  Synthetic
gggccggggaugggggggaa

SEQ ID NO: 36423 - RNA, 20 nt, Artificial Sequence
  Synthetic
ccacacggcccaccacaaca

SEQ ID NO: 36424 - RNA, 20 nt, Artificial Sequence
  Synthetic
ggccccccucccugucaaca

SEQ ID NO: 36425 - RNA, 20 nt, Artificial Sequence
  Synthetic
uuuuccucaaguuuucaaca

SEQ ID NO: 36426 - RNA, 20 nt, Artificial Sequence
  Synthetic
caacaccacaccacaccaca

SEQ ID NO: 36427 - RNA, 20 nt, Artificial Sequence
  Synthetic
cccgcccacccaccaagaca

SEQ ID NO: 36428 - RNA, 20 nt, Artificial Sequence
  Synthetic
gugggggggggggacggaca

SEQ ID NO: 36429 - RNA, 20 nt, Artificial Sequence
  Synthetic
cugccugcccguccuggaca

SEQ ID NO: 36430 - RNA, 20 nt, Artificial Sequence
  Synthetic
agaguguguccguguugaca

SEQ ID NO: 36431 - RNA, 20 nt, Artificial Sequence
  Synthetic
gaaguccagcgcgcccacca

SEQ ID NO: 36432 - RNA, 20 nt, Artificial Sequence
  Synthetic
gcgcccugcucccgagacca

SEQ ID NO: 36433 - RNA, 20 nt, Artificial Sequence
  Synthetic
ggcaacaugcucuuugacca

SEQ ID NO: 36434 - RNA, 20 nt, Artificial Sequence
  Synthetic
acuccugcccaccaccccca

SEQ ID NO: 36435 - RNA, 20 nt, Artificial Sequence
  Synthetic
gcaccaccggcgcgaagcca

SEQ ID NO: 36436 - RNA, 20 nt, Artificial Sequence
  Synthetic
cuccuccuuucucccagcca

SEQ ID NO: 36437 - RNA, 20 nt, Artificial Sequence
  Synthetic
ugggagucuccccgcagcca

SEQ ID NO: 36438 - RNA, 20 nt, Artificial Sequence
  Synthetic
cuuguucacguaaggcgcca

SEQ ID NO: 36439 - RNA, 20 nt, Artificial Sequence
  Synthetic
ggcgacgcccccgcgggcca

SEQ ID NO: 36440 - RNA, 20 nt, Artificial Sequence
  Synthetic
cggcgcgaagccaggggcca

SEQ ID NO: 36441 - RNA, 20 nt, Artificial Sequence
  Synthetic
gugggcgcgcuggacuucca

SEQ ID NO: 36442 - RNA, 20 nt, Artificial Sequence
  Synthetic
cacccguggucucgggagca

SEQ ID NO: 36443 - RNA, 20 nt, Artificial Sequence
  Synthetic
gcgcgcgugcucggggagca

SEQ ID NO: 36444 - RNA, 20 nt, Artificial Sequence
  Synthetic
ugaugcagcucccccgcgca

SEQ ID NO: 36445 - RNA, 20 nt, Artificial Sequence
  Synthetic
gccgaggcgccucgggggca

SEQ ID NO: 36446 - RNA, 20 nt, Artificial Sequence
  Synthetic
cgccggggcgggggugggca

SEQ ID NO: 36447 - RNA, 20 nt, Artificial Sequence
  Synthetic
uuacgugaacaagacgguca

SEQ ID NO: 36448 - RNA, 20 nt, Artificial Sequence
  Synthetic
gagguggggggggggaaaga

SEQ ID NO: 36449 - RNA, 20 nt, Artificial Sequence
  Synthetic
ggcgccuuacgugaacaaga

SEQ ID NO: 36450 - RNA, 20 nt, Artificial Sequence
  Synthetic
cgugguccucguggaccaga

SEQ ID NO: 36451 - RNA, 20 nt, Artificial Sequence
  Synthetic
cacccguccccgggggcaga

SEQ ID NO: 36452 - RNA, 20 nt, Artificial Sequence
  Synthetic
ccagggaacuuugauagaga

SEQ ID NO: 36453 - RNA, 20 nt, Artificial Sequence
  Synthetic
gcccguccuggacauggaga

SEQ ID NO: 36454 - RNA, 20 nt, Artificial Sequence
  Synthetic
cgcgagcccccucgccccga

SEQ ID NO: 36455 - RNA, 20 nt, Artificial Sequence
  Synthetic
acacucggcuugcugcccga

SEQ ID NO: 36456 - RNA, 20 nt, Artificial Sequence
  Synthetic
cgcagcagcgcgggggccga

SEQ ID NO: 36457 - RNA, 20 nt, Artificial Sequence
  Synthetic
gacgcucgagacccccgcga

SEQ ID NO: 36458 - RNA, 20 nt, Artificial Sequence
  Synthetic
ggagacucccaucggggcga

SEQ ID NO: 36459 - RNA, 20 nt, Artificial Sequence
  Synthetic
ggaaaguggggcgggggcga

SEQ ID NO: 36460 - RNA, 20 nt, Artificial Sequence
  Synthetic
ccccgcagccaggguaagga

SEQ ID NO: 36461 - RNA, 20 nt, Artificial Sequence
  Synthetic
gcccgucuccauguccagga

SEQ ID NO: 36462 - RNA, 20 nt, Artificial Sequence
  Synthetic
acgggugggaggaaggagga

SEQ ID NO: 36463 - RNA, 20 nt, Artificial Sequence
  Synthetic
gggggaagggaggaggagga

SEQ ID NO: 36464 - RNA, 20 nt, Artificial Sequence
  Synthetic
ccuggcucggggagggagga

SEQ ID NO: 36465 - RNA, 20 nt, Artificial Sequence
  Synthetic
cccggggacgggugggagga

SEQ ID NO: 36466 - RNA, 20 nt, Artificial Sequence
  Synthetic
ucucccagccagggugagga

SEQ ID NO: 36467 - RNA, 20 nt, Artificial Sequence
  Synthetic
aggaagacgcgccacgcgga

SEQ ID NO: 36468 - RNA, 20 nt, Artificial Sequence
  Synthetic
uguguccguguugacaggga

SEQ ID NO: 36469 - RNA, 20 nt, Artificial Sequence
  Synthetic
acgcccucugcccccgggga

SEQ ID NO: 36470 - RNA, 20 nt, Artificial Sequence
  Synthetic
ccgcgcaggggggccgggga

SEQ ID NO: 36471 - RNA, 20 nt, Artificial Sequence
  Synthetic
gagggcgccuggcucgggga

SEQ ID NO: 36472 - RNA, 20 nt, Artificial Sequence
  Synthetic
gugggaguggggggggggga

SEQ ID NO: 36473 - RNA, 20 nt, Artificial Sequence
  Synthetic
ggggccggggauggggggga

SEQ ID NO: 36474 - RNA, 20 nt, Artificial Sequence
  Synthetic
gguggugggcaggaguggga

SEQ ID NO: 36475 - RNA, 20 nt, Artificial Sequence
  Synthetic
acauggagacgggccacaua

SEQ ID NO: 36476 - RNA, 20 nt, Artificial Sequence
  Synthetic
gccgggggccggggccgcua

SEQ ID NO: 36477 - RNA, 20 nt, Artificial Sequence
  Synthetic
cccgcgggccacggggagua

SEQ ID NO: 36478 - RNA, 20 nt, Artificial Sequence
  Synthetic
gugaccgucuuguucacgua

SEQ ID NO: 36479 - RNA, 20 nt, Artificial Sequence
  Synthetic
gucuccccgcagccagggua

SEQ ID NO: 36480 - RNA, 20 nt, Artificial Sequence
  Synthetic
cacacaccagcauuuuguua

SEQ ID NO: 36481 - RNA, 20 nt, Artificial Sequence
  Synthetic
guucuaugauaaagaccaac

SEQ ID NO: 36482 - RNA, 20 nt, Artificial Sequence
  Synthetic
gggggggucagccgcaccac

SEQ ID NO: 36483 - RNA, 20 nt, Artificial Sequence
  Synthetic
cgcccugcucccgagaccac

SEQ ID NO: 36484 - RNA, 20 nt, Artificial Sequence
  Synthetic
gccgccccccaccggaccac

SEQ ID NO: 36485 - RNA, 20 nt, Artificial Sequence
  Synthetic
cgaaggaagccgccccccac

SEQ ID NO: 36486 - RNA, 20 nt, Artificial Sequence
  Synthetic
ucaaagagcauguugcccac

SEQ ID NO: 36487 - RNA, 20 nt, Artificial Sequence
  Synthetic
gcgacgcccccgcgggccac

SEQ ID NO: 36488 - RNA, 20 nt, Artificial Sequence
  Synthetic
gccggggcgggggugggcac

SEQ ID NO: 36489 - RNA, 20 nt, Artificial Sequence
  Synthetic
uacgugaacaagacggucac

SEQ ID NO: 36490 - RNA, 20 nt, Artificial Sequence
  Synthetic
agguggggggggggaaagac

SEQ ID NO: 36491 - RNA, 20 nt, Artificial Sequence
  Synthetic
gcccgcccacccaccaagac

SEQ ID NO: 36492 - RNA, 20 nt, Artificial Sequence
  Synthetic
gugguccucguggaccagac

SEQ ID NO: 36493 - RNA, 20 nt, Artificial Sequence
  Synthetic
gggaaagacggggaggagac

SEQ ID NO: 36494 - RNA, 20 nt, Artificial Sequence
  Synthetic
cccguccuggacauggagac

SEQ ID NO: 36495 - RNA, 20 nt, Artificial Sequence
  Synthetic
gagaccacggguggcgcgac

SEQ ID NO: 36496 - RNA, 20 nt, Artificial Sequence
  Synthetic
cccgucuccauguccaggac

SEQ ID NO: 36497 - RNA, 20 nt, Artificial Sequence
  Synthetic
cgcccucugcccccggggac

SEQ ID NO: 36498 - RNA, 20 nt, Artificial Sequence
  Synthetic
aagaguguguccguguugac

SEQ ID NO: 36499 - RNA, 20 nt, Artificial Sequence
  Synthetic
ggaaguccagcgcgcccacc

SEQ ID NO: 36500 - RNA, 20 nt, Artificial Sequence
  Synthetic
caaagagcauguugcccacc

SEQ ID NO: 36501 - RNA, 20 nt, Artificial Sequence
  Synthetic
cgagcccggggcccgcgacc

SEQ ID NO: 36502 - RNA, 20 nt, Artificial Sequence
  Synthetic
gggcaacaugcucuuugacc

SEQ ID NO: 36503 - RNA, 20 nt, Artificial Sequence
  Synthetic
gcucuuugaccagggcaccc

SEQ ID NO: 36504 - RNA, 20 nt, Artificial Sequence
  Synthetic
acgcccgccccuccucaccc

SEQ ID NO: 36505 - RNA, 20 nt, Artificial Sequence
  Synthetic
acgucuggccggccagaccc

SEQ ID NO: 36506 - RNA, 20 nt, Artificial Sequence
  Synthetic
gaacagccucuggaugaccc

SEQ ID NO: 36507 - RNA, 20 nt, Artificial Sequence
  Synthetic
acgcccgccccuccuuaccc

SEQ ID NO: 36508 - RNA, 20 nt, Artificial Sequence
  Synthetic
cacuccugcccaccaccccc

SEQ ID NO: 36509 - RNA, 20 nt, Artificial Sequence
  Synthetic
caugcacgcccucugccccc

SEQ ID NO: 36510 - RNA, 20 nt, Artificial Sequence
  Synthetic
ucccuagcggccccggcccc

SEQ ID NO: 36511 - RNA, 20 nt, Artificial Sequence
  Synthetic
ggcgccgggucgcgggcccc

SEQ ID NO: 36512 - RNA, 20 nt, Artificial Sequence
  Synthetic
uaucaaaguucccuggcccc

SEQ ID NO: 36513 - RNA, 20 nt, Artificial Sequence
  Synthetic
gcaugcacgcccucugcccc

SEQ ID NO: 36514 - RNA, 20 nt, Artificial Sequence
  Synthetic
ccuuccucccacccgucccc

SEQ ID NO: 36515 - RNA, 20 nt, Artificial Sequence
  Synthetic
cggagggcggccccgagccc

SEQ ID NO: 36516 - RNA, 20 nt, Artificial Sequence
  Synthetic
gcccgugcccacccccgccc

SEQ ID NO: 36517 - RNA, 20 nt, Artificial Sequence
  Synthetic
cuaccuuucccuagcggccc

SEQ ID NO: 36518 - RNA, 20 nt, Artificial Sequence
  Synthetic
gccagaacgaggccgggccc

SEQ ID NO: 36519 - RNA, 20 nt, Artificial Sequence
  Synthetic
gggcgccgggucgcgggccc

SEQ ID NO: 36520 - RNA, 20 nt, Artificial Sequence
  Synthetic
ggucucgagcgucguggccc

SEQ ID NO: 36521 - RNA, 20 nt, Artificial Sequence
  Synthetic
gcgcgcccaccagggugccc

SEQ ID NO: 36522 - RNA, 20 nt, Artificial Sequence
  Synthetic
ccucccuucccccccauccc

SEQ ID NO: 36523 - RNA, 20 nt, Artificial Sequence
  Synthetic
uccuuccucccacccguccc

SEQ ID NO: 36524 - RNA, 20 nt, Artificial Sequence
  Synthetic
cccucucuaucaaaguuccc

SEQ ID NO: 36525 - RNA, 20 nt, Artificial Sequence
  Synthetic
cgcaccaccggcgcgaagcc

SEQ ID NO: 36526 - RNA, 20 nt, Artificial Sequence
  Synthetic
ccuccuccuuucucccagcc

SEQ ID NO: 36527 - RNA, 20 nt, Artificial Sequence
  Synthetic
augggagucuccccgcagcc

SEQ ID NO: 36528 - RNA, 20 nt, Artificial Sequence
  Synthetic
cuuuaucauagaacagagcc

SEQ ID NO: 36529 - RNA, 20 nt, Artificial Sequence
  Synthetic
gcggagggcggccccgagcc

SEQ ID NO: 36530 - RNA, 20 nt, Artificial Sequence
  Synthetic
cccuccucccuccccgagcc

SEQ ID NO: 36531 - RNA, 20 nt, Artificial Sequence
  Synthetic
ucuuguucacguaaggcgcc

SEQ ID NO: 36532 - RNA, 20 nt, Artificial Sequence
  Synthetic
ggggcccgcgacccggcgcc

SEQ ID NO: 36533 - RNA, 20 nt, Artificial Sequence
  Synthetic
ggcaggagugggagggcgcc

SEQ ID NO: 36534 - RNA, 20 nt, Artificial Sequence
  Synthetic
agcgcgugaggccgggcgcc

SEQ ID NO: 36535 - RNA, 20 nt, Artificial Sequence
  Synthetic
gugcgggcggggugggcgcc

SEQ ID NO: 36536 - RNA, 20 nt, Artificial Sequence
  Synthetic
cagggagccagaacgaggcc

SEQ ID NO: 36537 - RNA, 20 nt, Artificial Sequence
  Synthetic
ggcagguagcgcgugaggcc

SEQ ID NO: 36538 - RNA, 20 nt, Artificial Sequence
  Synthetic
ccggcgcgaagccaggggcc

SEQ ID NO: 36539 - RNA, 20 nt, Artificial Sequence
  Synthetic
cauagaacagagccggggcc

SEQ ID NO: 36540 - RNA, 20 nt, Artificial Sequence
  Synthetic
aaggaaacgggccgggggcc

SEQ ID NO: 36541 - RNA, 20 nt, Artificial Sequence
  Synthetic
cucccccgcgcaggggggcc

SEQ ID NO: 36542 - RNA, 20 nt, Artificial Sequence
  Synthetic
gggggccgaggaagugugcc

SEQ ID NO: 36543 - RNA, 20 nt, Artificial Sequence
  Synthetic
gggggacugccugcccgucc

SEQ ID NO: 36544 - RNA, 20 nt, Artificial Sequence
  Synthetic
uguggcccgucuccaugucc

SEQ ID NO: 36545 - RNA, 20 nt, Artificial Sequence
  Synthetic
cuccgcguggcgcgucuucc

SEQ ID NO: 36546 - RNA, 20 nt, Artificial Sequence
  Synthetic
cgggggccgcggcccgcagc

SEQ ID NO: 36547 - RNA, 20 nt, Artificial Sequence
  Synthetic
ucuuuaucauagaacagagc

SEQ ID NO: 36548 - RNA, 20 nt, Artificial Sequence
  Synthetic
ugggagaaaggaggaggagc

SEQ ID NO: 36549 - RNA, 20 nt, Artificial Sequence
  Synthetic
ccacccguggucucgggagc

SEQ ID NO: 36550 - RNA, 20 nt, Artificial Sequence
  Synthetic
ugcgcgcgugcucggggagc

SEQ ID NO: 36551 - RNA, 20 nt, Artificial Sequence
  Synthetic
agggugcggcggcuccacgc

SEQ ID NO: 36552 - RNA, 20 nt, Artificial Sequence
  Synthetic
aggcuguuccacuccgacgc

SEQ ID NO: 36553 - RNA, 20 nt, Artificial Sequence
  Synthetic
ccggccggcgacgcccccgc

SEQ ID NO: 36554 - RNA, 20 nt, Artificial Sequence
  Synthetic
cccuacuccccguggcccgc

SEQ ID NO: 36555 - RNA, 20 nt, Artificial Sequence
  Synthetic
cccccgcgcugcugcgccgc

SEQ ID NO: 36556 - RNA, 20 nt, Artificial Sequence
  Synthetic
uucucgucucuccccagcgc

SEQ ID NO: 36557 - RNA, 20 nt, Artificial Sequence
  Synthetic
cccccgcggcgcagcagcgc

SEQ ID NO: 36558 - RNA, 20 nt, Artificial Sequence
  Synthetic
uugaugcagcucccccgcgc

SEQ ID NO: 36559 - RNA, 20 nt, Artificial Sequence
  Synthetic
ggagcagggcgcgcccgcgc

SEQ ID NO: 36560 - RNA, 20 nt, Artificial Sequence
  Synthetic
gggcacccuggugggcgcgc

SEQ ID NO: 36561 - RNA, 20 nt, Artificial Sequence
  Synthetic
ccuggccccuggcuucgcgc

SEQ ID NO: 36562 - RNA, 20 nt, Artificial Sequence
  Synthetic
ggggcgucgccggccggcgc

SEQ ID NO: 36563 - RNA, 20 nt, Artificial Sequence
  Synthetic
gucgcguccgcguccggcgc

SEQ ID NO: 36564 - RNA, 20 nt, Artificial Sequence
  Synthetic
uagcgcgugaggccgggcgc

SEQ ID NO: 36565 - RNA, 20 nt, Artificial Sequence
  Synthetic
ugugcgggcggggugggcgc

SEQ ID NO: 36566 - RNA, 20 nt, Artificial Sequence
  Synthetic
cauccccggccccccugcgc

SEQ ID NO: 36567 - RNA, 20 nt, Artificial Sequence
  Synthetic
acgcgcuaccugcccaucgc

SEQ ID NO: 36568 - RNA, 20 nt, Artificial Sequence
  Synthetic
guggcccgcgggggcgucgc

SEQ ID NO: 36569 - RNA, 20 nt, Artificial Sequence
  Synthetic
gaggccgggcgccgggucgc

SEQ ID NO: 36570 - RNA, 20 nt, Artificial Sequence
  Synthetic
acagggagccagaacgaggc

SEQ ID NO: 36571 - RNA, 20 nt, Artificial Sequence
  Synthetic
gggcagguagcgcgugaggc

SEQ ID NO: 36572 - RNA, 20 nt, Artificial Sequence
  Synthetic
cagggcgcgcccgcgccggc

SEQ ID NO: 36573 - RNA, 20 nt, Artificial Sequence
  Synthetic
cccgcgggggcgucgccggc

SEQ ID NO: 36574 - RNA, 20 nt, Artificial Sequence
  Synthetic
ugcccccgaggcgccucggc

SEQ ID NO: 36575 - RNA, 20 nt, Artificial Sequence
  Synthetic
ucuccauguccaggacgggc

SEQ ID NO: 36576 - RNA, 20 nt, Artificial Sequence
  Synthetic
gucuuggugggugggcgggc

SEQ ID NO: 36577 - RNA, 20 nt, Artificial Sequence
  Synthetic
gaggggcgggcguggcgggc

SEQ ID NO: 36578 - RNA, 20 nt, Artificial Sequence
  Synthetic
ccgccucuuccucugcgggc

SEQ ID NO: 36579 - RNA, 20 nt, Artificial Sequence
  Synthetic
uggcgggcaggugugcgggc

SEQ ID NO: 36580 - RNA, 20 nt, Artificial Sequence
  Synthetic
cagccaggguaaggaggggc

SEQ ID NO: 36581 - RNA, 20 nt, Artificial Sequence
  Synthetic
cagccagggugaggaggggc

SEQ ID NO: 36582 - RNA, 20 nt, Artificial Sequence
  Synthetic
ggcggggugggcgccggggc

SEQ ID NO: 36583 - RNA, 20 nt, Artificial Sequence
  Synthetic
ucuuccucugcgggcggggc

SEQ ID NO: 36584 - RNA, 20 nt, Artificial Sequence
  Synthetic
gaaggaaacgggccgggggc

SEQ ID NO: 36585 - RNA, 20 nt, Artificial Sequence
  Synthetic
ggccgaggcgccucgggggc

SEQ ID NO: 36586 - RNA, 20 nt, Artificial Sequence
  Synthetic
gcucccccgcgcaggggggc

SEQ ID NO: 36587 - RNA, 20 nt, Artificial Sequence
  Synthetic
ggaggaggaggagggggggc

SEQ ID NO: 36588 - RNA, 20 nt, Artificial Sequence
  Synthetic
gagaggggggaaaguggggc

SEQ ID NO: 36589 - RNA, 20 nt, Artificial Sequence
  Synthetic
ucgagacccccgcgaugggc

SEQ ID NO: 36590 - RNA, 20 nt, Artificial Sequence
  Synthetic
cccugucuuggugggugggc

SEQ ID NO: 36591 - RNA, 20 nt, Artificial Sequence
  Synthetic
agacccuggggguggugggc

SEQ ID NO: 36592 - RNA, 20 nt, Artificial Sequence
  Synthetic
ccgccccuccucacccuggc

SEQ ID NO: 36593 - RNA, 20 nt, Artificial Sequence
  Synthetic
uggugggugggcgggcuggc

SEQ ID NO: 36594 - RNA, 20 nt, Artificial Sequence
  Synthetic
gggugggcgggcuggcuggc

SEQ ID NO: 36595 - RNA, 20 nt, Artificial Sequence
  Synthetic
gcagagcacgcacgucuggc

SEQ ID NO: 36596 - RNA, 20 nt, Artificial Sequence
  Synthetic
caccacccccagggucuggc

SEQ ID NO: 36597 - RNA, 20 nt, Artificial Sequence
  Synthetic
uaaggaggggcgggcguggc

SEQ ID NO: 36598 - RNA, 20 nt, Artificial Sequence
  Synthetic
ugaggaggggcgggcguggc

SEQ ID NO: 36599 - RNA, 20 nt, Artificial Sequence
  Synthetic
gaaaguccauaacaaaaugc

SEQ ID NO: 36600 - RNA, 20 nt, Artificial Sequence
  Synthetic
ccccuccuuacccuggcugc

SEQ ID NO: 36601 - RNA, 20 nt, Artificial Sequence
  Synthetic
gaacguggcggaccugcugc

SEQ ID NO: 36602 - RNA, 20 nt, Artificial Sequence
  Synthetic
uccuccgccucuuccucugc

SEQ ID NO: 36603 - RNA, 20 nt, Artificial Sequence
  Synthetic
gugggcacgggcguaagugc

SEQ ID NO: 36604 - RNA, 20 nt, Artificial Sequence
  Synthetic
ggcguggcgggcaggugugc

SEQ ID NO: 36605 - RNA, 20 nt, Artificial Sequence
  Synthetic
cacgacacgacgcguuuugc

SEQ ID NO: 36606 - RNA, 20 nt, Artificial Sequence
  Synthetic
gcugcggggagacucccauc

SEQ ID NO: 36607 - RNA, 20 nt, Artificial Sequence
  Synthetic
cgugcgugcucugcacgauc

SEQ ID NO: 36608 - RNA, 20 nt, Artificial Sequence
  Synthetic
cgucggaguggaacagccuc

SEQ ID NO: 36609 - RNA, 20 nt, Artificial Sequence
  Synthetic
accaccggccgaggcgccuc

SEQ ID NO: 36610 - RNA, 20 nt, Artificial Sequence
  Synthetic
gauaaagaccaacaggccuc

SEQ ID NO: 36611 - RNA, 20 nt, Artificial Sequence
  Synthetic
cgcuggacuuccacggccuc

SEQ ID NO: 36612 - RNA, 20 nt, Artificial Sequence
  Synthetic
uaagugcgggugcaugccuc

SEQ ID NO: 36613 - RNA, 20 nt, Artificial Sequence
  Synthetic
ugagugcgguugcaugccuc

SEQ ID NO: 36614 - RNA, 20 nt, Artificial Sequence
  Synthetic
gggucgcgggccccgggcuc

SEQ ID NO: 36615 - RNA, 20 nt, Artificial Sequence
  Synthetic
agugggagggcgccuggcuc

SEQ ID NO: 36616 - RNA, 20 nt, Artificial Sequence
  Synthetic
acgcaguugcgcgcgugcuc

SEQ ID NO: 36617 - RNA, 20 nt, Artificial Sequence
  Synthetic
gucgcgccacccguggucuc

SEQ ID NO: 36618 - RNA, 20 nt, Artificial Sequence
  Synthetic
gcggggggcgucggguaguc

SEQ ID NO: 36619 - RNA, 20 nt, Artificial Sequence
  Synthetic
ucgugcagagcacgcacguc

SEQ ID NO: 36620 - RNA, 20 nt, Artificial Sequence
  Synthetic
gguccgccacguuccccguc

SEQ ID NO: 36621 - RNA, 20 nt, Artificial Sequence
  Synthetic
gggagcgucgcguccgcguc

SEQ ID NO: 36622 - RNA, 20 nt, Artificial Sequence
  Synthetic
acuccgacgcggggggcguc

SEQ ID NO: 36623 - RNA, 20 nt, Artificial Sequence
  Synthetic
ugcccaccacccccaggguc

SEQ ID NO: 36624 - RNA, 20 nt, Artificial Sequence
  Synthetic
aggcgccucggccggugguc

SEQ ID NO: 36625 - RNA, 20 nt, Artificial Sequence
  Synthetic
gguggggggcggcuuccuuc

SEQ ID NO: 36626 - RNA, 20 nt, Artificial Sequence
  Synthetic
gccggggcccggccucguuc

SEQ ID NO: 36627 - RNA, 20 nt, Artificial Sequence
  Synthetic
gcugguguguguugcuguuc

SEQ ID NO: 36628 - RNA, 20 nt, Artificial Sequence
  Synthetic
gcauuuuguuauggacuuuc

SEQ ID NO: 36629 - RNA, 20 nt, Artificial Sequence
  Synthetic
uugauagagaggggggaaag

SEQ ID NO: 36630 - RNA, 20 nt, Artificial Sequence
  Synthetic
gacggggaggagacaggaag

SEQ ID NO: 36631 - RNA, 20 nt, Artificial Sequence
  Synthetic
aaaggaggaggagcaggaag

SEQ ID NO: 36632 - RNA, 20 nt, Artificial Sequence
  Synthetic
agccccgcccgcagaggaag

SEQ ID NO: 36633 - RNA, 20 nt, Artificial Sequence
  Synthetic
caccaccggcgcgaagccag

SEQ ID NO: 36634 - RNA, 20 nt, Artificial Sequence
  Synthetic
ugcccaccggggucauccag

SEQ ID NO: 36635 - RNA, 20 nt, Artificial Sequence
  Synthetic
cccaccagccccgcccgcag

SEQ ID NO: 36636 - RNA, 20 nt, Artificial Sequence
  Synthetic
gaugcagcucccccgcgcag

SEQ ID NO: 36637 - RNA, 20 nt, Artificial Sequence
  Synthetic
ccacccguccccgggggcag

SEQ ID NO: 36638 - RNA, 20 nt, Artificial Sequence
  Synthetic
ccgaggcgccucgggggcag

SEQ ID NO: 36639 - RNA, 20 nt, Artificial Sequence
  Synthetic
cagggaacuuugauagagag

SEQ ID NO: 36640 - RNA, 20 nt, Artificial Sequence
  Synthetic
gccagggaacuuugauagag

SEQ ID NO: 36641 - RNA, 20 nt, Artificial Sequence
  Synthetic
gagacucccaucggggcgag

SEQ ID NO: 36642 - RNA, 20 nt, Artificial Sequence
  Synthetic
cccgcagccaggguaaggag

SEQ ID NO: 36643 - RNA, 20 nt, Artificial Sequence
  Synthetic
cuggggguggugggcaggag

SEQ ID NO: 36644 - RNA, 20 nt, Artificial Sequence
  Synthetic
ggggaagggaggaggaggag

SEQ ID NO: 36645 - RNA, 20 nt, Artificial Sequence
  Synthetic
cuggcucggggagggaggag

SEQ ID NO: 36646 - RNA, 20 nt, Artificial Sequence
  Synthetic
cucccagccagggugaggag

SEQ ID NO: 36647 - RNA, 20 nt, Artificial Sequence
  Synthetic
cgacgccccccgcgucggag

SEQ ID NO: 36648 - RNA, 20 nt, Artificial Sequence
  Synthetic
guguccguguugacagggag

SEQ ID NO: 36649 - RNA, 20 nt, Artificial Sequence
  Synthetic
acaggaagugggggugggag

SEQ ID NO: 36650 - RNA, 20 nt, Artificial Sequence
  Synthetic
cauggagacgggccacauag

SEQ ID NO: 36651 - RNA, 20 nt, Artificial Sequence
  Synthetic
gcgugccuaccuuucccuag

SEQ ID NO: 36652 - RNA, 20 nt, Artificial Sequence
  Synthetic
ccgcgggccacggggaguag

SEQ ID NO: 36653 - RNA, 20 nt, Artificial Sequence
  Synthetic
caagacagggagccagaacg

SEQ ID NO: 36654 - RNA, 20 nt, Artificial Sequence
  Synthetic
cguggaccagacggggaacg

SEQ ID NO: 36655 - RNA, 20 nt, Artificial Sequence
  Synthetic
ugccaggaagacgcgccacg

SEQ ID NO: 36656 - RNA, 20 nt, Artificial Sequence
  Synthetic
cgacgcccccgcgggccacg

SEQ ID NO: 36657 - RNA, 20 nt, Artificial Sequence
  Synthetic
cagggugcggcggcuccacg

SEQ ID NO: 36658 - RNA, 20 nt, Artificial Sequence
  Synthetic
cguuccccgucugguccacg

SEQ ID NO: 36659 - RNA, 20 nt, Artificial Sequence
  Synthetic
acgugaacaagacggucacg

SEQ ID NO: 36660 - RNA, 20 nt, Artificial Sequence
  Synthetic
gguggggggggggaaagacg

SEQ ID NO: 36661 - RNA, 20 nt, Artificial Sequence
  Synthetic
ugguccucguggaccagacg

SEQ ID NO: 36662 - RNA, 20 nt, Artificial Sequence
  Synthetic
gaggcuguuccacuccgacg

SEQ ID NO: 36663 - RNA, 20 nt, Artificial Sequence
  Synthetic
ucucuccccagcgccggacg

SEQ ID NO: 36664 - RNA, 20 nt, Artificial Sequence
  Synthetic
gggccacauaggggccuacg

SEQ ID NO: 36665 - RNA, 20 nt, Artificial Sequence
  Synthetic
aaagagcauguugcccaccg

SEQ ID NO: 36666 - RNA, 20 nt, Artificial Sequence
  Synthetic
gccuccggucgcgccacccg

SEQ ID NO: 36667 - RNA, 20 nt, Artificial Sequence
  Synthetic
gagggagaagagaagacccg

SEQ ID NO: 36668 - RNA, 20 nt, Artificial Sequence
  Synthetic
gagcaggaagaggagacccg

SEQ ID NO: 36669 - RNA, 20 nt, Artificial Sequence
  Synthetic
agaagccgcccccacccccg

SEQ ID NO: 36670 - RNA, 20 nt, Artificial Sequence
  Synthetic
gccggccggcgacgcccccg

SEQ ID NO: 36671 - RNA, 20 nt, Artificial Sequence
  Synthetic
gcacacuuccucggcccccg

SEQ ID NO: 36672 - RNA, 20 nt, Artificial Sequence
  Synthetic
cccaccucccccugcccccg

SEQ ID NO: 36673 - RNA, 20 nt, Artificial Sequence
  Synthetic
augcacgcccucugcccccg

SEQ ID NO: 36674 - RNA, 20 nt, Artificial Sequence
  Synthetic
uuagcucccccuacuccccg

SEQ ID NO: 36675 - RNA, 20 nt, Artificial Sequence
  Synthetic
cuuccucccacccguccccg

SEQ ID NO: 36676 - RNA, 20 nt, Artificial Sequence
  Synthetic
ggagggcggccccgagcccg

SEQ ID NO: 36677 - RNA, 20 nt, Artificial Sequence
  Synthetic
ccccuacuccccguggcccg

SEQ ID NO: 36678 - RNA, 20 nt, Artificial Sequence
  Synthetic
uuuaucauagaacagagccg

SEQ ID NO: 36679 - RNA, 20 nt, Artificial Sequence
  Synthetic
ugcgggcggggugggcgccg

SEQ ID NO: 36680 - RNA, 20 nt, Artificial Sequence
  Synthetic
gcccccgcgcugcugcgccg

SEQ ID NO: 36681 - RNA, 20 nt, Artificial Sequence
  Synthetic
gguggcgcgaccggaggccg

SEQ ID NO: 36682 - RNA, 20 nt, Artificial Sequence
  Synthetic
ccccaccggaccaccggccg

SEQ ID NO: 36683 - RNA, 20 nt, Artificial Sequence
  Synthetic
ggcggaccugcugcgggccg

SEQ ID NO: 36684 - RNA, 20 nt, Artificial Sequence
  Synthetic
aggaaacgggccgggggccg

SEQ ID NO: 36685 - RNA, 20 nt, Artificial Sequence
  Synthetic
gcggcuccacgcgggggccg

SEQ ID NO: 36686 - RNA, 20 nt, Artificial Sequence
  Synthetic
cugcugcgccgcgggggccg

SEQ ID NO: 36687 - RNA, 20 nt, Artificial Sequence
  Synthetic
gcgcagcagcgcgggggccg

SEQ ID NO: 36688 - RNA, 20 nt, Artificial Sequence
  Synthetic
ucccccgcgcaggggggccg

SEQ ID NO: 36689 - RNA, 20 nt, Artificial Sequence
  Synthetic
gcccccgcggcgcagcagcg

SEQ ID NO: 36690 - RNA, 20 nt, Artificial Sequence
  Synthetic
gggugcggcggcuccacgcg

SEQ ID NO: 36691 - RNA, 20 nt, Artificial Sequence
  Synthetic
ggcuguuccacuccgacgcg

SEQ ID NO: 36692 - RNA, 20 nt, Artificial Sequence
  Synthetic
ugcgggccgcggcccccgcg

SEQ ID NO: 36693 - RNA, 20 nt, Artificial Sequence
  Synthetic
ccuacuccccguggcccgcg

SEQ ID NO: 36694 - RNA, 20 nt, Artificial Sequence
  Synthetic
ccccgcgcugcugcgccgcg

SEQ ID NO: 36695 - RNA, 20 nt, Artificial Sequence
  Synthetic
gcucggggccgcccuccgcg

SEQ ID NO: 36696 - RNA, 20 nt, Artificial Sequence
  Synthetic
ccccgcggcgcagcagcgcg

SEQ ID NO: 36697 - RNA, 20 nt, Artificial Sequence
  Synthetic
gggaaagguaggcacgcgcg

SEQ ID NO: 36698 - RNA, 20 nt, Artificial Sequence
  Synthetic
auccccggccccccugcgcg

SEQ ID NO: 36699 - RNA, 20 nt, Artificial Sequence
  Synthetic
cgcgcuaccugcccaucgcg

SEQ ID NO: 36700 - RNA, 20 nt, Artificial Sequence
  Synthetic
gggggcgucgccggccggcg

SEQ ID NO: 36701 - RNA, 20 nt, Artificial Sequence
  Synthetic
aggguaaggaggggcgggcg

SEQ ID NO: 36702 - RNA, 20 nt, Artificial Sequence
  Synthetic
agggugaggaggggcgggcg

SEQ ID NO: 36703 - RNA, 20 nt, Artificial Sequence
  Synthetic
cgccucuuccucugcgggcg

SEQ ID NO: 36704 - RNA, 20 nt, Artificial Sequence
  Synthetic
ggcgggcaggugugcgggcg

SEQ ID NO: 36705 - RNA, 20 nt, Artificial Sequence
  Synthetic
gcggggugggcgccggggcg

SEQ ID NO: 36706 - RNA, 20 nt, Artificial Sequence
  Synthetic
gggagacucccaucggggcg

SEQ ID NO: 36707 - RNA, 20 nt, Artificial Sequence
  Synthetic
gggaaaguggggcgggggcg

SEQ ID NO: 36708 - RNA, 20 nt, Artificial Sequence
  Synthetic
agaggggggaaaguggggcg

SEQ ID NO: 36709 - RNA, 20 nt, Artificial Sequence
  Synthetic
ccauccccggccccccugcg

SEQ ID NO: 36710 - RNA, 20 nt, Artificial Sequence
  Synthetic
cccuccuuacccuggcugcg

SEQ ID NO: 36711 - RNA, 20 nt, Artificial Sequence
  Synthetic
acgacacgacgcguuuugcg

SEQ ID NO: 36712 - RNA, 20 nt, Artificial Sequence
  Synthetic
cacgcgcuaccugcccaucg

SEQ ID NO: 36713 - RNA, 20 nt, Artificial Sequence
  Synthetic
cugcggggagacucccaucg

SEQ ID NO: 36714 - RNA, 20 nt, Artificial Sequence
  Synthetic
ccaccggccgaggcgccucg

SEQ ID NO: 36715 - RNA, 20 nt, Artificial Sequence
  Synthetic
auaaagaccaacaggccucg

SEQ ID NO: 36716 - RNA, 20 nt, Artificial Sequence
  Synthetic
aggggccuacgugguccucg

SEQ ID NO: 36717 - RNA, 20 nt, Artificial Sequence
  Synthetic
ggucgcgggccccgggcucg

SEQ ID NO: 36718 - RNA, 20 nt, Artificial Sequence
  Synthetic
gugggagggcgccuggcucg

SEQ ID NO: 36719 - RNA, 20 nt, Artificial Sequence
  Synthetic
cgcaguugcgcgcgugcucg

SEQ ID NO: 36720 - RNA, 20 nt, Artificial Sequence
  Synthetic
cggggggcgucggguagucg

SEQ ID NO: 36721 - RNA, 20 nt, Artificial Sequence
  Synthetic
cgcgggggucucgagcgucg

SEQ ID NO: 36722 - RNA, 20 nt, Artificial Sequence
  Synthetic
ugaggccgggcgccgggucg

SEQ ID NO: 36723 - RNA, 20 nt, Artificial Sequence
  Synthetic
cgucgugucguguugugucg

SEQ ID NO: 36724 - RNA, 20 nt, Artificial Sequence
  Synthetic
cugguguguguugcuguucg

SEQ ID NO: 36725 - RNA, 20 nt, Artificial Sequence
  Synthetic
cacccuggcugggagaaagg

SEQ ID NO: 36726 - RNA, 20 nt, Artificial Sequence
  Synthetic
ggggacgggugggaggaagg

SEQ ID NO: 36727 - RNA, 20 nt, Artificial Sequence
  Synthetic
uccccgcagccaggguaagg

SEQ ID NO: 36728 - RNA, 20 nt, Artificial Sequence
  Synthetic
augcagcucccccgcgcagg

SEQ ID NO: 36729 - RNA, 20 nt, Artificial Sequence
  Synthetic
cgaggcgccucgggggcagg

SEQ ID NO: 36730 - RNA, 20 nt, Artificial Sequence
  Synthetic
cccgcccgcagaggaagagg

SEQ ID NO: 36731 - RNA, 20 nt, Artificial Sequence
  Synthetic
agggaacuuugauagagagg

SEQ ID NO: 36732 - RNA, 20 nt, Artificial Sequence
  Synthetic
agacucccaucggggcgagg

SEQ ID NO: 36733 - RNA, 20 nt, Artificial Sequence
  Synthetic
ccuggcugggagaaaggagg

SEQ ID NO: 36734 - RNA, 20 nt, Artificial Sequence
  Synthetic
gacgggugggaggaaggagg

SEQ ID NO: 36735 - RNA, 20 nt, Artificial Sequence
  Synthetic
agaggcggaggaggaggagg

SEQ ID NO: 36736 - RNA, 20 nt, Artificial Sequence
  Synthetic
ggaggcggaggaggaggagg

SEQ ID NO: 36737 - RNA, 20 nt, Artificial Sequence
  Synthetic
gggaagggaggaggaggagg

SEQ ID NO: 36738 - RNA, 20 nt, Artificial Sequence
  Synthetic
ggaagaggcggaggaggagg

SEQ ID NO: 36739 - RNA, 20 nt, Artificial Sequence
  Synthetic
ggaggaggcggaggaggagg

SEQ ID NO: 36740 - RNA, 20 nt, Artificial Sequence
  Synthetic
ggggggaagggaggaggagg

SEQ ID NO: 36741 - RNA, 20 nt, Artificial Sequence
  Synthetic
agaggaagaggcggaggagg

SEQ ID NO: 36742 - RNA, 20 nt, Artificial Sequence
  Synthetic
ggaggaggaggcggaggagg

SEQ ID NO: 36743 - RNA, 20 nt, Artificial Sequence
  Synthetic
augggggggaagggaggagg

SEQ ID NO: 36744 - RNA, 20 nt, Artificial Sequence
  Synthetic
uggcucggggagggaggagg

SEQ ID NO: 36745 - RNA, 20 nt, Artificial Sequence
  Synthetic
cgcagaggaagaggcggagg

SEQ ID NO: 36746 - RNA, 20 nt, Artificial Sequence
  Synthetic
ggaggaggaggaggcggagg

SEQ ID NO: 36747 - RNA, 20 nt, Artificial Sequence
  Synthetic
gggaugggggggaagggagg

SEQ ID NO: 36748 - RNA, 20 nt, Artificial Sequence
  Synthetic
uguccguguugacagggagg

SEQ ID NO: 36749 - RNA, 20 nt, Artificial Sequence
  Synthetic
gccuggcucggggagggagg

SEQ ID NO: 36750 - RNA, 20 nt, Artificial Sequence
  Synthetic
gccucgggggcagggggagg

SEQ ID NO: 36751 - RNA, 20 nt, Artificial Sequence
  Synthetic
uucucccagccagggugagg

SEQ ID NO: 36752 - RNA, 20 nt, Artificial Sequence
  Synthetic
cgcgggccacggggaguagg

SEQ ID NO: 36753 - RNA, 20 nt, Artificial Sequence
  Synthetic
cgugaacaagacggucacgg

SEQ ID NO: 36754 - RNA, 20 nt, Artificial Sequence
  Synthetic
accacggguggcgcgaccgg

SEQ ID NO: 36755 - RNA, 20 nt, Artificial Sequence
  Synthetic
cagccucuggaugaccccgg

SEQ ID NO: 36756 - RNA, 20 nt, Artificial Sequence
  Synthetic
uuccucccacccguccccgg

SEQ ID NO: 36757 - RNA, 20 nt, Artificial Sequence
  Synthetic
ggccccuggcuucgcgccgg

SEQ ID NO: 36758 - RNA, 20 nt, Artificial Sequence
  Synthetic
ccccgaggcgccucggccgg

SEQ ID NO: 36759 - RNA, 20 nt, Artificial Sequence
  Synthetic
cgccucggccggugguccgg

SEQ ID NO: 36760 - RNA, 20 nt, Artificial Sequence
  Synthetic
caggaagacgcgccacgcgg

SEQ ID NO: 36761 - RNA, 20 nt, Artificial Sequence
  Synthetic
ggugcggcggcuccacgcgg

SEQ ID NO: 36762 - RNA, 20 nt, Artificial Sequence
  Synthetic
gcuguuccacuccgacgcgg

SEQ ID NO: 36763 - RNA, 20 nt, Artificial Sequence
  Synthetic
cuacuccccguggcccgcgg

SEQ ID NO: 36764 - RNA, 20 nt, Artificial Sequence
  Synthetic
cccgcgcugcugcgccgcgg

SEQ ID NO: 36765 - RNA, 20 nt, Artificial Sequence
  Synthetic
cccgcggcgcagcagcgcgg

SEQ ID NO: 36766 - RNA, 20 nt, Artificial Sequence
  Synthetic
uccccggccccccugcgcgg

SEQ ID NO: 36767 - RNA, 20 nt, Artificial Sequence
  Synthetic
gcgcuaccugcccaucgcgg

SEQ ID NO: 36768 - RNA, 20 nt, Artificial Sequence
  Synthetic
gcccgcagaggaagaggcgg

SEQ ID NO: 36769 - RNA, 20 nt, Artificial Sequence
  Synthetic
ggcggaggaggaggaggcgg

SEQ ID NO: 36770 - RNA, 20 nt, Artificial Sequence
  Synthetic
cggggugggcgccggggcgg

SEQ ID NO: 36771 - RNA, 20 nt, Artificial Sequence
  Synthetic
gaggggggaaaguggggcgg

SEQ ID NO: 36772 - RNA, 20 nt, Artificial Sequence
  Synthetic
gcucggggagcagggugcgg

SEQ ID NO: 36773 - RNA, 20 nt, Artificial Sequence
  Synthetic
caccggccgaggcgccucgg

SEQ ID NO: 36774 - RNA, 20 nt, Artificial Sequence
  Synthetic
uaaagaccaacaggccucgg

SEQ ID NO: 36775 - RNA, 20 nt, Artificial Sequence
  Synthetic
ggggggcgucggguagucgg

SEQ ID NO: 36776 - RNA, 20 nt, Artificial Sequence
  Synthetic
ccggggaugggggggaaggg

SEQ ID NO: 36777 - RNA, 20 nt, Artificial Sequence
  Synthetic
guguguccguguugacaggg

SEQ ID NO: 36778 - RNA, 20 nt, Artificial Sequence
  Synthetic
ugcagcucccccgcgcaggg

SEQ ID NO: 36779 - RNA, 20 nt, Artificial Sequence
  Synthetic
gggaacuuugauagagaggg

SEQ ID NO: 36780 - RNA, 20 nt, Artificial Sequence
  Synthetic
agcagcgcgggggccgaggg

SEQ ID NO: 36781 - RNA, 20 nt, Artificial Sequence
  Synthetic
aaguggggcgggggcgaggg

SEQ ID NO: 36782 - RNA, 20 nt, Artificial Sequence
  Synthetic
ggaagggaggaggaggaggg

SEQ ID NO: 36783 - RNA, 20 nt, Artificial Sequence
  Synthetic
ggcucggggagggaggaggg

SEQ ID NO: 36784 - RNA, 20 nt, Artificial Sequence
  Synthetic
aagacgcgccacgcggaggg

SEQ ID NO: 36785 - RNA, 20 nt, Artificial Sequence
  Synthetic
guccguguugacagggaggg

SEQ ID NO: 36786 - RNA, 20 nt, Artificial Sequence
  Synthetic
ggcgccuggcucggggaggg

SEQ ID NO: 36787 - RNA, 20 nt, Artificial Sequence
  Synthetic
ccugcucccgagaccacggg

SEQ ID NO: 36788 - RNA, 20 nt, Artificial Sequence
  Synthetic
ccucugcccccggggacggg

SEQ ID NO: 36789 - RNA, 20 nt, Artificial Sequence
  Synthetic
cuguuccacuccgacgcggg

SEQ ID NO: 36790 - RNA, 20 nt, Artificial Sequence
  Synthetic
uccgccucuuccucugcggg

SEQ ID NO: 36791 - RNA, 20 nt, Artificial Sequence
  Synthetic
guggcgggcaggugugcggg

SEQ ID NO: 36792 - RNA, 20 nt, Artificial Sequence
  Synthetic
gggggcgucggguagucggg

SEQ ID NO: 36793 - RNA, 20 nt, Artificial Sequence
  Synthetic
gcagccaggguaaggagggg

SEQ ID NO: 36794 - RNA, 20 nt, Artificial Sequence
  Synthetic
gaagggaggaggaggagggg

SEQ ID NO: 36795 - RNA, 20 nt, Artificial Sequence
  Synthetic
gcucggggagggaggagggg

SEQ ID NO: 36796 - RNA, 20 nt, Artificial Sequence
  Synthetic
ccagccagggugaggagggg

SEQ ID NO: 36797 - RNA, 20 nt, Artificial Sequence
  Synthetic
ggggggggggaaagacgggg

SEQ ID NO: 36798 - RNA, 20 nt, Artificial Sequence
  Synthetic
gggcggggugggcgccgggg

SEQ ID NO: 36799 - RNA, 20 nt, Artificial Sequence
  Synthetic
gggcaggugugcgggcgggg

SEQ ID NO: 36800 - RNA, 20 nt, Artificial Sequence
  Synthetic
ggagggcgccuggcucgggg

SEQ ID NO: 36801 - RNA, 20 nt, Artificial Sequence
  Synthetic
ggcgccucgggggcaggggg

SEQ ID NO: 36802 - RNA, 20 nt, Artificial Sequence
  Synthetic
cucggggagggaggaggggg

SEQ ID NO: 36803 - RNA, 20 nt, Artificial Sequence
  Synthetic
ggugggcgccggggcggggg

SEQ ID NO: 36804 - RNA, 20 nt, Artificial Sequence
  Synthetic
agaccaacaggccucggggg

SEQ ID NO: 36805 - RNA, 20 nt, Artificial Sequence
  Synthetic
ucggggagggaggagggggg

SEQ ID NO: 36806 - RNA, 20 nt, Artificial Sequence
  Synthetic
gggaggaggaggaggggggg

SEQ ID NO: 36807 - RNA, 20 nt, Artificial Sequence
  Synthetic
gggggugggagugggggggg

SEQ ID NO: 36808 - RNA, 20 nt, Artificial Sequence
  Synthetic
ugggggugggaguggggggg

SEQ ID NO: 36809 - RNA, 20 nt, Artificial Sequence
  Synthetic
ggcagggggagguggggggg

SEQ ID NO: 36810 - RNA, 20 nt, Artificial Sequence
  Synthetic
gugggggugggagugggggg

SEQ ID NO: 36811 - RNA, 20 nt, Artificial Sequence
  Synthetic
gggcagggggaggugggggg

SEQ ID NO: 36812 - RNA, 20 nt, Artificial Sequence
  Synthetic
gccggugguccggugggggg

SEQ ID NO: 36813 - RNA, 20 nt, Artificial Sequence
  Synthetic
ggccggccagacccuggggg

SEQ ID NO: 36814 - RNA, 20 nt, Artificial Sequence
  Synthetic
gaggagacaggaaguggggg

SEQ ID NO: 36815 - RNA, 20 nt, Artificial Sequence
  Synthetic
agugggggugggaguggggg

SEQ ID NO: 36816 - RNA, 20 nt, Artificial Sequence
  Synthetic
ggggcagggggagguggggg

SEQ ID NO: 36817 - RNA, 20 nt, Artificial Sequence
  Synthetic
acaggccucggggguggggg

SEQ ID NO: 36818 - RNA, 20 nt, Artificial Sequence
  Synthetic
caggggggccggggaugggg

SEQ ID NO: 36819 - RNA, 20 nt, Artificial Sequence
  Synthetic
agagaggggggaaagugggg

SEQ ID NO: 36820 - RNA, 20 nt, Artificial Sequence
  Synthetic
aagugggggugggagugggg

SEQ ID NO: 36821 - RNA, 20 nt, Artificial Sequence
  Synthetic
gggggcagggggaggugggg

SEQ ID NO: 36822 - RNA, 20 nt, Artificial Sequence
  Synthetic
gcaggggggccggggauggg

SEQ ID NO: 36823 - RNA, 20 nt, Artificial Sequence
  Synthetic
ggguggugggcaggaguggg

SEQ ID NO: 36824 - RNA, 20 nt, Artificial Sequence
  Synthetic
gaagugggggugggaguggg

SEQ ID NO: 36825 - RNA, 20 nt, Artificial Sequence
  Synthetic
cgggggcagggggagguggg

SEQ ID NO: 36826 - RNA, 20 nt, Artificial Sequence
  Synthetic
ucggccggugguccgguggg

SEQ ID NO: 36827 - RNA, 20 nt, Artificial Sequence
  Synthetic
ugcccccggggacggguggg

SEQ ID NO: 36828 - RNA, 20 nt, Artificial Sequence
  Synthetic
ucccugucuugguggguggg

SEQ ID NO: 36829 - RNA, 20 nt, Artificial Sequence
  Synthetic
uggcucccugucuugguggg

SEQ ID NO: 36830 - RNA, 20 nt, Artificial Sequence
  Synthetic
cgcaggggggccggggaugg

SEQ ID NO: 36831 - RNA, 20 nt, Artificial Sequence
  Synthetic
cuuugaccagggcacccugg

SEQ ID NO: 36832 - RNA, 20 nt, Artificial Sequence
  Synthetic
ucuggccggccagacccugg

SEQ ID NO: 36833 - RNA, 20 nt, Artificial Sequence
  Synthetic
uccucugcgggcggggcugg

SEQ ID NO: 36834 - RNA, 20 nt, Artificial Sequence
  Synthetic
ugggugggcgggcuggcugg

SEQ ID NO: 36835 - RNA, 20 nt, Artificial Sequence
  Synthetic
ggggaggagacaggaagugg

SEQ ID NO: 36836 - RNA, 20 nt, Artificial Sequence
  Synthetic
ggaagugggggugggagugg

SEQ ID NO: 36837 - RNA, 20 nt, Artificial Sequence
  Synthetic
ggaccagacggggaacgugg

SEQ ID NO: 36838 - RNA, 20 nt, Artificial Sequence
  Synthetic
guaaggaggggcgggcgugg

SEQ ID NO: 36839 - RNA, 20 nt, Artificial Sequence
  Synthetic
gugaggaggggcgggcgugg

SEQ ID NO: 36840 - RNA, 20 nt, Artificial Sequence
  Synthetic
cgugucguguugugucgugg

SEQ ID NO: 36841 - RNA, 20 nt, Artificial Sequence
  Synthetic
ucgggggcagggggaggugg

SEQ ID NO: 36842 - RNA, 20 nt, Artificial Sequence
  Synthetic
cucggccggugguccggugg

SEQ ID NO: 36843 - RNA, 20 nt, Artificial Sequence
  Synthetic
ccaacaggccucgggggugg

SEQ ID NO: 36844 - RNA, 20 nt, Artificial Sequence
  Synthetic
cggccagacccugggggugg

SEQ ID NO: 36845 - RNA, 20 nt, Artificial Sequence
  Synthetic
cguggugggccguguugugg

SEQ ID NO: 36846 - RNA, 20 nt, Artificial Sequence
  Synthetic
guucuggcucccugucuugg

SEQ ID NO: 36847 - RNA, 20 nt, Artificial Sequence
  Synthetic
gcgcaggggggccggggaug

SEQ ID NO: 36848 - RNA, 20 nt, Artificial Sequence
  Synthetic
ggaccacguaggccccuaug

SEQ ID NO: 36849 - RNA, 20 nt, Artificial Sequence
  Synthetic
gucuggccggccagacccug

SEQ ID NO: 36850 - RNA, 20 nt, Artificial Sequence
  Synthetic
cgcguccgcguccggcgcug

SEQ ID NO: 36851 - RNA, 20 nt, Artificial Sequence
  Synthetic
gccccuccuuacccuggcug

SEQ ID NO: 36852 - RNA, 20 nt, Artificial Sequence
  Synthetic
ggaacguggcggaccugcug

SEQ ID NO: 36853 - RNA, 20 nt, Artificial Sequence
  Synthetic
cuccuccgccucuuccucug

SEQ ID NO: 36854 - RNA, 20 nt, Artificial Sequence
  Synthetic
gauagagaggggggaaagug

SEQ ID NO: 36855 - RNA, 20 nt, Artificial Sequence
  Synthetic
cggggaggagacaggaagug

SEQ ID NO: 36856 - RNA, 20 nt, Artificial Sequence
  Synthetic
ggugggcacgggcguaagug

SEQ ID NO: 36857 - RNA, 20 nt, Artificial Sequence
  Synthetic
aggaagugggggugggagug

SEQ ID NO: 36858 - RNA, 20 nt, Artificial Sequence
  Synthetic
cgggcgggguggggugagug

SEQ ID NO: 36859 - RNA, 20 nt, Artificial Sequence
  Synthetic
ccguguuguggugggccgug

SEQ ID NO: 36860 - RNA, 20 nt, Artificial Sequence
  Synthetic
cgaugggcagguagcgcgug

SEQ ID NO: 36861 - RNA, 20 nt, Artificial Sequence
  Synthetic
agcacgcgcgcaacugcgug

SEQ ID NO: 36862 - RNA, 20 nt, Artificial Sequence
  Synthetic
cucgggggcagggggaggug

SEQ ID NO: 36863 - RNA, 20 nt, Artificial Sequence
  Synthetic
ccucggccggugguccggug

SEQ ID NO: 36864 - RNA, 20 nt, Artificial Sequence
  Synthetic
ccuuucucccagccagggug

SEQ ID NO: 36865 - RNA, 20 nt, Artificial Sequence
  Synthetic
cgugcucggggagcagggug

SEQ ID NO: 36866 - RNA, 20 nt, Artificial Sequence
  Synthetic
gcaggugugcgggcggggug

SEQ ID NO: 36867 - RNA, 20 nt, Artificial Sequence
  Synthetic
accaacaggccucgggggug

SEQ ID NO: 36868 - RNA, 20 nt, Artificial Sequence
  Synthetic
cuggcuucgcgccgguggug

SEQ ID NO: 36869 - RNA, 20 nt, Artificial Sequence
  Synthetic
uuguggugggccguguggug

SEQ ID NO: 36870 - RNA, 20 nt, Artificial Sequence
  Synthetic
gugggccgugugguguggug

SEQ ID NO: 36871 - RNA, 20 nt, Artificial Sequence
  Synthetic
gggcguggcgggcaggugug

SEQ ID NO: 36872 - RNA, 20 nt, Artificial Sequence
  Synthetic
cuggccuuguugaaaacuug

SEQ ID NO: 36873 - RNA, 20 nt, Artificial Sequence
  Synthetic
ugucguggugggccguguug

SEQ ID NO: 36874 - RNA, 20 nt, Artificial Sequence
  Synthetic
acacgacacgacgcguuuug

SEQ ID NO: 36875 - RNA, 20 nt, Artificial Sequence
  Synthetic
gacauggagacgggccacau

SEQ ID NO: 36876 - RNA, 20 nt, Artificial Sequence
  Synthetic
ggcugcggggagacucccau

SEQ ID NO: 36877 - RNA, 20 nt, Artificial Sequence
  Synthetic
acgugcgugcucugcacgau

SEQ ID NO: 36878 - RNA, 20 nt, Artificial Sequence
  Synthetic
gcgagcccccucgccccgau

SEQ ID NO: 36879 - RNA, 20 nt, Artificial Sequence
  Synthetic
acgcucgagacccccgcgau

SEQ ID NO: 36880 - RNA, 20 nt, Artificial Sequence
  Synthetic
cgcgcaggggggccggggau

SEQ ID NO: 36881 - RNA, 20 nt, Artificial Sequence
  Synthetic
gaguagggggagcuaacacu

SEQ ID NO: 36882 - RNA, 20 nt, Artificial Sequence
  Synthetic
cgucuggccggccagacccu

SEQ ID NO: 36883 - RNA, 20 nt, Artificial Sequence
  Synthetic
gagagacgagaaaccucccu

SEQ ID NO: 36884 - RNA, 20 nt, Artificial Sequence
  Synthetic
ccccugcccccgaggcgccu

SEQ ID NO: 36885 - RNA, 20 nt, Artificial Sequence
  Synthetic
gaccaccggccgaggcgccu

SEQ ID NO: 36886 - RNA, 20 nt, Artificial Sequence
  Synthetic
ugauaaagaccaacaggccu

SEQ ID NO: 36887 - RNA, 20 nt, Artificial Sequence
  Synthetic
guaagugcgggugcaugccu

SEQ ID NO: 36888 - RNA, 20 nt, Artificial Sequence
  Synthetic
gugagugcgguugcaugccu

SEQ ID NO: 36889 - RNA, 20 nt, Artificial Sequence
  Synthetic
gucuuccuggcacacuuccu

SEQ ID NO: 36890 - RNA, 20 nt, Artificial Sequence
  Synthetic
ggccgggggccggggccgcu

SEQ ID NO: 36891 - RNA, 20 nt, Artificial Sequence
  Synthetic
ucgcguccgcguccggcgcu

SEQ ID NO: 36892 - RNA, 20 nt, Artificial Sequence
  Synthetic
cgggucgcgggccccgggcu

SEQ ID NO: 36893 - RNA, 20 nt, Artificial Sequence
  Synthetic
cgccccuccucacccuggcu

SEQ ID NO: 36894 - RNA, 20 nt, Artificial Sequence
  Synthetic
gagugggagggcgccuggcu

SEQ ID NO: 36895 - RNA, 20 nt, Artificial Sequence
  Synthetic
cacgcaguugcgcgcgugcu

SEQ ID NO: 36896 - RNA, 20 nt, Artificial Sequence
  Synthetic
ggucgcgccacccguggucu

SEQ ID NO: 36897 - RNA, 20 nt, Artificial Sequence
  Synthetic
cucguucuggcucccugucu

SEQ ID NO: 36898 - RNA, 20 nt, Artificial Sequence
  Synthetic
ugauagagaggggggaaagu

SEQ ID NO: 36899 - RNA, 20 nt, Artificial Sequence
  Synthetic
acggggaggagacaggaagu

SEQ ID NO: 36900 - RNA, 20 nt, Artificial Sequence
  Synthetic
uggggguggugggcaggagu

SEQ ID NO: 36901 - RNA, 20 nt, Artificial Sequence
  Synthetic
ccccgcgggccacggggagu

SEQ ID NO: 36902 - RNA, 20 nt, Artificial Sequence
  Synthetic
caggaagugggggugggagu

SEQ ID NO: 36903 - RNA, 20 nt, Artificial Sequence
  Synthetic
cgcggggggcgucggguagu

SEQ ID NO: 36904 - RNA, 20 nt, Artificial Sequence
  Synthetic
cugguccacgaggaccacgu

SEQ ID NO: 36905 - RNA, 20 nt, Artificial Sequence
  Synthetic
cuacccgacgccccccgcgu

SEQ ID NO: 36906 - RNA, 20 nt, Artificial Sequence
  Synthetic
cacuccgacgcggggggcgu

SEQ ID NO: 36907 - RNA, 20 nt, Artificial Sequence
  Synthetic
cggggccgcuagggaaaggu

SEQ ID NO: 36908 - RNA, 20 nt, Artificial Sequence
  Synthetic
ccucgggggcagggggaggu

SEQ ID NO: 36909 - RNA, 20 nt, Artificial Sequence
  Synthetic
agccucuggaugaccccggu

SEQ ID NO: 36910 - RNA, 20 nt, Artificial Sequence
  Synthetic
gccucggccggugguccggu

SEQ ID NO: 36911 - RNA, 20 nt, Artificial Sequence
  Synthetic
cucugcccccggggacgggu

SEQ ID NO: 36912 - RNA, 20 nt, Artificial Sequence
  Synthetic
ggcaggugugcgggcggggu

SEQ ID NO: 36913 - RNA, 20 nt, Artificial Sequence
  Synthetic
gugggcgccggggcgggggu

SEQ ID NO: 36914 - RNA, 20 nt, Artificial Sequence
  Synthetic
gaccaacaggccucgggggu

SEQ ID NO: 36915 - RNA, 20 nt, Artificial Sequence
  Synthetic
aggagacaggaagugggggu

SEQ ID NO: 36916 - RNA, 20 nt, Artificial Sequence
  Synthetic
ggcucccugucuuggugggu

SEQ ID NO: 36917 - RNA, 20 nt, Artificial Sequence
  Synthetic
uuugaccagggcacccuggu

SEQ ID NO: 36918 - RNA, 20 nt, Artificial Sequence
  Synthetic
ccucugcgggcggggcuggu

SEQ ID NO: 36919 - RNA, 20 nt, Artificial Sequence
  Synthetic
gugucguguugugucguggu

SEQ ID NO: 36920 - RNA, 20 nt, Artificial Sequence
  Synthetic
ggccagacccuggggguggu

SEQ ID NO: 36921 - RNA, 20 nt, Artificial Sequence
  Synthetic
guggugggccguguuguggu

SEQ ID NO: 36922 - RNA, 20 nt, Artificial Sequence
  Synthetic
uucuggcucccugucuuggu

SEQ ID NO: 36923 - RNA, 20 nt, Artificial Sequence
  Synthetic
cccccacccccgaggccugu

SEQ ID NO: 36924 - RNA, 20 nt, Artificial Sequence
  Synthetic
cuuuugacacacuuuguugu

SEQ ID NO: 36925 - RNA, 20 nt, Artificial Sequence
  Synthetic
cgguggggggcggcuuccuu

SEQ ID NO: 36926 - RNA, 20 nt, Artificial Sequence
  Synthetic
ugcugguguguguugcuguu

SEQ ID NO: 36927 - RNA, 18 nt, Artificial Sequence
  Synthetic
gacgggggggggggaaac

SEQ ID NO: 36928 - RNA, 21 nt, Artificial Sequence
  Synthetic
gacgacgggggggggggaaac

SEQ ID NO: 36929 - RNA, 18 nt, Artificial Sequence
  Synthetic
gggguggauccgaacacg

SEQ ID NO: 36930 - RNA, 19 nt, Artificial Sequence
  Synthetic
ggggguggauccgaacacg

SEQ ID NO: 36931 - RNA, 20 nt, Artificial Sequence
  Synthetic
gggggguggauccgaacacg

SEQ ID NO: 36932 - RNA, 21 nt, Artificial Sequence
  Synthetic
ggggggguggauccgaacacg

SEQ ID NO: 36933 - RNA, 22 nt, Artificial Sequence
  Synthetic
gacgggggggggggaaacgggg

SEQ ID NO: 36934 - RNA, 21 nt, Artificial Sequence
  Synthetic
gcgccuuugggguuguugggg

SEQ ID NO: 36935 - RNA, 19 nt, Artificial Sequence
  Synthetic
guggccgggcacgcgccuu

SEQ ID NO: 36936 - RNA, 22 nt, Artificial Sequence
  Synthetic
gcuguggccgggcacgcgccuu

SEQ ID NO: 36937 - RNA, 23 nt, Artificial Sequence
  Synthetic
ggcuguggccgggcacgcgccuu

SEQ ID NO: 36938 - RNA, 21 nt, Artificial Sequence
  Synthetic
ggcgcgugcccggccacagcc

SEQ ID NO: 36939 - RNA, 18 nt, Artificial Sequence
  Synthetic
guucccgggggggcaggc

SEQ ID NO: 36940 - RNA, 21 nt, Artificial Sequence
  Synthetic
gucguucccgggggggcaggc

SEQ ID NO: 36941 - RNA, 24 nt, Artificial Sequence
  Synthetic
gucgucguucccgggggggcaggc

SEQ ID NO: 36942 - RNA, 19 nt, Artificial Sequence
  Synthetic
cgacgggggggggggaaac

SEQ ID NO: 36943 - RNA, 20 nt, Artificial Sequence
  Synthetic
acgacgggggggggggaaac

SEQ ID NO: 36944 - RNA, 22 nt, Artificial Sequence
  Synthetic
cgacgacgggggggggggaaac

SEQ ID NO: 36945 - RNA, 23 nt, Artificial Sequence
  Synthetic
acgacgacgggggggggggaaac

SEQ ID NO: 36946 - RNA, 24 nt, Artificial Sequence
  Synthetic
aacgacgacgggggggggggaaac

SEQ ID NO: 36947 - RNA, 22 nt, Artificial Sequence
  Synthetic
aggggggguggauccgaacacg

SEQ ID NO: 36948 - RNA, 23 nt, Artificial Sequence
  Synthetic
aaggggggguggauccgaacacg

SEQ ID NO: 36949 - RNA, 24 nt, Artificial Sequence
  Synthetic
aaaggggggguggauccgaacacg

SEQ ID NO: 36950 - RNA, 21 nt, Artificial Sequence
  Synthetic
acgggggggggggaaacgggg

SEQ ID NO: 36951 - RNA, 23 nt, Artificial Sequence
  Synthetic
cgacgggggggggggaaacgggg

SEQ ID NO: 36952 - RNA, 24 nt, Artificial Sequence
  Synthetic
acgacgggggggggggaaacgggg

SEQ ID NO: 36953 - RNA, 22 nt, Artificial Sequence
  Synthetic
cgcgccuuugggguuguugggg

SEQ ID NO: 36954 - RNA, 23 nt, Artificial Sequence
  Synthetic
acgcgccuuugggguuguugggg

SEQ ID NO: 36955 - RNA, 24 nt, Artificial Sequence
  Synthetic
cacgcgccuuugggguuguugggg

SEQ ID NO: 36956 - RNA, 18 nt, Artificial Sequence
  Synthetic
uggccgggcacgcgccuu

SEQ ID NO: 36957 - RNA, 20 nt, Artificial Sequence
  Synthetic
uguggccgggcacgcgccuu

SEQ ID NO: 36958 - RNA, 21 nt, Artificial Sequence
  Synthetic
cuguggccgggcacgcgccuu

SEQ ID NO: 36959 - RNA, 24 nt, Artificial Sequence
  Synthetic
cggcuguggccgggcacgcgccuu

SEQ ID NO: 36960 - RNA, 22 nt, Artificial Sequence
  Synthetic
aggcgcgugcccggccacagcc

SEQ ID NO: 36961 - RNA, 23 nt, Artificial Sequence
  Synthetic
aaggcgcgugcccggccacagcc

SEQ ID NO: 36962 - RNA, 24 nt, Artificial Sequence
  Synthetic
aaaggcgcgugcccggccacagcc

SEQ ID NO: 36963 - RNA, 19 nt, Artificial Sequence
  Synthetic
cguucccgggggggcaggc

SEQ ID NO: 36964 - RNA, 20 nt, Artificial Sequence
  Synthetic
ucguucccgggggggcaggc

SEQ ID NO: 36965 - RNA, 22 nt, Artificial Sequence
  Synthetic
cgucguucccgggggggcaggc

SEQ ID NO: 36966 - RNA, 23 nt, Artificial Sequence
  Synthetic
ucgucguucccgggggggcaggc

SEQ ID NO: 36967 - RNA, 18 nt, Artificial Sequence
  Synthetic
uuucaagaaacacgaggc

SEQ ID NO: 36968 - RNA, 19 nt, Artificial Sequence
  Synthetic
cuuucaagaaacacgaggc

SEQ ID NO: 36969 - RNA, 20 nt, Artificial Sequence
  Synthetic
ccuuucaagaaacacgaggc

SEQ ID NO: 36970 - RNA, 21 nt, Artificial Sequence
  Synthetic
cuaccgcgugggcgcgggcgg

SEQ ID NO: 36971 - RNA, 22 nt, Artificial Sequence
  Synthetic
ucuaccgcgugggcgcgggcgg

SEQ ID NO: 36972 - RNA, 23 nt, Artificial Sequence
  Synthetic
cucuaccgcgugggcgcgggcgg

SEQ ID NO: 36973 - RNA, 24 nt, Artificial Sequence
  Synthetic
ccucuaccgcgugggcgcgggcgg

SEQ ID NO: 36974 - RNA, 18 nt, Artificial Sequence
  Synthetic
uucgcggauccggcgugu

SEQ ID NO: 36975 - RNA, 19 nt, Artificial Sequence
  Synthetic
uuucgcggauccggcgugu

SEQ ID NO: 36976 - RNA, 20 nt, Artificial Sequence
  Synthetic
uuuucgcggauccggcgugu

SEQ ID NO: 36977 - RNA, 21 nt, Artificial Sequence
  Synthetic
auuuucgcggauccggcgugu

SEQ ID NO: 36978 - RNA, 22 nt, Artificial Sequence
  Synthetic
uauuuucgcggauccggcgugu

SEQ ID NO: 36979 - RNA, 23 nt, Artificial Sequence
  Synthetic
uuauuuucgcggauccggcgugu

SEQ ID NO: 36980 - RNA, 24 nt, Artificial Sequence
  Synthetic
auuauuuucgcggauccggcgugu

SEQ ID NO: 36981 - RNA, 18 nt, Artificial Sequence
  Synthetic
caaaaacaccuagaaaaa

SEQ ID NO: 36982 - RNA, 19 nt, Artificial Sequence
  Synthetic
acaaaaacaccuagaaaaa

SEQ ID NO: 36983 - RNA, 20 nt, Artificial Sequence
  Synthetic
aacaaaaacaccuagaaaaa

SEQ ID NO: 36984 - RNA, 21 nt, Artificial Sequence
  Synthetic
aaacaaaaacaccuagaaaaa

SEQ ID NO: 36985 - RNA, 22 nt, Artificial Sequence
  Synthetic
aaaacaaaaacaccuagaaaaa

SEQ ID NO: 36986 - RNA, 23 nt, Artificial Sequence
  Synthetic
aaaaacaaaaacaccuagaaaaa

SEQ ID NO: 36987 - RNA, 24 nt, Artificial Sequence
  Synthetic
caaaaacaaaaacaccuagaaaaa

SEQ ID NO: 36988 - RNA, 18 nt, Artificial Sequence
  Synthetic
gaagaggaaggagaaagg

SEQ ID NO: 36989 - RNA, 19 nt, Artificial Sequence
  Synthetic
ggaagaggaaggagaaagg

SEQ ID NO: 36990 - RNA, 20 nt, Artificial Sequence
  Synthetic
gggaagaggaaggagaaagg

SEQ ID NO: 36991 - RNA, 21 nt, Artificial Sequence
  Synthetic
agggaagaggaaggagaaagg

SEQ ID NO: 36992 - RNA, 22 nt, Artificial Sequence
  Synthetic
aagggaagaggaaggagaaagg

SEQ ID NO: 36993 - RNA, 23 nt, Artificial Sequence
  Synthetic
gaagggaagaggaaggagaaagg

SEQ ID NO: 36994 - RNA, 24 nt, Artificial Sequence
  Synthetic
ggaagggaagaggaaggagaaagg

SEQ ID NO: 36995 - RNA, 18 nt, Artificial Sequence
  Synthetic
ggggggggggaaacgggg

SEQ ID NO: 36996 - RNA, 19 nt, Artificial Sequence
  Synthetic
gggggggggggaaacgggg

SEQ ID NO: 36997 - RNA, 20 nt, Artificial Sequence
  Synthetic
cgggggggggggaaacgggg

SEQ ID NO: 36998 - RNA, 18 nt, Artificial Sequence
  Synthetic
aggaaggagaaagggggg

SEQ ID NO: 36999 - RNA, 19 nt, Artificial Sequence
  Synthetic
gaggaaggagaaagggggg

SEQ ID NO: 37000 - RNA, 20 nt, Artificial Sequence
  Synthetic
agaggaaggagaaagggggg

SEQ ID NO: 37001 - RNA, 21 nt, Artificial Sequence
  Synthetic
aagaggaaggagaaagggggg

SEQ ID NO: 37002 - RNA, 22 nt, Artificial Sequence
  Synthetic
gaagaggaaggagaaagggggg

SEQ ID NO: 37003 - RNA, 23 nt, Artificial Sequence
  Synthetic
ggaagaggaaggagaaagggggg

SEQ ID NO: 37004 - RNA, 24 nt, Artificial Sequence
  Synthetic
gggaagaggaaggagaaagggggg

SEQ ID NO: 37005 - RNA, 18 nt, Artificial Sequence
  Synthetic
ccuuugggguuguugggg

SEQ ID NO: 37006 - RNA, 19 nt, Artificial Sequence
  Synthetic
gccuuugggguuguugggg

SEQ ID NO: 37007 - RNA, 20 nt, Artificial Sequence
  Synthetic
cgccuuugggguuguugggg

SEQ ID NO: 37008 - RNA, 18 nt, Artificial Sequence
  Synthetic
caccuagaaaaaaaggau

SEQ ID NO: 37009 - RNA, 19 nt, Artificial Sequence
  Synthetic
acaccuagaaaaaaaggau

SEQ ID NO: 37010 - RNA, 20 nt, Artificial Sequence
  Synthetic
aacaccuagaaaaaaaggau

SEQ ID NO: 37011 - RNA, 21 nt, Artificial Sequence
  Synthetic
aaacaccuagaaaaaaaggau

SEQ ID NO: 37012 - RNA, 22 nt, Artificial Sequence
  Synthetic
aaaacaccuagaaaaaaaggau

SEQ ID NO: 37013 - RNA, 23 nt, Artificial Sequence
  Synthetic
aaaaacaccuagaaaaaaaggau

SEQ ID NO: 37014 - RNA, 24 nt, Artificial Sequence
  Synthetic
caaaaacaccuagaaaaaaaggau

SEQ ID NO: 37015 - RNA, 18 nt, Artificial Sequence
  Synthetic
gcgugcccggccacagcc

SEQ ID NO: 37016 - RNA, 19 nt, Artificial Sequence
  Synthetic
cgcgugcccggccacagcc

SEQ ID NO: 37017 - RNA, 20 nt, Artificial Sequence
  Synthetic
gcgcgugcccggccacagcc

SEQ ID NO: 37018 - RNA, 18 nt, Artificial Sequence
  Synthetic
cggaagagagaagagagc

SEQ ID NO: 37019 - RNA, 19 nt, Artificial Sequence
  Synthetic
gcggaagagagaagagagc

SEQ ID NO: 37020 - RNA, 20 nt, Artificial Sequence
  Synthetic
ggcggaagagagaagagagc

SEQ ID NO: 37021 - RNA, 21 nt, Artificial Sequence
  Synthetic
gggcggaagagagaagagagc

SEQ ID NO: 37022 - RNA, 22 nt, Artificial Sequence
  Synthetic
cgggcggaagagagaagagagc

SEQ ID NO: 37023 - RNA, 23 nt, Artificial Sequence
  Synthetic
gcgggcggaagagagaagagagc

SEQ ID NO: 37024 - RNA, 24 nt, Artificial Sequence
  Synthetic
ggcgggcggaagagagaagagagc

SEQ ID NO: 37025 - RNA, 21 nt, Artificial Sequence
  Synthetic
cccuuucaagaaacacgaggc

SEQ ID NO: 37026 - RNA, 22 nt, Artificial Sequence
  Synthetic
ccccuuucaagaaacacgaggc

SEQ ID NO: 37027 - RNA, 23 nt, Artificial Sequence
  Synthetic
cccccuuucaagaaacacgaggc

SEQ ID NO: 37028 - RNA, 24 nt, Artificial Sequence
  Synthetic
ucccccuuucaagaaacacgaggc

SEQ ID NO: 37029 - RNA, 18 nt, Artificial Sequence
  Synthetic
uguuuuguuauuauuuuc

SEQ ID NO: 37030 - RNA, 19 nt, Artificial Sequence
  Synthetic
uuguuuuguuauuauuuuc

SEQ ID NO: 37031 - RNA, 20 nt, Artificial Sequence
  Synthetic
uuuguuuuguuauuauuuuc

SEQ ID NO: 37032 - RNA, 21 nt, Artificial Sequence
  Synthetic
guuuguuuuguuauuauuuuc

SEQ ID NO: 37033 - RNA, 22 nt, Artificial Sequence
  Synthetic
uguuuguuuuguuauuauuuuc

SEQ ID NO: 37034 - RNA, 23 nt, Artificial Sequence
  Synthetic
uuguuuguuuuguuauuauuuuc

SEQ ID NO: 37035 - RNA, 24 nt, Artificial Sequence
  Synthetic
uuuguuuguuuuguuauuauuuuc

SEQ ID NO: 37036 - RNA, 18 nt, Artificial Sequence
  Synthetic
ccgcgugggcgcgggcgg

SEQ ID NO: 37037 - RNA, 19 nt, Artificial Sequence
  Synthetic
accgcgugggcgcgggcgg

SEQ ID NO: 37038 - RNA, 20 nt, Artificial Sequence
  Synthetic
uaccgcgugggcgcgggcgg

SEQ ID NO: 37039 - RNA, 18 nt, Artificial Sequence
  Synthetic
uaacaaaacaaacaaaaa

SEQ ID NO: 37040 - RNA, 19 nt, Artificial Sequence
  Synthetic
auaacaaaacaaacaaaaa

SEQ ID NO: 37041 - RNA, 20 nt, Artificial Sequence
  Synthetic
aauaacaaaacaaacaaaaa

SEQ ID NO: 37042 - RNA, 21 nt, Artificial Sequence
  Synthetic
uaauaacaaaacaaacaaaaa

SEQ ID NO: 37043 - RNA, 22 nt, Artificial Sequence
  Synthetic
auaauaacaaaacaaacaaaaa

SEQ ID NO: 37044 - RNA, 23 nt, Artificial Sequence
  Synthetic
aauaauaacaaaacaaacaaaaa

SEQ ID NO: 37045 - RNA, 24 nt, Artificial Sequence
  Synthetic
aaauaauaacaaaacaaacaaaaa

SEQ ID NO: 37046 - RNA, 18 nt, Artificial Sequence
  Synthetic
gggaagaggaaggagaaa

SEQ ID NO: 37047 - RNA, 19 nt, Artificial Sequence
  Synthetic
agggaagaggaaggagaaa

SEQ ID NO: 37048 - RNA, 20 nt, Artificial Sequence
  Synthetic
aagggaagaggaaggagaaa

SEQ ID NO: 37049 - RNA, 21 nt, Artificial Sequence
  Synthetic
gaagggaagaggaaggagaaa

SEQ ID NO: 37050 - RNA, 22 nt, Artificial Sequence
  Synthetic
ggaagggaagaggaaggagaaa

SEQ ID NO: 37051 - RNA, 23 nt, Artificial Sequence
  Synthetic
uggaagggaagaggaaggagaaa

SEQ ID NO: 37052 - RNA, 24 nt, Artificial Sequence
  Synthetic
guggaagggaagaggaaggagaaa

SEQ ID NO: 37053 - RNA, 18 nt, Artificial Sequence
  Synthetic
cgacgggggggggggaaa

SEQ ID NO: 37054 - RNA, 19 nt, Artificial Sequence
  Synthetic
acgacgggggggggggaaa

SEQ ID NO: 37055 - RNA, 20 nt, Artificial Sequence
  Synthetic
gacgacgggggggggggaaa

SEQ ID NO: 37056 - RNA, 21 nt, Artificial Sequence
  Synthetic
cgacgacgggggggggggaaa

SEQ ID NO: 37057 - RNA, 22 nt, Artificial Sequence
  Synthetic
acgacgacgggggggggggaaa

SEQ ID NO: 37058 - RNA, 23 nt, Artificial Sequence
  Synthetic
aacgacgacgggggggggggaaa

SEQ ID NO: 37059 - RNA, 24 nt, Artificial Sequence
  Synthetic
gaacgacgacgggggggggggaaa

SEQ ID NO: 37060 - RNA, 18 nt, Artificial Sequence
  Synthetic
gccucguguuucuugaaa

SEQ ID NO: 37061 - RNA, 19 nt, Artificial Sequence
  Synthetic
cgccucguguuucuugaaa

SEQ ID NO: 37062 - RNA, 20 nt, Artificial Sequence
  Synthetic
ccgccucguguuucuugaaa

SEQ ID NO: 37063 - RNA, 21 nt, Artificial Sequence
  Synthetic
cccgccucguguuucuugaaa

SEQ ID NO: 37064 - RNA, 22 nt, Artificial Sequence
  Synthetic
ccccgccucguguuucuugaaa

SEQ ID NO: 37065 - RNA, 23 nt, Artificial Sequence
  Synthetic
cccccgccucguguuucuugaaa

SEQ ID NO: 37066 - RNA, 24 nt, Artificial Sequence
  Synthetic
acccccgccucguguuucuugaaa

SEQ ID NO: 37067 - RNA, 18 nt, Artificial Sequence
  Synthetic
agggaagaggaaggagaa

SEQ ID NO: 37068 - RNA, 19 nt, Artificial Sequence
  Synthetic
aagggaagaggaaggagaa

SEQ ID NO: 37069 - RNA, 20 nt, Artificial Sequence
  Synthetic
gaagggaagaggaaggagaa

SEQ ID NO: 37070 - RNA, 21 nt, Artificial Sequence
  Synthetic
ggaagggaagaggaaggagaa

SEQ ID NO: 37071 - RNA, 22 nt, Artificial Sequence
  Synthetic
uggaagggaagaggaaggagaa

SEQ ID NO: 37072 - RNA, 23 nt, Artificial Sequence
  Synthetic
guggaagggaagaggaaggagaa

SEQ ID NO: 37073 - RNA, 24 nt, Artificial Sequence
  Synthetic
gguggaagggaagaggaaggagaa

SEQ ID NO: 37074 - RNA, 18 nt, Artificial Sequence
  Synthetic
gcccacgcgguagaggaa

SEQ ID NO: 37075 - RNA, 19 nt, Artificial Sequence
  Synthetic
cgcccacgcgguagaggaa

SEQ ID NO: 37076 - RNA, 20 nt, Artificial Sequence
  Synthetic
gcgcccacgcgguagaggaa

SEQ ID NO: 37077 - RNA, 21 nt, Artificial Sequence
  Synthetic
cgcgcccacgcgguagaggaa

SEQ ID NO: 37078 - RNA, 22 nt, Artificial Sequence
  Synthetic
ccgcgcccacgcgguagaggaa

SEQ ID NO: 37079 - RNA, 23 nt, Artificial Sequence
  Synthetic
cccgcgcccacgcgguagaggaa

SEQ ID NO: 37080 - RNA, 24 nt, Artificial Sequence
  Synthetic
gcccgcgcccacgcgguagaggaa

SEQ ID NO: 37081 - RNA, 18 nt, Artificial Sequence
  Synthetic
gggguggguggaagggaa

SEQ ID NO: 37082 - RNA, 19 nt, Artificial Sequence
  Synthetic
ggggguggguggaagggaa

SEQ ID NO: 37083 - RNA, 20 nt, Artificial Sequence
  Synthetic
cggggguggguggaagggaa

SEQ ID NO: 37084 - RNA, 21 nt, Artificial Sequence
  Synthetic
acggggguggguggaagggaa

SEQ ID NO: 37085 - RNA, 22 nt, Artificial Sequence
  Synthetic
aacggggguggguggaagggaa

SEQ ID NO: 37086 - RNA, 23 nt, Artificial Sequence
  Synthetic
aaacggggguggguggaagggaa

SEQ ID NO: 37087 - RNA, 24 nt, Artificial Sequence
  Synthetic
gaaacggggguggguggaagggaa

SEQ ID NO: 37088 - RNA, 18 nt, Artificial Sequence
  Synthetic
acgacgggggggggggaa

SEQ ID NO: 37089 - RNA, 19 nt, Artificial Sequence
  Synthetic
gacgacgggggggggggaa

SEQ ID NO: 37090 - RNA, 20 nt, Artificial Sequence
  Synthetic
cgacgacgggggggggggaa

SEQ ID NO: 37091 - RNA, 21 nt, Artificial Sequence
  Synthetic
acgacgacgggggggggggaa

SEQ ID NO: 37092 - RNA, 22 nt, Artificial Sequence
  Synthetic
aacgacgacgggggggggggaa

SEQ ID NO: 37093 - RNA, 23 nt, Artificial Sequence
  Synthetic
gaacgacgacgggggggggggaa

SEQ ID NO: 37094 - RNA, 24 nt, Artificial Sequence
  Synthetic
ggaacgacgacgggggggggggaa

SEQ ID NO: 37095 - RNA, 18 nt, Artificial Sequence
  Synthetic
aaacggggguggguggaa

SEQ ID NO: 37096 - RNA, 19 nt, Artificial Sequence
  Synthetic
gaaacggggguggguggaa

SEQ ID NO: 37097 - RNA, 20 nt, Artificial Sequence
  Synthetic
ggaaacggggguggguggaa

SEQ ID NO: 37098 - RNA, 21 nt, Artificial Sequence
  Synthetic
gggaaacggggguggguggaa

SEQ ID NO: 37099 - RNA, 22 nt, Artificial Sequence
  Synthetic
ggggaaacggggguggguggaa

SEQ ID NO: 37100 - RNA, 23 nt, Artificial Sequence
  Synthetic
gggggaaacggggguggguggaa

SEQ ID NO: 37101 - RNA, 24 nt, Artificial Sequence
  Synthetic
ggggggaaacggggguggguggaa

SEQ ID NO: 37102 - RNA, 18 nt, Artificial Sequence
  Synthetic
cgccucguguuucuugaa

SEQ ID NO: 37103 - RNA, 19 nt, Artificial Sequence
  Synthetic
ccgccucguguuucuugaa

SEQ ID NO: 37104 - RNA, 20 nt, Artificial Sequence
  Synthetic
cccgccucguguuucuugaa

SEQ ID NO: 37105 - RNA, 21 nt, Artificial Sequence
  Synthetic
ccccgccucguguuucuugaa

SEQ ID NO: 37106 - RNA, 22 nt, Artificial Sequence
  Synthetic
cccccgccucguguuucuugaa

SEQ ID NO: 37107 - RNA, 23 nt, Artificial Sequence
  Synthetic
acccccgccucguguuucuugaa

SEQ ID NO: 37108 - RNA, 24 nt, Artificial Sequence
  Synthetic
gacccccgccucguguuucuugaa

SEQ ID NO: 37109 - RNA, 18 nt, Artificial Sequence
  Synthetic
aagggaagaggaaggaga

SEQ ID NO: 37110 - RNA, 19 nt, Artificial Sequence
  Synthetic
gaagggaagaggaaggaga

SEQ ID NO: 37111 - RNA, 20 nt, Artificial Sequence
  Synthetic
ggaagggaagaggaaggaga

SEQ ID NO: 37112 - RNA, 21 nt, Artificial Sequence
  Synthetic
uggaagggaagaggaaggaga

SEQ ID NO: 37113 - RNA, 22 nt, Artificial Sequence
  Synthetic
guggaagggaagaggaaggaga

SEQ ID NO: 37114 - RNA, 23 nt, Artificial Sequence
  Synthetic
gguggaagggaagaggaaggaga

SEQ ID NO: 37115 - RNA, 24 nt, Artificial Sequence
  Synthetic
ggguggaagggaagaggaaggaga

SEQ ID NO: 37116 - RNA, 18 nt, Artificial Sequence
  Synthetic
cccccccgggaacgacga

SEQ ID NO: 37117 - RNA, 19 nt, Artificial Sequence
  Synthetic
gcccccccgggaacgacga

SEQ ID NO: 37118 - RNA, 20 nt, Artificial Sequence
  Synthetic
ugcccccccgggaacgacga

SEQ ID NO: 37119 - RNA, 21 nt, Artificial Sequence
  Synthetic
cugcccccccgggaacgacga

SEQ ID NO: 37120 - RNA, 22 nt, Artificial Sequence
  Synthetic
ccugcccccccgggaacgacga

SEQ ID NO: 37121 - RNA, 23 nt, Artificial Sequence
  Synthetic
gccugcccccccgggaacgacga

SEQ ID NO: 37122 - RNA, 24 nt, Artificial Sequence
  Synthetic
cgccugcccccccgggaacgacga

SEQ ID NO: 37123 - RNA, 18 nt, Artificial Sequence
  Synthetic
ggguggaagggaagagga

SEQ ID NO: 37124 - RNA, 19 nt, Artificial Sequence
  Synthetic
uggguggaagggaagagga

SEQ ID NO: 37125 - RNA, 20 nt, Artificial Sequence
  Synthetic
guggguggaagggaagagga

SEQ ID NO: 37126 - RNA, 21 nt, Artificial Sequence
  Synthetic
gguggguggaagggaagagga

SEQ ID NO: 37127 - RNA, 22 nt, Artificial Sequence
  Synthetic
ggguggguggaagggaagagga

SEQ ID NO: 37128 - RNA, 23 nt, Artificial Sequence
  Synthetic
gggguggguggaagggaagagga

SEQ ID NO: 37129 - RNA, 24 nt, Artificial Sequence
  Synthetic
ggggguggguggaagggaagagga

SEQ ID NO: 37130 - RNA, 18 nt, Artificial Sequence
  Synthetic
cgcccacgcgguagagga

SEQ ID NO: 37131 - RNA, 19 nt, Artificial Sequence
  Synthetic
gcgcccacgcgguagagga

SEQ ID NO: 37132 - RNA, 20 nt, Artificial Sequence
  Synthetic
cgcgcccacgcgguagagga

SEQ ID NO: 37133 - RNA, 21 nt, Artificial Sequence
  Synthetic
ccgcgcccacgcgguagagga

SEQ ID NO: 37134 - RNA, 22 nt, Artificial Sequence
  Synthetic
cccgcgcccacgcgguagagga

SEQ ID NO: 37135 - RNA, 23 nt, Artificial Sequence
  Synthetic
gcccgcgcccacgcgguagagga

SEQ ID NO: 37136 - RNA, 24 nt, Artificial Sequence
  Synthetic
cgcccgcgcccacgcgguagagga

SEQ ID NO: 37137 - RNA, 18 nt, Artificial Sequence
  Synthetic
gaaacgggggugggugga

SEQ ID NO: 37138 - RNA, 19 nt, Artificial Sequence
  Synthetic
ggaaacgggggugggugga

SEQ ID NO: 37139 - RNA, 20 nt, Artificial Sequence
  Synthetic
gggaaacgggggugggugga

SEQ ID NO: 37140 - RNA, 21 nt, Artificial Sequence
  Synthetic
ggggaaacgggggugggugga

SEQ ID NO: 37141 - RNA, 22 nt, Artificial Sequence
  Synthetic
gggggaaacgggggugggugga

SEQ ID NO: 37142 - RNA, 23 nt, Artificial Sequence
  Synthetic
ggggggaaacgggggugggugga

SEQ ID NO: 37143 - RNA, 24 nt, Artificial Sequence
  Synthetic
gggggggaaacgggggugggugga

SEQ ID NO: 37144 - RNA, 18 nt, Artificial Sequence
  Synthetic
ccgccucguguuucuuga

SEQ ID NO: 37145 - RNA, 19 nt, Artificial Sequence
  Synthetic
cccgccucguguuucuuga

SEQ ID NO: 37146 - RNA, 20 nt, Artificial Sequence
  Synthetic
ccccgccucguguuucuuga

SEQ ID NO: 37147 - RNA, 21 nt, Artificial Sequence
  Synthetic
cccccgccucguguuucuuga

SEQ ID NO: 37148 - RNA, 22 nt, Artificial Sequence
  Synthetic
acccccgccucguguuucuuga

SEQ ID NO: 37149 - RNA, 23 nt, Artificial Sequence
  Synthetic
gacccccgccucguguuucuuga

SEQ ID NO: 37150 - RNA, 24 nt, Artificial Sequence
  Synthetic
ggacccccgccucguguuucuuga

SEQ ID NO: 37151 - RNA, 18 nt, Artificial Sequence
  Synthetic
gcccgcgcccacgcggua

SEQ ID NO: 37152 - RNA, 19 nt, Artificial Sequence
  Synthetic
cgcccgcgcccacgcggua

SEQ ID NO: 37153 - RNA, 20 nt, Artificial Sequence
  Synthetic
ccgcccgcgcccacgcggua

SEQ ID NO: 37154 - RNA, 21 nt, Artificial Sequence
  Synthetic
cccgcccgcgcccacgcggua

SEQ ID NO: 37155 - RNA, 22 nt, Artificial Sequence
  Synthetic
ccccgcccgcgcccacgcggua

SEQ ID NO: 37156 - RNA, 23 nt, Artificial Sequence
  Synthetic
cccccgcccgcgcccacgcggua

SEQ ID NO: 37157 - RNA, 24 nt, Artificial Sequence
  Synthetic
ccccccgcccgcgcccacgcggua

SEQ ID NO: 37158 - RNA, 18 nt, Artificial Sequence
  Synthetic
ccccccgggaacgacgac

SEQ ID NO: 37159 - RNA, 19 nt, Artificial Sequence
  Synthetic
cccccccgggaacgacgac

SEQ ID NO: 37160 - RNA, 20 nt, Artificial Sequence
  Synthetic
gcccccccgggaacgacgac

SEQ ID NO: 37161 - RNA, 21 nt, Artificial Sequence
  Synthetic
ugcccccccgggaacgacgac

SEQ ID NO: 37162 - RNA, 22 nt, Artificial Sequence
  Synthetic
cugcccccccgggaacgacgac

SEQ ID NO: 37163 - RNA, 23 nt, Artificial Sequence
  Synthetic
ccugcccccccgggaacgacgac

SEQ ID NO: 37164 - RNA, 24 nt, Artificial Sequence
  Synthetic
gccugcccccccgggaacgacgac

SEQ ID NO: 37165 - RNA, 18 nt, Artificial Sequence
  Synthetic
aacaaaaacaaaaacacc

SEQ ID NO: 37166 - RNA, 19 nt, Artificial Sequence
  Synthetic
aaacaaaaacaaaaacacc

SEQ ID NO: 37167 - RNA, 20 nt, Artificial Sequence
  Synthetic
gaaacaaaaacaaaaacacc

SEQ ID NO: 37168 - RNA, 21 nt, Artificial Sequence
  Synthetic
agaaacaaaaacaaaaacacc

SEQ ID NO: 37169 - RNA, 22 nt, Artificial Sequence
  Synthetic
cagaaacaaaaacaaaaacacc

SEQ ID NO: 37170 - RNA, 23 nt, Artificial Sequence
  Synthetic
acagaaacaaaaacaaaaacacc

SEQ ID NO: 37171 - RNA, 24 nt, Artificial Sequence
  Synthetic
aacagaaacaaaaacaaaaacacc

SEQ ID NO: 37172 - RNA, 18 nt, Artificial Sequence
  Synthetic
acccgcgccugccccccc

SEQ ID NO: 37173 - RNA, 19 nt, Artificial Sequence
  Synthetic
gacccgcgccugccccccc

SEQ ID NO: 37174 - RNA, 20 nt, Artificial Sequence
  Synthetic
cgacccgcgccugccccccc

SEQ ID NO: 37175 - RNA, 21 nt, Artificial Sequence
  Synthetic
ccgacccgcgccugccccccc

SEQ ID NO: 37176 - RNA, 22 nt, Artificial Sequence
  Synthetic
cccgacccgcgccugccccccc

SEQ ID NO: 37177 - RNA, 23 nt, Artificial Sequence
  Synthetic
gcccgacccgcgccugccccccc

SEQ ID NO: 37178 - RNA, 24 nt, Artificial Sequence
  Synthetic
ggcccgacccgcgccugccccccc

SEQ ID NO: 37179 - RNA, 18 nt, Artificial Sequence
  Synthetic
gacccgcgccugcccccc

SEQ ID NO: 37180 - RNA, 19 nt, Artificial Sequence
  Synthetic
cgacccgcgccugcccccc

SEQ ID NO: 37181 - RNA, 20 nt, Artificial Sequence
  Synthetic
ccgacccgcgccugcccccc

SEQ ID NO: 37182 - RNA, 21 nt, Artificial Sequence
  Synthetic
cccgacccgcgccugcccccc

SEQ ID NO: 37183 - RNA, 22 nt, Artificial Sequence
  Synthetic
gcccgacccgcgccugcccccc

SEQ ID NO: 37184 - RNA, 23 nt, Artificial Sequence
  Synthetic
ggcccgacccgcgccugcccccc

SEQ ID NO: 37185 - RNA, 24 nt, Artificial Sequence
  Synthetic
gggcccgacccgcgccugcccccc

SEQ ID NO: 37186 - RNA, 18 nt, Artificial Sequence
  Synthetic
cgacccgcgccugccccc

SEQ ID NO: 37187 - RNA, 19 nt, Artificial Sequence
  Synthetic
ccgacccgcgccugccccc

SEQ ID NO: 37188 - RNA, 20 nt, Artificial Sequence
  Synthetic
cccgacccgcgccugccccc

SEQ ID NO: 37189 - RNA, 21 nt, Artificial Sequence
  Synthetic
gcccgacccgcgccugccccc

SEQ ID NO: 37190 - RNA, 22 nt, Artificial Sequence
  Synthetic
ggcccgacccgcgccugccccc

SEQ ID NO: 37191 - RNA, 23 nt, Artificial Sequence
  Synthetic
gggcccgacccgcgccugccccc

SEQ ID NO: 37192 - RNA, 24 nt, Artificial Sequence
  Synthetic
cgggcccgacccgcgccugccccc

SEQ ID NO: 37193 - RNA, 18 nt, Artificial Sequence
  Synthetic
uccgaacacgccggaucc

SEQ ID NO: 37194 - RNA, 19 nt, Artificial Sequence
  Synthetic
auccgaacacgccggaucc

SEQ ID NO: 37195 - RNA, 20 nt, Artificial Sequence
  Synthetic
gauccgaacacgccggaucc

SEQ ID NO: 37196 - RNA, 21 nt, Artificial Sequence
  Synthetic
ggauccgaacacgccggaucc

SEQ ID NO: 37197 - RNA, 22 nt, Artificial Sequence
  Synthetic
uggauccgaacacgccggaucc

SEQ ID NO: 37198 - RNA, 23 nt, Artificial Sequence
  Synthetic
guggauccgaacacgccggaucc

SEQ ID NO: 37199 - RNA, 24 nt, Artificial Sequence
  Synthetic
gguggauccgaacacgccggaucc

SEQ ID NO: 37200 - RNA, 18 nt, Artificial Sequence
  Synthetic
ggggggggugaccggcgc

SEQ ID NO: 37201 - RNA, 19 nt, Artificial Sequence
  Synthetic
gggggggggugaccggcgc

SEQ ID NO: 37202 - RNA, 20 nt, Artificial Sequence
  Synthetic
ugggggggggugaccggcgc

SEQ ID NO: 37203 - RNA, 21 nt, Artificial Sequence
  Synthetic
uugggggggggugaccggcgc

SEQ ID NO: 37204 - RNA, 22 nt, Artificial Sequence
  Synthetic
guugggggggggugaccggcgc

SEQ ID NO: 37205 - RNA, 23 nt, Artificial Sequence
  Synthetic
uguugggggggggugaccggcgc

SEQ ID NO: 37206 - RNA, 24 nt, Artificial Sequence
  Synthetic
uuguugggggggggugaccggcgc

SEQ ID NO: 37207 - RNA, 18 nt, Artificial Sequence
  Synthetic
aaggauacggguuggcuc

SEQ ID NO: 37208 - RNA, 19 nt, Artificial Sequence
  Synthetic
aaaggauacggguuggcuc

SEQ ID NO: 37209 - RNA, 20 nt, Artificial Sequence
  Synthetic
aaaaggauacggguuggcuc

SEQ ID NO: 37210 - RNA, 21 nt, Artificial Sequence
  Synthetic
aaaaaggauacggguuggcuc

SEQ ID NO: 37211 - RNA, 22 nt, Artificial Sequence
  Synthetic
aaaaaaggauacggguuggcuc

SEQ ID NO: 37212 - RNA, 23 nt, Artificial Sequence
  Synthetic
aaaaaaaggauacggguuggcuc

SEQ ID NO: 37213 - RNA, 24 nt, Artificial Sequence
  Synthetic
gaaaaaaaggauacggguuggcuc

SEQ ID NO: 37214 - RNA, 18 nt, Artificial Sequence
  Synthetic
ugaccugccugcccuuuc

SEQ ID NO: 37215 - RNA, 19 nt, Artificial Sequence
  Synthetic
cugaccugccugcccuuuc

SEQ ID NO: 37216 - RNA, 20 nt, Artificial Sequence
  Synthetic
gcugaccugccugcccuuuc

SEQ ID NO: 37217 - RNA, 21 nt, Artificial Sequence
  Synthetic
ggcugaccugccugcccuuuc

SEQ ID NO: 37218 - RNA, 22 nt, Artificial Sequence
  Synthetic
cggcugaccugccugcccuuuc

SEQ ID NO: 37219 - RNA, 23 nt, Artificial Sequence
  Synthetic
gcggcugaccugccugcccuuuc

SEQ ID NO: 37220 - RNA, 24 nt, Artificial Sequence
  Synthetic
ugcggcugaccugccugcccuuuc

SEQ ID NO: 37221 - RNA, 18 nt, Artificial Sequence
  Synthetic
acccccgccucguguuuc

SEQ ID NO: 37222 - RNA, 19 nt, Artificial Sequence
  Synthetic
gacccccgccucguguuuc

SEQ ID NO: 37223 - RNA, 20 nt, Artificial Sequence
  Synthetic
ggacccccgccucguguuuc

SEQ ID NO: 37224 - RNA, 21 nt, Artificial Sequence
  Synthetic
gggacccccgccucguguuuc

SEQ ID NO: 37225 - RNA, 22 nt, Artificial Sequence
  Synthetic
ugggacccccgccucguguuuc

SEQ ID NO: 37226 - RNA, 23 nt, Artificial Sequence
  Synthetic
cugggacccccgccucguguuuc

SEQ ID NO: 37227 - RNA, 24 nt, Artificial Sequence
  Synthetic
ucugggacccccgccucguguuuc

SEQ ID NO: 37228 - RNA, 18 nt, Artificial Sequence
  Synthetic
ggaagaggaaggagaaag

SEQ ID NO: 37229 - RNA, 19 nt, Artificial Sequence
  Synthetic
gggaagaggaaggagaaag

SEQ ID NO: 37230 - RNA, 20 nt, Artificial Sequence
  Synthetic
agggaagaggaaggagaaag

SEQ ID NO: 37231 - RNA, 21 nt, Artificial Sequence
  Synthetic
aagggaagaggaaggagaaag

SEQ ID NO: 37232 - RNA, 22 nt, Artificial Sequence
  Synthetic
gaagggaagaggaaggagaaag

SEQ ID NO: 37233 - RNA, 23 nt, Artificial Sequence
  Synthetic
ggaagggaagaggaaggagaaag

SEQ ID NO: 37234 - RNA, 24 nt, Artificial Sequence
  Synthetic
uggaagggaagaggaaggagaaag

SEQ ID NO: 37235 - RNA, 18 nt, Artificial Sequence
  Synthetic
ccucguguuucuugaaag

SEQ ID NO: 37236 - RNA, 19 nt, Artificial Sequence
  Synthetic
gccucguguuucuugaaag

SEQ ID NO: 37237 - RNA, 20 nt, Artificial Sequence
  Synthetic
cgccucguguuucuugaaag

SEQ ID NO: 37238 - RNA, 21 nt, Artificial Sequence
  Synthetic
ccgccucguguuucuugaaag

SEQ ID NO: 37239 - RNA, 22 nt, Artificial Sequence
  Synthetic
cccgccucguguuucuugaaag

SEQ ID NO: 37240 - RNA, 23 nt, Artificial Sequence
  Synthetic
ccccgccucguguuucuugaaag

SEQ ID NO: 37241 - RNA, 24 nt, Artificial Sequence
  Synthetic
cccccgccucguguuucuugaaag

SEQ ID NO: 37242 - RNA, 18 nt, Artificial Sequence
  Synthetic
guggaagggaagaggaag

SEQ ID NO: 37243 - RNA, 19 nt, Artificial Sequence
  Synthetic
gguggaagggaagaggaag

SEQ ID NO: 37244 - RNA, 20 nt, Artificial Sequence
  Synthetic
ggguggaagggaagaggaag

SEQ ID NO: 37245 - RNA, 21 nt, Artificial Sequence
  Synthetic
uggguggaagggaagaggaag

SEQ ID NO: 37246 - RNA, 22 nt, Artificial Sequence
  Synthetic
guggguggaagggaagaggaag

SEQ ID NO: 37247 - RNA, 23 nt, Artificial Sequence
  Synthetic
gguggguggaagggaagaggaag

SEQ ID NO: 37248 - RNA, 24 nt, Artificial Sequence
  Synthetic
ggguggguggaagggaagaggaag

SEQ ID NO: 37249 - RNA, 18 nt, Artificial Sequence
  Synthetic
ggguggguggaagggaag

SEQ ID NO: 37250 - RNA, 19 nt, Artificial Sequence
  Synthetic
gggguggguggaagggaag

SEQ ID NO: 37251 - RNA, 20 nt, Artificial Sequence
  Synthetic
ggggguggguggaagggaag

SEQ ID NO: 37252 - RNA, 21 nt, Artificial Sequence
  Synthetic
cggggguggguggaagggaag

SEQ ID NO: 37253 - RNA, 22 nt, Artificial Sequence
  Synthetic
acggggguggguggaagggaag

SEQ ID NO: 37254 - RNA, 23 nt, Artificial Sequence
  Synthetic
aacggggguggguggaagggaag

SEQ ID NO: 37255 - RNA, 24 nt, Artificial Sequence
  Synthetic
aaacggggguggguggaagggaag

SEQ ID NO: 37256 - RNA, 18 nt, Artificial Sequence
  Synthetic
cucuccccgccgccucag

SEQ ID NO: 37257 - RNA, 19 nt, Artificial Sequence
  Synthetic
ccucuccccgccgccucag

SEQ ID NO: 37258 - RNA, 20 nt, Artificial Sequence
  Synthetic
cccucuccccgccgccucag

SEQ ID NO: 37259 - RNA, 21 nt, Artificial Sequence
  Synthetic
ccccucuccccgccgccucag

SEQ ID NO: 37260 - RNA, 22 nt, Artificial Sequence
  Synthetic
cccccucuccccgccgccucag

SEQ ID NO: 37261 - RNA, 23 nt, Artificial Sequence
  Synthetic
ccccccucuccccgccgccucag

SEQ ID NO: 37262 - RNA, 24 nt, Artificial Sequence
  Synthetic
cccccccucuccccgccgccucag

SEQ ID NO: 37263 - RNA, 18 nt, Artificial Sequence
  Synthetic
cccgcgcccacgcgguag

SEQ ID NO: 37264 - RNA, 19 nt, Artificial Sequence
  Synthetic
gcccgcgcccacgcgguag

SEQ ID NO: 37265 - RNA, 20 nt, Artificial Sequence
  Synthetic
cgcccgcgcccacgcgguag

SEQ ID NO: 37266 - RNA, 21 nt, Artificial Sequence
  Synthetic
ccgcccgcgcccacgcgguag

SEQ ID NO: 37267 - RNA, 22 nt, Artificial Sequence
  Synthetic
cccgcccgcgcccacgcgguag

SEQ ID NO: 37268 - RNA, 23 nt, Artificial Sequence
  Synthetic
ccccgcccgcgcccacgcgguag

SEQ ID NO: 37269 - RNA, 24 nt, Artificial Sequence
  Synthetic
cccccgcccgcgcccacgcgguag

SEQ ID NO: 37270 - RNA, 18 nt, Artificial Sequence
  Synthetic
gcccccccgggaacgacg

SEQ ID NO: 37271 - RNA, 19 nt, Artificial Sequence
  Synthetic
ugcccccccgggaacgacg

SEQ ID NO: 37272 - RNA, 20 nt, Artificial Sequence
  Synthetic
cugcccccccgggaacgacg

SEQ ID NO: 37273 - RNA, 21 nt, Artificial Sequence
  Synthetic
ccugcccccccgggaacgacg

SEQ ID NO: 37274 - RNA, 22 nt, Artificial Sequence
  Synthetic
gccugcccccccgggaacgacg

SEQ ID NO: 37275 - RNA, 23 nt, Artificial Sequence
  Synthetic
cgccugcccccccgggaacgacg

SEQ ID NO: 37276 - RNA, 24 nt, Artificial Sequence
  Synthetic
gcgccugcccccccgggaacgacg

SEQ ID NO: 37277 - RNA, 18 nt, Artificial Sequence
  Synthetic
cccccgggaacgacgacg

SEQ ID NO: 37278 - RNA, 19 nt, Artificial Sequence
  Synthetic
ccccccgggaacgacgacg

SEQ ID NO: 37279 - RNA, 20 nt, Artificial Sequence
  Synthetic
cccccccgggaacgacgacg

SEQ ID NO: 37280 - RNA, 21 nt, Artificial Sequence
  Synthetic
gcccccccgggaacgacgacg

SEQ ID NO: 37281 - RNA, 22 nt, Artificial Sequence
  Synthetic
ugcccccccgggaacgacgacg

SEQ ID NO: 37282 - RNA, 23 nt, Artificial Sequence
  Synthetic
cugcccccccgggaacgacgacg

SEQ ID NO: 37283 - RNA, 24 nt, Artificial Sequence
  Synthetic
ccugcccccccgggaacgacgacg

SEQ ID NO: 37284 - RNA, 18 nt, Artificial Sequence
  Synthetic
gggggggugaccggcgcg

SEQ ID NO: 37285 - RNA, 19 nt, Artificial Sequence
  Synthetic
ggggggggugaccggcgcg

SEQ ID NO: 37286 - RNA, 20 nt, Artificial Sequence
  Synthetic
gggggggggugaccggcgcg

SEQ ID NO: 37287 - RNA, 21 nt, Artificial Sequence
  Synthetic
ugggggggggugaccggcgcg

SEQ ID NO: 37288 - RNA, 22 nt, Artificial Sequence
  Synthetic
uugggggggggugaccggcgcg

SEQ ID NO: 37289 - RNA, 23 nt, Artificial Sequence
  Synthetic
guugggggggggugaccggcgcg

SEQ ID NO: 37290 - RNA, 24 nt, Artificial Sequence
  Synthetic
uguugggggggggugaccggcgcg

SEQ ID NO: 37291 - RNA, 18 nt, Artificial Sequence
  Synthetic
gaccggcgcgugggggcg

SEQ ID NO: 37292 - RNA, 19 nt, Artificial Sequence
  Synthetic
ugaccggcgcgugggggcg

SEQ ID NO: 37293 - RNA, 20 nt, Artificial Sequence
  Synthetic
gugaccggcgcgugggggcg

SEQ ID NO: 37294 - RNA, 21 nt, Artificial Sequence
  Synthetic
ggugaccggcgcgugggggcg

SEQ ID NO: 37295 - RNA, 22 nt, Artificial Sequence
  Synthetic
gggugaccggcgcgugggggcg

SEQ ID NO: 37296 - RNA, 23 nt, Artificial Sequence
  Synthetic
ggggugaccggcgcgugggggcg

SEQ ID NO: 37297 - RNA, 24 nt, Artificial Sequence
  Synthetic
gggggugaccggcgcgugggggcg

SEQ ID NO: 37298 - RNA, 18 nt, Artificial Sequence
  Synthetic
cucguguuucuugaaagg

SEQ ID NO: 37299 - RNA, 19 nt, Artificial Sequence
  Synthetic
ccucguguuucuugaaagg

SEQ ID NO: 37300 - RNA, 20 nt, Artificial Sequence
  Synthetic
gccucguguuucuugaaagg

SEQ ID NO: 37301 - RNA, 21 nt, Artificial Sequence
  Synthetic
cgccucguguuucuugaaagg

SEQ ID NO: 37302 - RNA, 22 nt, Artificial Sequence
  Synthetic
ccgccucguguuucuugaaagg

SEQ ID NO: 37303 - RNA, 23 nt, Artificial Sequence
  Synthetic
cccgccucguguuucuugaaagg

SEQ ID NO: 37304 - RNA, 24 nt, Artificial Sequence
  Synthetic
ccccgccucguguuucuugaaagg

SEQ ID NO: 37305 - RNA, 18 nt, Artificial Sequence
  Synthetic
uggguggaagggaagagg

SEQ ID NO: 37306 - RNA, 19 nt, Artificial Sequence
  Synthetic
guggguggaagggaagagg

SEQ ID NO: 37307 - RNA, 20 nt, Artificial Sequence
  Synthetic
gguggguggaagggaagagg

SEQ ID NO: 37308 - RNA, 21 nt, Artificial Sequence
  Synthetic
ggguggguggaagggaagagg

SEQ ID NO: 37309 - RNA, 22 nt, Artificial Sequence
  Synthetic
gggguggguggaagggaagagg

SEQ ID NO: 37310 - RNA, 23 nt, Artificial Sequence
  Synthetic
ggggguggguggaagggaagagg

SEQ ID NO: 37311 - RNA, 24 nt, Artificial Sequence
  Synthetic
cggggguggguggaagggaagagg

SEQ ID NO: 37312 - RNA, 18 nt, Artificial Sequence
  Synthetic
gcgcccacgcgguagagg

SEQ ID NO: 37313 - RNA, 19 nt, Artificial Sequence
  Synthetic
cgcgcccacgcgguagagg

SEQ ID NO: 37314 - RNA, 20 nt, Artificial Sequence
  Synthetic
ccgcgcccacgcgguagagg

SEQ ID NO: 37315 - RNA, 21 nt, Artificial Sequence
  Synthetic
cccgcgcccacgcgguagagg

SEQ ID NO: 37316 - RNA, 22 nt, Artificial Sequence
  Synthetic
gcccgcgcccacgcgguagagg

SEQ ID NO: 37317 - RNA, 23 nt, Artificial Sequence
  Synthetic
cgcccgcgcccacgcgguagagg

SEQ ID NO: 37318 - RNA, 24 nt, Artificial Sequence
  Synthetic
ccgcccgcgcccacgcgguagagg

SEQ ID NO: 37319 - RNA, 18 nt, Artificial Sequence
  Synthetic
uuucuugaaagggggagg

SEQ ID NO: 37320 - RNA, 19 nt, Artificial Sequence
  Synthetic
guuucuugaaagggggagg

SEQ ID NO: 37321 - RNA, 20 nt, Artificial Sequence
  Synthetic
uguuucuugaaagggggagg

SEQ ID NO: 37322 - RNA, 21 nt, Artificial Sequence
  Synthetic
guguuucuugaaagggggagg

SEQ ID NO: 37323 - RNA, 22 nt, Artificial Sequence
  Synthetic
cguguuucuugaaagggggagg

SEQ ID NO: 37324 - RNA, 23 nt, Artificial Sequence
  Synthetic
ucguguuucuugaaagggggagg

SEQ ID NO: 37325 - RNA, 24 nt, Artificial Sequence
  Synthetic
cucguguuucuugaaagggggagg

SEQ ID NO: 37326 - RNA, 18 nt, Artificial Sequence
  Synthetic
ccccgggaacgacgacgg

SEQ ID NO: 37327 - RNA, 19 nt, Artificial Sequence
  Synthetic
cccccgggaacgacgacgg

SEQ ID NO: 37328 - RNA, 20 nt, Artificial Sequence
  Synthetic
ccccccgggaacgacgacgg

SEQ ID NO: 37329 - RNA, 21 nt, Artificial Sequence
  Synthetic
cccccccgggaacgacgacgg

SEQ ID NO: 37330 - RNA, 22 nt, Artificial Sequence
  Synthetic
gcccccccgggaacgacgacgg

SEQ ID NO: 37331 - RNA, 23 nt, Artificial Sequence
  Synthetic
ugcccccccgggaacgacgacgg

SEQ ID NO: 37332 - RNA, 24 nt, Artificial Sequence
  Synthetic
cugcccccccgggaacgacgacgg

SEQ ID NO: 37333 - RNA, 18 nt, Artificial Sequence
  Synthetic
ccgcccgcgcccacgcgg

SEQ ID NO: 37334 - RNA, 19 nt, Artificial Sequence
  Synthetic
cccgcccgcgcccacgcgg

SEQ ID NO: 37335 - RNA, 20 nt, Artificial Sequence
  Synthetic
ccccgcccgcgcccacgcgg

SEQ ID NO: 37336 - RNA, 21 nt, Artificial Sequence
  Synthetic
cccccgcccgcgcccacgcgg

SEQ ID NO: 37337 - RNA, 22 nt, Artificial Sequence
  Synthetic
ccccccgcccgcgcccacgcgg

SEQ ID NO: 37338 - RNA, 23 nt, Artificial Sequence
  Synthetic
cccccccgcccgcgcccacgcgg

SEQ ID NO: 37339 - RNA, 24 nt, Artificial Sequence
  Synthetic
acccccccgcccgcgcccacgcgg

SEQ ID NO: 37340 - RNA, 18 nt, Artificial Sequence
  Synthetic
cggggguggguggaaggg

SEQ ID NO: 37341 - RNA, 19 nt, Artificial Sequence
  Synthetic
acggggguggguggaaggg

SEQ ID NO: 37342 - RNA, 20 nt, Artificial Sequence
  Synthetic
aacggggguggguggaaggg

SEQ ID NO: 37343 - RNA, 21 nt, Artificial Sequence
  Synthetic
aaacggggguggguggaaggg

SEQ ID NO: 37344 - RNA, 22 nt, Artificial Sequence
  Synthetic
gaaacggggguggguggaaggg

SEQ ID NO: 37345 - RNA, 23 nt, Artificial Sequence
  Synthetic
ggaaacggggguggguggaaggg

SEQ ID NO: 37346 - RNA, 24 nt, Artificial Sequence
  Synthetic
gggaaacggggguggguggaaggg

SEQ ID NO: 37347 - RNA, 18 nt, Artificial Sequence
  Synthetic
cccgggaacgacgacggg

SEQ ID NO: 37348 - RNA, 19 nt, Artificial Sequence
  Synthetic
ccccgggaacgacgacggg

SEQ ID NO: 37349 - RNA, 20 nt, Artificial Sequence
  Synthetic
cccccgggaacgacgacggg

SEQ ID NO: 37350 - RNA, 21 nt, Artificial Sequence
  Synthetic
ccccccgggaacgacgacggg

SEQ ID NO: 37351 - RNA, 22 nt, Artificial Sequence
  Synthetic
cccccccgggaacgacgacggg

SEQ ID NO: 37352 - RNA, 23 nt, Artificial Sequence
  Synthetic
gcccccccgggaacgacgacggg

SEQ ID NO: 37353 - RNA, 24 nt, Artificial Sequence
  Synthetic
ugcccccccgggaacgacgacggg

SEQ ID NO: 37354 - RNA, 18 nt, Artificial Sequence
  Synthetic
cguguuucuugaaagggg

SEQ ID NO: 37355 - RNA, 19 nt, Artificial Sequence
  Synthetic
ucguguuucuugaaagggg

SEQ ID NO: 37356 - RNA, 20 nt, Artificial Sequence
  Synthetic
cucguguuucuugaaagggg

SEQ ID NO: 37357 - RNA, 21 nt, Artificial Sequence
  Synthetic
ccucguguuucuugaaagggg

SEQ ID NO: 37358 - RNA, 22 nt, Artificial Sequence
  Synthetic
gccucguguuucuugaaagggg

SEQ ID NO: 37359 - RNA, 23 nt, Artificial Sequence
  Synthetic
cgccucguguuucuugaaagggg

SEQ ID NO: 37360 - RNA, 24 nt, Artificial Sequence
  Synthetic
ccgccucguguuucuugaaagggg

SEQ ID NO: 37361 - RNA, 18 nt, Artificial Sequence
  Synthetic
acgcgguagaggaagggg

SEQ ID NO: 37362 - RNA, 19 nt, Artificial Sequence
  Synthetic
cacgcgguagaggaagggg

SEQ ID NO: 37363 - RNA, 20 nt, Artificial Sequence
  Synthetic
ccacgcgguagaggaagggg

SEQ ID NO: 37364 - RNA, 21 nt, Artificial Sequence
  Synthetic
cccacgcgguagaggaagggg

SEQ ID NO: 37365 - RNA, 22 nt, Artificial Sequence
  Synthetic
gcccacgcgguagaggaagggg

SEQ ID NO: 37366 - RNA, 23 nt, Artificial Sequence
  Synthetic
cgcccacgcgguagaggaagggg

SEQ ID NO: 37367 - RNA, 24 nt, Artificial Sequence
  Synthetic
gcgcccacgcgguagaggaagggg

SEQ ID NO: 37368 - RNA, 18 nt, Artificial Sequence
  Synthetic
ccgggaacgacgacgggg

SEQ ID NO: 37369 - RNA, 19 nt, Artificial Sequence
  Synthetic
cccgggaacgacgacgggg

SEQ ID NO: 37370 - RNA, 20 nt, Artificial Sequence
  Synthetic
ccccgggaacgacgacgggg

SEQ ID NO: 37371 - RNA, 21 nt, Artificial Sequence
  Synthetic
cccccgggaacgacgacgggg

SEQ ID NO: 37372 - RNA, 22 nt, Artificial Sequence
  Synthetic
ccccccgggaacgacgacgggg

SEQ ID NO: 37373 - RNA, 23 nt, Artificial Sequence
  Synthetic
cccccccgggaacgacgacgggg

SEQ ID NO: 37374 - RNA, 24 nt, Artificial Sequence
  Synthetic
gcccccccgggaacgacgacgggg

SEQ ID NO: 37375 - RNA, 18 nt, Artificial Sequence
  Synthetic
guguuucuugaaaggggg

SEQ ID NO: 37376 - RNA, 19 nt, Artificial Sequence
  Synthetic
cguguuucuugaaaggggg

SEQ ID NO: 37377 - RNA, 20 nt, Artificial Sequence
  Synthetic
ucguguuucuugaaaggggg

SEQ ID NO: 37378 - RNA, 21 nt, Artificial Sequence
  Synthetic
cucguguuucuugaaaggggg

SEQ ID NO: 37379 - RNA, 22 nt, Artificial Sequence
  Synthetic
ccucguguuucuugaaaggggg

SEQ ID NO: 37380 - RNA, 23 nt, Artificial Sequence
  Synthetic
gccucguguuucuugaaaggggg

SEQ ID NO: 37381 - RNA, 24 nt, Artificial Sequence
  Synthetic
cgccucguguuucuugaaaggggg

SEQ ID NO: 37382 - RNA, 18 nt, Artificial Sequence
  Synthetic
cgggaacgacgacggggg

SEQ ID NO: 37383 - RNA, 19 nt, Artificial Sequence
  Synthetic
ccgggaacgacgacggggg

SEQ ID NO: 37384 - RNA, 20 nt, Artificial Sequence
  Synthetic
cccgggaacgacgacggggg

SEQ ID NO: 37385 - RNA, 21 nt, Artificial Sequence
  Synthetic
ccccgggaacgacgacggggg

SEQ ID NO: 37386 - RNA, 22 nt, Artificial Sequence
  Synthetic
cccccgggaacgacgacggggg

SEQ ID NO: 37387 - RNA, 23 nt, Artificial Sequence
  Synthetic
ccccccgggaacgacgacggggg

SEQ ID NO: 37388 - RNA, 24 nt, Artificial Sequence
  Synthetic
cccccccgggaacgacgacggggg

SEQ ID NO: 37389 - RNA, 18 nt, Artificial Sequence
  Synthetic
gggaacgacgacgggggg

SEQ ID NO: 37390 - RNA, 19 nt, Artificial Sequence
  Synthetic
cgggaacgacgacgggggg

SEQ ID NO: 37391 - RNA, 20 nt, Artificial Sequence
  Synthetic
ccgggaacgacgacgggggg

SEQ ID NO: 37392 - RNA, 21 nt, Artificial Sequence
  Synthetic
cccgggaacgacgacgggggg

SEQ ID NO: 37393 - RNA, 22 nt, Artificial Sequence
  Synthetic
ccccgggaacgacgacgggggg

SEQ ID NO: 37394 - RNA, 23 nt, Artificial Sequence
  Synthetic
cccccgggaacgacgacgggggg

SEQ ID NO: 37395 - RNA, 24 nt, Artificial Sequence
  Synthetic
ccccccgggaacgacgacgggggg

SEQ ID NO: 37396 - RNA, 18 nt, Artificial Sequence
  Synthetic
ggaacgacgacggggggg

SEQ ID NO: 37397 - RNA, 19 nt, Artificial Sequence
  Synthetic
gggaacgacgacggggggg

SEQ ID NO: 37398 - RNA, 20 nt, Artificial Sequence
  Synthetic
cgggaacgacgacggggggg

SEQ ID NO: 37399 - RNA, 21 nt, Artificial Sequence
  Synthetic
ccgggaacgacgacggggggg

SEQ ID NO: 37400 - RNA, 22 nt, Artificial Sequence
  Synthetic
cccgggaacgacgacggggggg

SEQ ID NO: 37401 - RNA, 23 nt, Artificial Sequence
  Synthetic
ccccgggaacgacgacggggggg

SEQ ID NO: 37402 - RNA, 24 nt, Artificial Sequence
  Synthetic
cccccgggaacgacgacggggggg

SEQ ID NO: 37403 - RNA, 18 nt, Artificial Sequence
  Synthetic
gaacgacgacgggggggg

SEQ ID NO: 37404 - RNA, 19 nt, Artificial Sequence
  Synthetic
ggaacgacgacgggggggg

SEQ ID NO: 37405 - RNA, 20 nt, Artificial Sequence
  Synthetic
gggaacgacgacgggggggg

SEQ ID NO: 37406 - RNA, 21 nt, Artificial Sequence
  Synthetic
cgggaacgacgacgggggggg

SEQ ID NO: 37407 - RNA, 22 nt, Artificial Sequence
  Synthetic
ccgggaacgacgacgggggggg

SEQ ID NO: 37408 - RNA, 23 nt, Artificial Sequence
  Synthetic
cccgggaacgacgacgggggggg

SEQ ID NO: 37409 - RNA, 24 nt, Artificial Sequence
  Synthetic
ccccgggaacgacgacgggggggg

SEQ ID NO: 37410 - RNA, 18 nt, Artificial Sequence
  Synthetic
gggggaaacggggguggg

SEQ ID NO: 37411 - RNA, 19 nt, Artificial Sequence
  Synthetic
ggggggaaacggggguggg

SEQ ID NO: 37412 - RNA, 20 nt, Artificial Sequence
  Synthetic
gggggggaaacggggguggg

SEQ ID NO: 37413 - RNA, 21 nt, Artificial Sequence
  Synthetic
ggggggggaaacggggguggg

SEQ ID NO: 37414 - RNA, 22 nt, Artificial Sequence
  Synthetic
gggggggggaaacggggguggg

SEQ ID NO: 37415 - RNA, 23 nt, Artificial Sequence
  Synthetic
ggggggggggaaacggggguggg

SEQ ID NO: 37416 - RNA, 24 nt, Artificial Sequence
  Synthetic
gggggggggggaaacggggguggg

SEQ ID NO: 37417 - RNA, 18 nt, Artificial Sequence
  Synthetic
gccuuugggguuguuggg

SEQ ID NO: 37418 - RNA, 19 nt, Artificial Sequence
  Synthetic
cgccuuugggguuguuggg

SEQ ID NO: 37419 - RNA, 20 nt, Artificial Sequence
  Synthetic
gcgccuuugggguuguuggg

SEQ ID NO: 37420 - RNA, 21 nt, Artificial Sequence
  Synthetic
cgcgccuuugggguuguuggg

SEQ ID NO: 37421 - RNA, 22 nt, Artificial Sequence
  Synthetic
acgcgccuuugggguuguuggg

SEQ ID NO: 37422 - RNA, 23 nt, Artificial Sequence
  Synthetic
cacgcgccuuugggguuguuggg

SEQ ID NO: 37423 - RNA, 24 nt, Artificial Sequence
  Synthetic
gcacgcgccuuugggguuguuggg

SEQ ID NO: 37424 - RNA, 18 nt, Artificial Sequence
  Synthetic
ggggggaaacgggggugg

SEQ ID NO: 37425 - RNA, 19 nt, Artificial Sequence
  Synthetic
gggggggaaacgggggugg

SEQ ID NO: 37426 - RNA, 20 nt, Artificial Sequence
  Synthetic
ggggggggaaacgggggugg

SEQ ID NO: 37427 - RNA, 21 nt, Artificial Sequence
  Synthetic
gggggggggaaacgggggugg

SEQ ID NO: 37428 - RNA, 22 nt, Artificial Sequence
  Synthetic
ggggggggggaaacgggggugg

SEQ ID NO: 37429 - RNA, 23 nt, Artificial Sequence
  Synthetic
gggggggggggaaacgggggugg

SEQ ID NO: 37430 - RNA, 24 nt, Artificial Sequence
  Synthetic
cgggggggggggaaacgggggugg

SEQ ID NO: 37431 - RNA, 18 nt, Artificial Sequence
  Synthetic
ggaaacgggggugggugg

SEQ ID NO: 37432 - RNA, 19 nt, Artificial Sequence
  Synthetic
gggaaacgggggugggugg

SEQ ID NO: 37433 - RNA, 20 nt, Artificial Sequence
  Synthetic
ggggaaacgggggugggugg

SEQ ID NO: 37434 - RNA, 21 nt, Artificial Sequence
  Synthetic
gggggaaacgggggugggugg

SEQ ID NO: 37435 - RNA, 22 nt, Artificial Sequence
  Synthetic
ggggggaaacgggggugggugg

SEQ ID NO: 37436 - RNA, 23 nt, Artificial Sequence
  Synthetic
gggggggaaacgggggugggugg

SEQ ID NO: 37437 - RNA, 24 nt, Artificial Sequence
  Synthetic
ggggggggaaacgggggugggugg

SEQ ID NO: 37438 - RNA, 18 nt, Artificial Sequence
  Synthetic
ccacacccacggcugugg

SEQ ID NO: 37439 - RNA, 19 nt, Artificial Sequence
  Synthetic
gccacacccacggcugugg

SEQ ID NO: 37440 - RNA, 20 nt, Artificial Sequence
  Synthetic
cgccacacccacggcugugg

SEQ ID NO: 37441 - RNA, 21 nt, Artificial Sequence
  Synthetic
gcgccacacccacggcugugg

SEQ ID NO: 37442 - RNA, 22 nt, Artificial Sequence
  Synthetic
ggcgccacacccacggcugugg

SEQ ID NO: 37443 - RNA, 23 nt, Artificial Sequence
  Synthetic
gggcgccacacccacggcugugg

SEQ ID NO: 37444 - RNA, 24 nt, Artificial Sequence
  Synthetic
cgggcgccacacccacggcugugg

SEQ ID NO: 37445 - RNA, 18 nt, Artificial Sequence
  Synthetic
cgccuuugggguuguugg

SEQ ID NO: 37446 - RNA, 19 nt, Artificial Sequence
  Synthetic
gcgccuuugggguuguugg

SEQ ID NO: 37447 - RNA, 20 nt, Artificial Sequence
  Synthetic
cgcgccuuugggguuguugg

SEQ ID NO: 37448 - RNA, 21 nt, Artificial Sequence
  Synthetic
acgcgccuuugggguuguugg

SEQ ID NO: 37449 - RNA, 22 nt, Artificial Sequence
  Synthetic
cacgcgccuuugggguuguugg

SEQ ID NO: 37450 - RNA, 23 nt, Artificial Sequence
  Synthetic
gcacgcgccuuugggguuguugg

SEQ ID NO: 37451 - RNA, 24 nt, Artificial Sequence
  Synthetic
ggcacgcgccuuugggguuguugg

SEQ ID NO: 37452 - RNA, 18 nt, Artificial Sequence
  Synthetic
cacgcgccuuugggguug

SEQ ID NO: 37453 - RNA, 19 nt, Artificial Sequence
  Synthetic
gcacgcgccuuugggguug

SEQ ID NO: 37454 - RNA, 20 nt, Artificial Sequence
  Synthetic
ggcacgcgccuuugggguug

SEQ ID NO: 37455 - RNA, 21 nt, Artificial Sequence
  Synthetic
gggcacgcgccuuugggguug

SEQ ID NO: 37456 - RNA, 22 nt, Artificial Sequence
  Synthetic
cgggcacgcgccuuugggguug

SEQ ID NO: 37457 - RNA, 23 nt, Artificial Sequence
  Synthetic
ccgggcacgcgccuuugggguug

SEQ ID NO: 37458 - RNA, 24 nt, Artificial Sequence
  Synthetic
gccgggcacgcgccuuugggguug

SEQ ID NO: 37459 - RNA, 18 nt, Artificial Sequence
  Synthetic
gcgccuuugggguuguug

SEQ ID NO: 37460 - RNA, 19 nt, Artificial Sequence
  Synthetic
cgcgccuuugggguuguug

SEQ ID NO: 37461 - RNA, 20 nt, Artificial Sequence
  Synthetic
acgcgccuuugggguuguug

SEQ ID NO: 37462 - RNA, 21 nt, Artificial Sequence
  Synthetic
cacgcgccuuugggguuguug

SEQ ID NO: 37463 - RNA, 22 nt, Artificial Sequence
  Synthetic
gcacgcgccuuugggguuguug

SEQ ID NO: 37464 - RNA, 23 nt, Artificial Sequence
  Synthetic
ggcacgcgccuuugggguuguug

SEQ ID NO: 37465 - RNA, 24 nt, Artificial Sequence
  Synthetic
gggcacgcgccuuugggguuguug

SEQ ID NO: 37466 - RNA, 18 nt, Artificial Sequence
  Synthetic
gagaaaggggggguggau

SEQ ID NO: 37467 - RNA, 19 nt, Artificial Sequence
  Synthetic
ggagaaaggggggguggau

SEQ ID NO: 37468 - RNA, 20 nt, Artificial Sequence
  Synthetic
aggagaaaggggggguggau

SEQ ID NO: 37469 - RNA, 21 nt, Artificial Sequence
  Synthetic
aaggagaaaggggggguggau

SEQ ID NO: 37470 - RNA, 22 nt, Artificial Sequence
  Synthetic
gaaggagaaaggggggguggau

SEQ ID NO: 37471 - RNA, 23 nt, Artificial Sequence
  Synthetic
ggaaggagaaaggggggguggau

SEQ ID NO: 37472 - RNA, 24 nt, Artificial Sequence
  Synthetic
aggaaggagaaaggggggguggau

SEQ ID NO: 37473 - RNA, 18 nt, Artificial Sequence
  Synthetic
guggccgggcacgcgccu

SEQ ID NO: 37474 - RNA, 19 nt, Artificial Sequence
  Synthetic
uguggccgggcacgcgccu

SEQ ID NO: 37475 - RNA, 20 nt, Artificial Sequence
  Synthetic
cuguggccgggcacgcgccu

SEQ ID NO: 37476 - RNA, 21 nt, Artificial Sequence
  Synthetic
gcuguggccgggcacgcgccu

SEQ ID NO: 37477 - RNA, 22 nt, Artificial Sequence
  Synthetic
ggcuguggccgggcacgcgccu

SEQ ID NO: 37478 - RNA, 23 nt, Artificial Sequence
  Synthetic
cggcuguggccgggcacgcgccu

SEQ ID NO: 37479 - RNA, 24 nt, Artificial Sequence
  Synthetic
acggcuguggccgggcacgcgccu

SEQ ID NO: 37480 - RNA, 18 nt, Artificial Sequence
  Synthetic
ggggggugaccggcgcgu

SEQ ID NO: 37481 - RNA, 19 nt, Artificial Sequence
  Synthetic
gggggggugaccggcgcgu

SEQ ID NO: 37482 - RNA, 20 nt, Artificial Sequence
  Synthetic
ggggggggugaccggcgcgu

SEQ ID NO: 37483 - RNA, 21 nt, Artificial Sequence
  Synthetic
gggggggggugaccggcgcgu

SEQ ID NO: 37484 - RNA, 22 nt, Artificial Sequence
  Synthetic
ugggggggggugaccggcgcgu

SEQ ID NO: 37485 - RNA, 23 nt, Artificial Sequence
  Synthetic
uugggggggggugaccggcgcgu

SEQ ID NO: 37486 - RNA, 24 nt, Artificial Sequence
  Synthetic
guugggggggggugaccggcgcgu

SEQ ID NO: 37487 - RNA, 18 nt, Artificial Sequence
  Synthetic
cgugggggcggugggcgu

SEQ ID NO: 37488 - RNA, 19 nt, Artificial Sequence
  Synthetic
gcgugggggcggugggcgu

SEQ ID NO: 37489 - RNA, 20 nt, Artificial Sequence
  Synthetic
cgcgugggggcggugggcgu

SEQ ID NO: 37490 - RNA, 21 nt, Artificial Sequence
  Synthetic
gcgcgugggggcggugggcgu

SEQ ID NO: 37491 - RNA, 22 nt, Artificial Sequence
  Synthetic
ggcgcgugggggcggugggcgu

SEQ ID NO: 37492 - RNA, 23 nt, Artificial Sequence
  Synthetic
cggcgcgugggggcggugggcgu

SEQ ID NO: 37493 - RNA, 24 nt, Artificial Sequence
  Synthetic
ccggcgcgugggggcggugggcgu

SEQ ID NO: 37494 - RNA, 18 nt, Artificial Sequence
  Synthetic
acgcgccuuugggguugu

SEQ ID NO: 37495 - RNA, 19 nt, Artificial Sequence
  Synthetic
cacgcgccuuugggguugu

SEQ ID NO: 37496 - RNA, 20 nt, Artificial Sequence
  Synthetic
gcacgcgccuuugggguugu

SEQ ID NO: 37497 - RNA, 21 nt, Artificial Sequence
  Synthetic
ggcacgcgccuuugggguugu

SEQ ID NO: 37498 - RNA, 22 nt, Artificial Sequence
  Synthetic
gggcacgcgccuuugggguugu

SEQ ID NO: 37499 - RNA, 23 nt, Artificial Sequence
  Synthetic
cgggcacgcgccuuugggguugu

SEQ ID NO: 37500 - RNA, 24 nt, Artificial Sequence
  Synthetic
ccgggcacgcgccuuugggguugu

SEQ ID NO: 37501 - RNA, 18 nt, Artificial Sequence
  Synthetic
cgcgccuuugggguuguu

SEQ ID NO: 37502 - RNA, 19 nt, Artificial Sequence
  Synthetic
acgcgccuuugggguuguu

SEQ ID NO: 37503 - RNA, 20 nt, Artificial Sequence
  Synthetic
cacgcgccuuugggguuguu

SEQ ID NO: 37504 - RNA, 21 nt, Artificial Sequence
  Synthetic
gcacgcgccuuugggguuguu

SEQ ID NO: 37505 - RNA, 22 nt, Artificial Sequence
  Synthetic
ggcacgcgccuuugggguuguu

SEQ ID NO: 37506 - RNA, 23 nt, Artificial Sequence
  Synthetic
gggcacgcgccuuugggguuguu

SEQ ID NO: 37507 - RNA, 24 nt, Artificial Sequence
  Synthetic
cgggcacgcgccuuugggguuguu

SEQ ID NO: 37508 - RNA, 18 nt, Artificial Sequence
  Synthetic
cugaccugccugcccuuu

SEQ ID NO: 37509 - RNA, 19 nt, Artificial Sequence
  Synthetic
gcugaccugccugcccuuu

SEQ ID NO: 37510 - RNA, 20 nt, Artificial Sequence
  Synthetic
ggcugaccugccugcccuuu

SEQ ID NO: 37511 - RNA, 21 nt, Artificial Sequence
  Synthetic
cggcugaccugccugcccuuu

SEQ ID NO: 37512 - RNA, 22 nt, Artificial Sequence
  Synthetic
gcggcugaccugccugcccuuu

SEQ ID NO: 37513 - RNA, 23 nt, Artificial Sequence
  Synthetic
ugcggcugaccugccugcccuuu

SEQ ID NO: 37514 - RNA, 24 nt, Artificial Sequence
  Synthetic
gugcggcugaccugccugcccuuu

SEQ ID NO: 37515 - RNA, 18 nt, Artificial Sequence
  Synthetic
ggcgggcggaagagagaa

SEQ ID NO: 37516 - RNA, 19 nt, Artificial Sequence
  Synthetic
gggcgggcggaagagagaa

SEQ ID NO: 37517 - RNA, 20 nt, Artificial Sequence
  Synthetic
ggggcgggcggaagagagaa

SEQ ID NO: 37518 - RNA, 21 nt, Artificial Sequence
  Synthetic
gggggcgggcggaagagagaa

SEQ ID NO: 37519 - RNA, 22 nt, Artificial Sequence
  Synthetic
ggggggcgggcggaagagagaa

SEQ ID NO: 37520 - RNA, 23 nt, Artificial Sequence
  Synthetic
gggggggcgggcggaagagagaa

SEQ ID NO: 37521 - RNA, 24 nt, Artificial Sequence
  Synthetic
ggggggggcgggcggaagagagaa

SEQ ID NO: 37522 - RNA, 18 nt, Artificial Sequence
  Synthetic
gggggggggcgggcggaa

SEQ ID NO: 37523 - RNA, 19 nt, Artificial Sequence
  Synthetic
ggggggggggcgggcggaa

SEQ ID NO: 37524 - RNA, 20 nt, Artificial Sequence
  Synthetic
gggggggggggcgggcggaa

SEQ ID NO: 37525 - RNA, 21 nt, Artificial Sequence
  Synthetic
agggggggggggcgggcggaa

SEQ ID NO: 37526 - RNA, 22 nt, Artificial Sequence
  Synthetic
gagggggggggggcgggcggaa

SEQ ID NO: 37527 - RNA, 23 nt, Artificial Sequence
  Synthetic
agagggggggggggcgggcggaa

SEQ ID NO: 37528 - RNA, 24 nt, Artificial Sequence
  Synthetic
gagagggggggggggcgggcggaa

SEQ ID NO: 37529 - RNA, 18 nt, Artificial Sequence
  Synthetic
gggggggcgggcggaaga

SEQ ID NO: 37530 - RNA, 19 nt, Artificial Sequence
  Synthetic
ggggggggcgggcggaaga

SEQ ID NO: 37531 - RNA, 20 nt, Artificial Sequence
  Synthetic
gggggggggcgggcggaaga

SEQ ID NO: 37532 - RNA, 21 nt, Artificial Sequence
  Synthetic
ggggggggggcgggcggaaga

SEQ ID NO: 37533 - RNA, 22 nt, Artificial Sequence
  Synthetic
gggggggggggcgggcggaaga

SEQ ID NO: 37534 - RNA, 23 nt, Artificial Sequence
  Synthetic
agggggggggggcgggcggaaga

SEQ ID NO: 37535 - RNA, 24 nt, Artificial Sequence
  Synthetic
gagggggggggggcgggcggaaga

SEQ ID NO: 37536 - RNA, 18 nt, Artificial Sequence
  Synthetic
cgaggcgggggucccaga

SEQ ID NO: 37537 - RNA, 19 nt, Artificial Sequence
  Synthetic
acgaggcgggggucccaga

SEQ ID NO: 37538 - RNA, 20 nt, Artificial Sequence
  Synthetic
cacgaggcgggggucccaga

SEQ ID NO: 37539 - RNA, 21 nt, Artificial Sequence
  Synthetic
acacgaggcgggggucccaga

SEQ ID NO: 37540 - RNA, 22 nt, Artificial Sequence
  Synthetic
aacacgaggcgggggucccaga

SEQ ID NO: 37541 - RNA, 23 nt, Artificial Sequence
  Synthetic
aaacacgaggcgggggucccaga

SEQ ID NO: 37542 - RNA, 24 nt, Artificial Sequence
  Synthetic
gaaacacgaggcgggggucccaga

SEQ ID NO: 37543 - RNA, 18 nt, Artificial Sequence
  Synthetic
gcugaggcggcggggaga

SEQ ID NO: 37544 - RNA, 19 nt, Artificial Sequence
  Synthetic
ugcugaggcggcggggaga

SEQ ID NO: 37545 - RNA, 20 nt, Artificial Sequence
  Synthetic
cugcugaggcggcggggaga

SEQ ID NO: 37546 - RNA, 21 nt, Artificial Sequence
  Synthetic
ucugcugaggcggcggggaga

SEQ ID NO: 37547 - RNA, 22 nt, Artificial Sequence
  Synthetic
uucugcugaggcggcggggaga

SEQ ID NO: 37548 - RNA, 23 nt, Artificial Sequence
  Synthetic
cuucugcugaggcggcggggaga

SEQ ID NO: 37549 - RNA, 24 nt, Artificial Sequence
  Synthetic
gcuucugcugaggcggcggggaga

SEQ ID NO: 37550 - RNA, 18 nt, Artificial Sequence
  Synthetic
cugcugaggcggcgggga

SEQ ID NO: 37551 - RNA, 19 nt, Artificial Sequence
  Synthetic
ucugcugaggcggcgggga

SEQ ID NO: 37552 - RNA, 20 nt, Artificial Sequence
  Synthetic
uucugcugaggcggcgggga

SEQ ID NO: 37553 - RNA, 21 nt, Artificial Sequence
  Synthetic
cuucugcugaggcggcgggga

SEQ ID NO: 37554 - RNA, 22 nt, Artificial Sequence
  Synthetic
gcuucugcugaggcggcgggga

SEQ ID NO: 37555 - RNA, 23 nt, Artificial Sequence
  Synthetic
agcuucugcugaggcggcgggga

SEQ ID NO: 37556 - RNA, 24 nt, Artificial Sequence
  Synthetic
gagcuucugcugaggcggcgggga

SEQ ID NO: 37557 - RNA, 18 nt, Artificial Sequence
  Synthetic
cucccccuuucaagaaac

SEQ ID NO: 37558 - RNA, 19 nt, Artificial Sequence
  Synthetic
ccucccccuuucaagaaac

SEQ ID NO: 37559 - RNA, 20 nt, Artificial Sequence
  Synthetic
uccucccccuuucaagaaac

SEQ ID NO: 37560 - RNA, 21 nt, Artificial Sequence
  Synthetic
uuccucccccuuucaagaaac

SEQ ID NO: 37561 - RNA, 22 nt, Artificial Sequence
  Synthetic
cuuccucccccuuucaagaaac

SEQ ID NO: 37562 - RNA, 23 nt, Artificial Sequence
  Synthetic
ucuuccucccccuuucaagaaac

SEQ ID NO: 37563 - RNA, 24 nt, Artificial Sequence
  Synthetic
uucuuccucccccuuucaagaaac

SEQ ID NO: 37564 - RNA, 18 nt, Artificial Sequence
  Synthetic
aggucagccgcaccgccc

SEQ ID NO: 37565 - RNA, 19 nt, Artificial Sequence
  Synthetic
caggucagccgcaccgccc

SEQ ID NO: 37566 - RNA, 20 nt, Artificial Sequence
  Synthetic
gcaggucagccgcaccgccc

SEQ ID NO: 37567 - RNA, 21 nt, Artificial Sequence
  Synthetic
ggcaggucagccgcaccgccc

SEQ ID NO: 37568 - RNA, 22 nt, Artificial Sequence
  Synthetic
aggcaggucagccgcaccgccc

SEQ ID NO: 37569 - RNA, 23 nt, Artificial Sequence
  Synthetic
caggcaggucagccgcaccgccc

SEQ ID NO: 37570 - RNA, 24 nt, Artificial Sequence
  Synthetic
gcaggcaggucagccgcaccgccc

SEQ ID NO: 37571 - RNA, 18 nt, Artificial Sequence
  Synthetic
ccccccgucgucguuccc

SEQ ID NO: 37572 - RNA, 19 nt, Artificial Sequence
  Synthetic
cccccccgucgucguuccc

SEQ ID NO: 37573 - RNA, 20 nt, Artificial Sequence
  Synthetic
ccccccccgucgucguuccc

SEQ ID NO: 37574 - RNA, 21 nt, Artificial Sequence
  Synthetic
cccccccccgucgucguuccc

SEQ ID NO: 37575 - RNA, 22 nt, Artificial Sequence
  Synthetic
ccccccccccgucgucguuccc

SEQ ID NO: 37576 - RNA, 23 nt, Artificial Sequence
  Synthetic
cccccccccccgucgucguuccc

SEQ ID NO: 37577 - RNA, 24 nt, Artificial Sequence
  Synthetic
ucccccccccccgucgucguuccc

SEQ ID NO: 37578 - RNA, 18 nt, Artificial Sequence
  Synthetic
aacacgaggcgggggucc

SEQ ID NO: 37579 - RNA, 19 nt, Artificial Sequence
  Synthetic
aaacacgaggcgggggucc

SEQ ID NO: 37580 - RNA, 20 nt, Artificial Sequence
  Synthetic
gaaacacgaggcgggggucc

SEQ ID NO: 37581 - RNA, 21 nt, Artificial Sequence
  Synthetic
agaaacacgaggcgggggucc

SEQ ID NO: 37582 - RNA, 22 nt, Artificial Sequence
  Synthetic
aagaaacacgaggcgggggucc

SEQ ID NO: 37583 - RNA, 23 nt, Artificial Sequence
  Synthetic
caagaaacacgaggcgggggucc

SEQ ID NO: 37584 - RNA, 24 nt, Artificial Sequence
  Synthetic
ucaagaaacacgaggcgggggucc

SEQ ID NO: 37585 - RNA, 18 nt, Artificial Sequence
  Synthetic
cccccccgucgucguucc

SEQ ID NO: 37586 - RNA, 19 nt, Artificial Sequence
  Synthetic
ccccccccgucgucguucc

SEQ ID NO: 37587 - RNA, 20 nt, Artificial Sequence
  Synthetic
cccccccccgucgucguucc

SEQ ID NO: 37588 - RNA, 21 nt, Artificial Sequence
  Synthetic
ccccccccccgucgucguucc

SEQ ID NO: 37589 - RNA, 22 nt, Artificial Sequence
  Synthetic
cccccccccccgucgucguucc

SEQ ID NO: 37590 - RNA, 23 nt, Artificial Sequence
  Synthetic
ucccccccccccgucgucguucc

SEQ ID NO: 37591 - RNA, 24 nt, Artificial Sequence
  Synthetic
uucccccccccccgucgucguucc

SEQ ID NO: 37592 - RNA, 18 nt, Artificial Sequence
  Synthetic
guccccuuccucuaccgc

SEQ ID NO: 37593 - RNA, 19 nt, Artificial Sequence
  Synthetic
cguccccuuccucuaccgc

SEQ ID NO: 37594 - RNA, 20 nt, Artificial Sequence
  Synthetic
ccguccccuuccucuaccgc

SEQ ID NO: 37595 - RNA, 21 nt, Artificial Sequence
  Synthetic
cccguccccuuccucuaccgc

SEQ ID NO: 37596 - RNA, 22 nt, Artificial Sequence
  Synthetic
gcccguccccuuccucuaccgc

SEQ ID NO: 37597 - RNA, 23 nt, Artificial Sequence
  Synthetic
cgcccguccccuuccucuaccgc

SEQ ID NO: 37598 - RNA, 24 nt, Artificial Sequence
  Synthetic
gcgcccguccccuuccucuaccgc

SEQ ID NO: 37599 - RNA, 18 nt, Artificial Sequence
  Synthetic
agcuucugcugaggcggc

SEQ ID NO: 37600 - RNA, 19 nt, Artificial Sequence
  Synthetic
gagcuucugcugaggcggc

SEQ ID NO: 37601 - RNA, 20 nt, Artificial Sequence
  Synthetic
ugagcuucugcugaggcggc

SEQ ID NO: 37602 - RNA, 21 nt, Artificial Sequence
  Synthetic
gugagcuucugcugaggcggc

SEQ ID NO: 37603 - RNA, 22 nt, Artificial Sequence
  Synthetic
ggugagcuucugcugaggcggc

SEQ ID NO: 37604 - RNA, 23 nt, Artificial Sequence
  Synthetic
aggugagcuucugcugaggcggc

SEQ ID NO: 37605 - RNA, 24 nt, Artificial Sequence
  Synthetic
caggugagcuucugcugaggcggc

SEQ ID NO: 37606 - RNA, 18 nt, Artificial Sequence
  Synthetic
uaccgcgugggcgcgggc

SEQ ID NO: 37607 - RNA, 19 nt, Artificial Sequence
  Synthetic
cuaccgcgugggcgcgggc

SEQ ID NO: 37608 - RNA, 20 nt, Artificial Sequence
  Synthetic
ucuaccgcgugggcgcgggc

SEQ ID NO: 37609 - RNA, 21 nt, Artificial Sequence
  Synthetic
cucuaccgcgugggcgcgggc

SEQ ID NO: 37610 - RNA, 22 nt, Artificial Sequence
  Synthetic
ccucuaccgcgugggcgcgggc

SEQ ID NO: 37611 - RNA, 23 nt, Artificial Sequence
  Synthetic
uccucuaccgcgugggcgcgggc

SEQ ID NO: 37612 - RNA, 24 nt, Artificial Sequence
  Synthetic
uuccucuaccgcgugggcgcgggc

SEQ ID NO: 37613 - RNA, 18 nt, Artificial Sequence
  Synthetic
uuccucuaccgcgugggc

SEQ ID NO: 37614 - RNA, 19 nt, Artificial Sequence
  Synthetic
cuuccucuaccgcgugggc

SEQ ID NO: 37615 - RNA, 20 nt, Artificial Sequence
  Synthetic
ccuuccucuaccgcgugggc

SEQ ID NO: 37616 - RNA, 21 nt, Artificial Sequence
  Synthetic
cccuuccucuaccgcgugggc

SEQ ID NO: 37617 - RNA, 22 nt, Artificial Sequence
  Synthetic
ccccuuccucuaccgcgugggc

SEQ ID NO: 37618 - RNA, 23 nt, Artificial Sequence
  Synthetic
uccccuuccucuaccgcgugggc

SEQ ID NO: 37619 - RNA, 24 nt, Artificial Sequence
  Synthetic
guccccuuccucuaccgcgugggc

SEQ ID NO: 37620 - RNA, 18 nt, Artificial Sequence
  Synthetic
ccccccccgucgucguuc

SEQ ID NO: 37621 - RNA, 19 nt, Artificial Sequence
  Synthetic
cccccccccgucgucguuc

SEQ ID NO: 37622 - RNA, 20 nt, Artificial Sequence
  Synthetic
ccccccccccgucgucguuc

SEQ ID NO: 37623 - RNA, 21 nt, Artificial Sequence
  Synthetic
cccccccccccgucgucguuc

SEQ ID NO: 37624 - RNA, 22 nt, Artificial Sequence
  Synthetic
ucccccccccccgucgucguuc

SEQ ID NO: 37625 - RNA, 23 nt, Artificial Sequence
  Synthetic
uucccccccccccgucgucguuc

SEQ ID NO: 37626 - RNA, 24 nt, Artificial Sequence
  Synthetic
uuucccccccccccgucgucguuc

SEQ ID NO: 37627 - RNA, 18 nt, Artificial Sequence
  Synthetic
guucuuccucccccuuuc

SEQ ID NO: 37628 - RNA, 19 nt, Artificial Sequence
  Synthetic
uguucuuccucccccuuuc

SEQ ID NO: 37629 - RNA, 20 nt, Artificial Sequence
  Synthetic
cuguucuuccucccccuuuc

SEQ ID NO: 37630 - RNA, 21 nt, Artificial Sequence
  Synthetic
acuguucuuccucccccuuuc

SEQ ID NO: 37631 - RNA, 22 nt, Artificial Sequence
  Synthetic
aacuguucuuccucccccuuuc

SEQ ID NO: 37632 - RNA, 23 nt, Artificial Sequence
  Synthetic
gaacuguucuuccucccccuuuc

SEQ ID NO: 37633 - RNA, 24 nt, Artificial Sequence
  Synthetic
agaacuguucuuccucccccuuuc

SEQ ID NO: 37634 - RNA, 18 nt, Artificial Sequence
  Synthetic
agguuuagggucguacag

SEQ ID NO: 37635 - RNA, 19 nt, Artificial Sequence
  Synthetic
uagguuuagggucguacag

SEQ ID NO: 37636 - RNA, 20 nt, Artificial Sequence
  Synthetic
guagguuuagggucguacag

SEQ ID NO: 37637 - RNA, 18 nt, Artificial Sequence
  Synthetic
gcggaagagagaagagag

SEQ ID NO: 37638 - RNA, 19 nt, Artificial Sequence
  Synthetic
ggcggaagagagaagagag

SEQ ID NO: 37639 - RNA, 20 nt, Artificial Sequence
  Synthetic
gggcggaagagagaagagag

SEQ ID NO: 37640 - RNA, 21 nt, Artificial Sequence
  Synthetic
cgggcggaagagagaagagag

SEQ ID NO: 37641 - RNA, 22 nt, Artificial Sequence
  Synthetic
gcgggcggaagagagaagagag

SEQ ID NO: 37642 - RNA, 23 nt, Artificial Sequence
  Synthetic
ggcgggcggaagagagaagagag

SEQ ID NO: 37643 - RNA, 24 nt, Artificial Sequence
  Synthetic
gggcgggcggaagagagaagagag

SEQ ID NO: 37644 - RNA, 18 nt, Artificial Sequence
  Synthetic
ggggcgggcggaagagag

SEQ ID NO: 37645 - RNA, 19 nt, Artificial Sequence
  Synthetic
gggggcgggcggaagagag

SEQ ID NO: 37646 - RNA, 20 nt, Artificial Sequence
  Synthetic
ggggggcgggcggaagagag

SEQ ID NO: 37647 - RNA, 21 nt, Artificial Sequence
  Synthetic
gggggggcgggcggaagagag

SEQ ID NO: 37648 - RNA, 22 nt, Artificial Sequence
  Synthetic
ggggggggcgggcggaagagag

SEQ ID NO: 37649 - RNA, 23 nt, Artificial Sequence
  Synthetic
gggggggggcgggcggaagagag

SEQ ID NO: 37650 - RNA, 24 nt, Artificial Sequence
  Synthetic
ggggggggggcgggcggaagagag

SEQ ID NO: 37651 - RNA, 18 nt, Artificial Sequence
  Synthetic
cugaggcggcggggagag

SEQ ID NO: 37652 - RNA, 19 nt, Artificial Sequence
  Synthetic
gcugaggcggcggggagag

SEQ ID NO: 37653 - RNA, 20 nt, Artificial Sequence
  Synthetic
ugcugaggcggcggggagag

SEQ ID NO: 37654 - RNA, 21 nt, Artificial Sequence
  Synthetic
cugcugaggcggcggggagag

SEQ ID NO: 37655 - RNA, 22 nt, Artificial Sequence
  Synthetic
ucugcugaggcggcggggagag

SEQ ID NO: 37656 - RNA, 23 nt, Artificial Sequence
  Synthetic
uucugcugaggcggcggggagag

SEQ ID NO: 37657 - RNA, 24 nt, Artificial Sequence
  Synthetic
cuucugcugaggcggcggggagag

SEQ ID NO: 37658 - RNA, 18 nt, Artificial Sequence
  Synthetic
ccuuucaagaaacacgag

SEQ ID NO: 37659 - RNA, 19 nt, Artificial Sequence
  Synthetic
cccuuucaagaaacacgag

SEQ ID NO: 37660 - RNA, 20 nt, Artificial Sequence
  Synthetic
ccccuuucaagaaacacgag

SEQ ID NO: 37661 - RNA, 21 nt, Artificial Sequence
  Synthetic
cccccuuucaagaaacacgag

SEQ ID NO: 37662 - RNA, 22 nt, Artificial Sequence
  Synthetic
ucccccuuucaagaaacacgag

SEQ ID NO: 37663 - RNA, 23 nt, Artificial Sequence
  Synthetic
cucccccuuucaagaaacacgag

SEQ ID NO: 37664 - RNA, 24 nt, Artificial Sequence
  Synthetic
ccucccccuuucaagaaacacgag

SEQ ID NO: 37665 - RNA, 18 nt, Artificial Sequence
  Synthetic
ugcugaggcggcggggag

SEQ ID NO: 37666 - RNA, 19 nt, Artificial Sequence
  Synthetic
cugcugaggcggcggggag

SEQ ID NO: 37667 - RNA, 20 nt, Artificial Sequence
  Synthetic
ucugcugaggcggcggggag

SEQ ID NO: 37668 - RNA, 21 nt, Artificial Sequence
  Synthetic
uucugcugaggcggcggggag

SEQ ID NO: 37669 - RNA, 22 nt, Artificial Sequence
  Synthetic
cuucugcugaggcggcggggag

SEQ ID NO: 37670 - RNA, 23 nt, Artificial Sequence
  Synthetic
gcuucugcugaggcggcggggag

SEQ ID NO: 37671 - RNA, 24 nt, Artificial Sequence
  Synthetic
agcuucugcugaggcggcggggag

SEQ ID NO: 37672 - RNA, 18 nt, Artificial Sequence
  Synthetic
cccccgucgucguucccg

SEQ ID NO: 37673 - RNA, 19 nt, Artificial Sequence
  Synthetic
ccccccgucgucguucccg

SEQ ID NO: 37674 - RNA, 20 nt, Artificial Sequence
  Synthetic
cccccccgucgucguucccg

SEQ ID NO: 37675 - RNA, 21 nt, Artificial Sequence
  Synthetic
ccccccccgucgucguucccg

SEQ ID NO: 37676 - RNA, 22 nt, Artificial Sequence
  Synthetic
cccccccccgucgucguucccg

SEQ ID NO: 37677 - RNA, 23 nt, Artificial Sequence
  Synthetic
ccccccccccgucgucguucccg

SEQ ID NO: 37678 - RNA, 24 nt, Artificial Sequence
  Synthetic
cccccccccccgucgucguucccg

SEQ ID NO: 37679 - RNA, 18 nt, Artificial Sequence
  Synthetic
ugagcuucugcugaggcg

SEQ ID NO: 37680 - RNA, 19 nt, Artificial Sequence
  Synthetic
gugagcuucugcugaggcg

SEQ ID NO: 37681 - RNA, 20 nt, Artificial Sequence
  Synthetic
ggugagcuucugcugaggcg

SEQ ID NO: 37682 - RNA, 21 nt, Artificial Sequence
  Synthetic
aggugagcuucugcugaggcg

SEQ ID NO: 37683 - RNA, 22 nt, Artificial Sequence
  Synthetic
caggugagcuucugcugaggcg

SEQ ID NO: 37684 - RNA, 23 nt, Artificial Sequence
  Synthetic
acaggugagcuucugcugaggcg

SEQ ID NO: 37685 - RNA, 24 nt, Artificial Sequence
  Synthetic
uacaggugagcuucugcugaggcg

SEQ ID NO: 37686 - RNA, 18 nt, Artificial Sequence
  Synthetic
gcuucugcugaggcggcg

SEQ ID NO: 37687 - RNA, 19 nt, Artificial Sequence
  Synthetic
agcuucugcugaggcggcg

SEQ ID NO: 37688 - RNA, 20 nt, Artificial Sequence
  Synthetic
gagcuucugcugaggcggcg

SEQ ID NO: 37689 - RNA, 21 nt, Artificial Sequence
  Synthetic
ugagcuucugcugaggcggcg

SEQ ID NO: 37690 - RNA, 22 nt, Artificial Sequence
  Synthetic
gugagcuucugcugaggcggcg

SEQ ID NO: 37691 - RNA, 23 nt, Artificial Sequence
  Synthetic
ggugagcuucugcugaggcggcg

SEQ ID NO: 37692 - RNA, 24 nt, Artificial Sequence
  Synthetic
aggugagcuucugcugaggcggcg

SEQ ID NO: 37693 - RNA, 18 nt, Artificial Sequence
  Synthetic
accgcgugggcgcgggcg

SEQ ID NO: 37694 - RNA, 19 nt, Artificial Sequence
  Synthetic
uaccgcgugggcgcgggcg

SEQ ID NO: 37695 - RNA, 20 nt, Artificial Sequence
  Synthetic
cuaccgcgugggcgcgggcg

SEQ ID NO: 37696 - RNA, 21 nt, Artificial Sequence
  Synthetic
ucuaccgcgugggcgcgggcg

SEQ ID NO: 37697 - RNA, 22 nt, Artificial Sequence
  Synthetic
cucuaccgcgugggcgcgggcg

SEQ ID NO: 37698 - RNA, 23 nt, Artificial Sequence
  Synthetic
ccucuaccgcgugggcgcgggcg

SEQ ID NO: 37699 - RNA, 24 nt, Artificial Sequence
  Synthetic
uccucuaccgcgugggcgcgggcg

SEQ ID NO: 37700 - RNA, 18 nt, Artificial Sequence
  Synthetic
ugaggcggcggggagagg

SEQ ID NO: 37701 - RNA, 19 nt, Artificial Sequence
  Synthetic
cugaggcggcggggagagg

SEQ ID NO: 37702 - RNA, 20 nt, Artificial Sequence
  Synthetic
gcugaggcggcggggagagg

SEQ ID NO: 37703 - RNA, 21 nt, Artificial Sequence
  Synthetic
ugcugaggcggcggggagagg

SEQ ID NO: 37704 - RNA, 22 nt, Artificial Sequence
  Synthetic
cugcugaggcggcggggagagg

SEQ ID NO: 37705 - RNA, 23 nt, Artificial Sequence
  Synthetic
ucugcugaggcggcggggagagg

SEQ ID NO: 37706 - RNA, 24 nt, Artificial Sequence
  Synthetic
uucugcugaggcggcggggagagg

SEQ ID NO: 37707 - RNA, 18 nt, Artificial Sequence
  Synthetic
cuuucaagaaacacgagg

SEQ ID NO: 37708 - RNA, 19 nt, Artificial Sequence
  Synthetic
ccuuucaagaaacacgagg

SEQ ID NO: 37709 - RNA, 20 nt, Artificial Sequence
  Synthetic
cccuuucaagaaacacgagg

SEQ ID NO: 37710 - RNA, 21 nt, Artificial Sequence
  Synthetic
ccccuuucaagaaacacgagg

SEQ ID NO: 37711 - RNA, 22 nt, Artificial Sequence
  Synthetic
cccccuuucaagaaacacgagg

SEQ ID NO: 37712 - RNA, 23 nt, Artificial Sequence
  Synthetic
ucccccuuucaagaaacacgagg

SEQ ID NO: 37713 - RNA, 24 nt, Artificial Sequence
  Synthetic
cucccccuuucaagaaacacgagg

SEQ ID NO: 37714 - RNA, 18 nt, Artificial Sequence
  Synthetic
ccccgucgucguucccgg

SEQ ID NO: 37715 - RNA, 19 nt, Artificial Sequence
  Synthetic
cccccgucgucguucccgg

SEQ ID NO: 37716 - RNA, 20 nt, Artificial Sequence
  Synthetic
ccccccgucgucguucccgg

SEQ ID NO: 37717 - RNA, 21 nt, Artificial Sequence
  Synthetic
cccccccgucgucguucccgg

SEQ ID NO: 37718 - RNA, 22 nt, Artificial Sequence
  Synthetic
ccccccccgucgucguucccgg

SEQ ID NO: 37719 - RNA, 23 nt, Artificial Sequence
  Synthetic
cccccccccgucgucguucccgg

SEQ ID NO: 37720 - RNA, 24 nt, Artificial Sequence
  Synthetic
ccccccccccgucgucguucccgg

SEQ ID NO: 37721 - RNA, 18 nt, Artificial Sequence
  Synthetic
ucuaccgcgugggcgcgg

SEQ ID NO: 37722 - RNA, 19 nt, Artificial Sequence
  Synthetic
cucuaccgcgugggcgcgg

SEQ ID NO: 37723 - RNA, 20 nt, Artificial Sequence
  Synthetic
ccucuaccgcgugggcgcgg

SEQ ID NO: 37724 - RNA, 21 nt, Artificial Sequence
  Synthetic
uccucuaccgcgugggcgcgg

SEQ ID NO: 37725 - RNA, 22 nt, Artificial Sequence
  Synthetic
uuccucuaccgcgugggcgcgg

SEQ ID NO: 37726 - RNA, 23 nt, Artificial Sequence
  Synthetic
cuuccucuaccgcgugggcgcgg

SEQ ID NO: 37727 - RNA, 24 nt, Artificial Sequence
  Synthetic
ccuuccucuaccgcgugggcgcgg

SEQ ID NO: 37728 - RNA, 18 nt, Artificial Sequence
  Synthetic
gagcuucugcugaggcgg

SEQ ID NO: 37729 - RNA, 19 nt, Artificial Sequence
  Synthetic
ugagcuucugcugaggcgg

SEQ ID NO: 37730 - RNA, 20 nt, Artificial Sequence
  Synthetic
gugagcuucugcugaggcgg

SEQ ID NO: 37731 - RNA, 21 nt, Artificial Sequence
  Synthetic
ggugagcuucugcugaggcgg

SEQ ID NO: 37732 - RNA, 22 nt, Artificial Sequence
  Synthetic
aggugagcuucugcugaggcgg

SEQ ID NO: 37733 - RNA, 23 nt, Artificial Sequence
  Synthetic
caggugagcuucugcugaggcgg

SEQ ID NO: 37734 - RNA, 24 nt, Artificial Sequence
  Synthetic
acaggugagcuucugcugaggcgg

SEQ ID NO: 37735 - RNA, 18 nt, Artificial Sequence
  Synthetic
gggggggggggcgggcgg

SEQ ID NO: 37736 - RNA, 19 nt, Artificial Sequence
  Synthetic
agggggggggggcgggcgg

SEQ ID NO: 37737 - RNA, 20 nt, Artificial Sequence
  Synthetic
gagggggggggggcgggcgg

SEQ ID NO: 37738 - RNA, 21 nt, Artificial Sequence
  Synthetic
agagggggggggggcgggcgg

SEQ ID NO: 37739 - RNA, 22 nt, Artificial Sequence
  Synthetic
gagagggggggggggcgggcgg

SEQ ID NO: 37740 - RNA, 23 nt, Artificial Sequence
  Synthetic
ggagagggggggggggcgggcgg

SEQ ID NO: 37741 - RNA, 24 nt, Artificial Sequence
  Synthetic
gggagagggggggggggcgggcgg

SEQ ID NO: 37742 - RNA, 18 nt, Artificial Sequence
  Synthetic
gagagggggggggggcgg

SEQ ID NO: 37743 - RNA, 19 nt, Artificial Sequence
  Synthetic
ggagagggggggggggcgg

SEQ ID NO: 37744 - RNA, 20 nt, Artificial Sequence
  Synthetic
gggagagggggggggggcgg

SEQ ID NO: 37745 - RNA, 21 nt, Artificial Sequence
  Synthetic
ggggagagggggggggggcgg

SEQ ID NO: 37746 - RNA, 22 nt, Artificial Sequence
  Synthetic
cggggagagggggggggggcgg

SEQ ID NO: 37747 - RNA, 23 nt, Artificial Sequence
  Synthetic
gcggggagagggggggggggcgg

SEQ ID NO: 37748 - RNA, 24 nt, Artificial Sequence
  Synthetic
ggcggggagagggggggggggcgg

SEQ ID NO: 37749 - RNA, 18 nt, Artificial Sequence
  Synthetic
gaggcggcggggagaggg

SEQ ID NO: 37750 - RNA, 19 nt, Artificial Sequence
  Synthetic
ugaggcggcggggagaggg

SEQ ID NO: 37751 - RNA, 20 nt, Artificial Sequence
  Synthetic
cugaggcggcggggagaggg

SEQ ID NO: 37752 - RNA, 21 nt, Artificial Sequence
  Synthetic
gcugaggcggcggggagaggg

SEQ ID NO: 37753 - RNA, 22 nt, Artificial Sequence
  Synthetic
ugcugaggcggcggggagaggg

SEQ ID NO: 37754 - RNA, 23 nt, Artificial Sequence
  Synthetic
cugcugaggcggcggggagaggg

SEQ ID NO: 37755 - RNA, 24 nt, Artificial Sequence
  Synthetic
ucugcugaggcggcggggagaggg

SEQ ID NO: 37756 - RNA, 18 nt, Artificial Sequence
  Synthetic
cgggggggcaggcgcggg

SEQ ID NO: 37757 - RNA, 19 nt, Artificial Sequence
  Synthetic
ccgggggggcaggcgcggg

SEQ ID NO: 37758 - RNA, 20 nt, Artificial Sequence
  Synthetic
cccgggggggcaggcgcggg

SEQ ID NO: 37759 - RNA, 21 nt, Artificial Sequence
  Synthetic
ucccgggggggcaggcgcggg

SEQ ID NO: 37760 - RNA, 22 nt, Artificial Sequence
  Synthetic
uucccgggggggcaggcgcggg

SEQ ID NO: 37761 - RNA, 23 nt, Artificial Sequence
  Synthetic
guucccgggggggcaggcgcggg

SEQ ID NO: 37762 - RNA, 24 nt, Artificial Sequence
  Synthetic
cguucccgggggggcaggcgcggg

SEQ ID NO: 37763 - RNA, 18 nt, Artificial Sequence
  Synthetic
cuaccgcgugggcgcggg

SEQ ID NO: 37764 - RNA, 19 nt, Artificial Sequence
  Synthetic
ucuaccgcgugggcgcggg

SEQ ID NO: 37765 - RNA, 20 nt, Artificial Sequence
  Synthetic
cucuaccgcgugggcgcggg

SEQ ID NO: 37766 - RNA, 21 nt, Artificial Sequence
  Synthetic
ccucuaccgcgugggcgcggg

SEQ ID NO: 37767 - RNA, 22 nt, Artificial Sequence
  Synthetic
uccucuaccgcgugggcgcggg

SEQ ID NO: 37768 - RNA, 23 nt, Artificial Sequence
  Synthetic
uuccucuaccgcgugggcgcggg

SEQ ID NO: 37769 - RNA, 24 nt, Artificial Sequence
  Synthetic
cuuccucuaccgcgugggcgcggg

SEQ ID NO: 37770 - RNA, 18 nt, Artificial Sequence
  Synthetic
uucugcugaggcggcggg

SEQ ID NO: 37771 - RNA, 19 nt, Artificial Sequence
  Synthetic
cuucugcugaggcggcggg

SEQ ID NO: 37772 - RNA, 20 nt, Artificial Sequence
  Synthetic
gcuucugcugaggcggcggg

SEQ ID NO: 37773 - RNA, 21 nt, Artificial Sequence
  Synthetic
agcuucugcugaggcggcggg

SEQ ID NO: 37774 - RNA, 22 nt, Artificial Sequence
  Synthetic
gagcuucugcugaggcggcggg

SEQ ID NO: 37775 - RNA, 23 nt, Artificial Sequence
  Synthetic
ugagcuucugcugaggcggcggg

SEQ ID NO: 37776 - RNA, 24 nt, Artificial Sequence
  Synthetic
gugagcuucugcugaggcggcggg

SEQ ID NO: 37777 - RNA, 18 nt, Artificial Sequence
  Synthetic
agagggggggggggcggg

SEQ ID NO: 37778 - RNA, 19 nt, Artificial Sequence
  Synthetic
gagagggggggggggcggg

SEQ ID NO: 37779 - RNA, 20 nt, Artificial Sequence
  Synthetic
ggagagggggggggggcggg

SEQ ID NO: 37780 - RNA, 21 nt, Artificial Sequence
  Synthetic
gggagagggggggggggcggg

SEQ ID NO: 37781 - RNA, 22 nt, Artificial Sequence
  Synthetic
ggggagagggggggggggcggg

SEQ ID NO: 37782 - RNA, 23 nt, Artificial Sequence
  Synthetic
cggggagagggggggggggcggg

SEQ ID NO: 37783 - RNA, 24 nt, Artificial Sequence
  Synthetic
gcggggagagggggggggggcggg

SEQ ID NO: 37784 - RNA, 18 nt, Artificial Sequence
  Synthetic
gagagaagagagcagggg

SEQ ID NO: 37785 - RNA, 19 nt, Artificial Sequence
  Synthetic
agagagaagagagcagggg

SEQ ID NO: 37786 - RNA, 20 nt, Artificial Sequence
  Synthetic
aagagagaagagagcagggg

SEQ ID NO: 37787 - RNA, 21 nt, Artificial Sequence
  Synthetic
gaagagagaagagagcagggg

SEQ ID NO: 37788 - RNA, 22 nt, Artificial Sequence
  Synthetic
ggaagagagaagagagcagggg

SEQ ID NO: 37789 - RNA, 23 nt, Artificial Sequence
  Synthetic
cggaagagagaagagagcagggg

SEQ ID NO: 37790 - RNA, 24 nt, Artificial Sequence
  Synthetic
gcggaagagagaagagagcagggg

SEQ ID NO: 37791 - RNA, 18 nt, Artificial Sequence
  Synthetic
aggcggcggggagagggg

SEQ ID NO: 37792 - RNA, 19 nt, Artificial Sequence
  Synthetic
gaggcggcggggagagggg

SEQ ID NO: 37793 - RNA, 20 nt, Artificial Sequence
  Synthetic
ugaggcggcggggagagggg

SEQ ID NO: 37794 - RNA, 21 nt, Artificial Sequence
  Synthetic
cugaggcggcggggagagggg

SEQ ID NO: 37795 - RNA, 22 nt, Artificial Sequence
  Synthetic
gcugaggcggcggggagagggg

SEQ ID NO: 37796 - RNA, 23 nt, Artificial Sequence
  Synthetic
ugcugaggcggcggggagagggg

SEQ ID NO: 37797 - RNA, 24 nt, Artificial Sequence
  Synthetic
cugcugaggcggcggggagagggg

SEQ ID NO: 37798 - RNA, 18 nt, Artificial Sequence
  Synthetic
ggcggcggggagaggggg

SEQ ID NO: 37799 - RNA, 19 nt, Artificial Sequence
  Synthetic
aggcggcggggagaggggg

SEQ ID NO: 37800 - RNA, 20 nt, Artificial Sequence
  Synthetic
gaggcggcggggagaggggg

SEQ ID NO: 37801 - RNA, 21 nt, Artificial Sequence
  Synthetic
ugaggcggcggggagaggggg

SEQ ID NO: 37802 - RNA, 22 nt, Artificial Sequence
  Synthetic
cugaggcggcggggagaggggg

SEQ ID NO: 37803 - RNA, 23 nt, Artificial Sequence
  Synthetic
gcugaggcggcggggagaggggg

SEQ ID NO: 37804 - RNA, 24 nt, Artificial Sequence
  Synthetic
ugcugaggcggcggggagaggggg

SEQ ID NO: 37805 - RNA, 18 nt, Artificial Sequence
  Synthetic
gcggcggggagagggggg

SEQ ID NO: 37806 - RNA, 19 nt, Artificial Sequence
  Synthetic
ggcggcggggagagggggg

SEQ ID NO: 37807 - RNA, 20 nt, Artificial Sequence
  Synthetic
aggcggcggggagagggggg

SEQ ID NO: 37808 - RNA, 21 nt, Artificial Sequence
  Synthetic
gaggcggcggggagagggggg

SEQ ID NO: 37809 - RNA, 22 nt, Artificial Sequence
  Synthetic
ugaggcggcggggagagggggg

SEQ ID NO: 37810 - RNA, 23 nt, Artificial Sequence
  Synthetic
cugaggcggcggggagagggggg

SEQ ID NO: 37811 - RNA, 24 nt, Artificial Sequence
  Synthetic
gcugaggcggcggggagagggggg

SEQ ID NO: 37812 - RNA, 18 nt, Artificial Sequence
  Synthetic
cggggagagggggggggg

SEQ ID NO: 37813 - RNA, 19 nt, Artificial Sequence
  Synthetic
gcggggagagggggggggg

SEQ ID NO: 37814 - RNA, 20 nt, Artificial Sequence
  Synthetic
ggcggggagagggggggggg

SEQ ID NO: 37815 - RNA, 21 nt, Artificial Sequence
  Synthetic
cggcggggagagggggggggg

SEQ ID NO: 37816 - RNA, 22 nt, Artificial Sequence
  Synthetic
gcggcggggagagggggggggg

SEQ ID NO: 37817 - RNA, 23 nt, Artificial Sequence
  Synthetic
ggcggcggggagagggggggggg

SEQ ID NO: 37818 - RNA, 24 nt, Artificial Sequence
  Synthetic
aggcggcggggagagggggggggg

SEQ ID NO: 37819 - RNA, 18 nt, Artificial Sequence
  Synthetic
agagagcagggguugggg

SEQ ID NO: 37820 - RNA, 19 nt, Artificial Sequence
  Synthetic
aagagagcagggguugggg

SEQ ID NO: 37821 - RNA, 20 nt, Artificial Sequence
  Synthetic
gaagagagcagggguugggg

SEQ ID NO: 37822 - RNA, 21 nt, Artificial Sequence
  Synthetic
agaagagagcagggguugggg

SEQ ID NO: 37823 - RNA, 22 nt, Artificial Sequence
  Synthetic
gagaagagagcagggguugggg

SEQ ID NO: 37824 - RNA, 23 nt, Artificial Sequence
  Synthetic
agagaagagagcagggguugggg

SEQ ID NO: 37825 - RNA, 24 nt, Artificial Sequence
  Synthetic
gagagaagagagcagggguugggg

SEQ ID NO: 37826 - RNA, 18 nt, Artificial Sequence
  Synthetic
gaagagagcagggguugg

SEQ ID NO: 37827 - RNA, 19 nt, Artificial Sequence
  Synthetic
agaagagagcagggguugg

SEQ ID NO: 37828 - RNA, 20 nt, Artificial Sequence
  Synthetic
gagaagagagcagggguugg

SEQ ID NO: 37829 - RNA, 21 nt, Artificial Sequence
  Synthetic
agagaagagagcagggguugg

SEQ ID NO: 37830 - RNA, 22 nt, Artificial Sequence
  Synthetic
gagagaagagagcagggguugg

SEQ ID NO: 37831 - RNA, 23 nt, Artificial Sequence
  Synthetic
agagagaagagagcagggguugg

SEQ ID NO: 37832 - RNA, 24 nt, Artificial Sequence
  Synthetic
aagagagaagagagcagggguugg

SEQ ID NO: 37833 - RNA, 18 nt, Artificial Sequence
  Synthetic
cguacaggugagcuucug

SEQ ID NO: 37834 - RNA, 19 nt, Artificial Sequence
  Synthetic
ucguacaggugagcuucug

SEQ ID NO: 37835 - RNA, 20 nt, Artificial Sequence
  Synthetic
gucguacaggugagcuucug

SEQ ID NO: 37836 - RNA, 21 nt, Artificial Sequence
  Synthetic
ggucguacaggugagcuucug

SEQ ID NO: 37837 - RNA, 22 nt, Artificial Sequence
  Synthetic
gggucguacaggugagcuucug

SEQ ID NO: 37838 - RNA, 23 nt, Artificial Sequence
  Synthetic
agggucguacaggugagcuucug

SEQ ID NO: 37839 - RNA, 24 nt, Artificial Sequence
  Synthetic
uagggucguacaggugagcuucug

SEQ ID NO: 37840 - RNA, 18 nt, Artificial Sequence
  Synthetic
agaagagagcagggguug

SEQ ID NO: 37841 - RNA, 19 nt, Artificial Sequence
  Synthetic
gagaagagagcagggguug

SEQ ID NO: 37842 - RNA, 20 nt, Artificial Sequence
  Synthetic
agagaagagagcagggguug

SEQ ID NO: 37843 - RNA, 21 nt, Artificial Sequence
  Synthetic
gagagaagagagcagggguug

SEQ ID NO: 37844 - RNA, 22 nt, Artificial Sequence
  Synthetic
agagagaagagagcagggguug

SEQ ID NO: 37845 - RNA, 23 nt, Artificial Sequence
  Synthetic
aagagagaagagagcagggguug

SEQ ID NO: 37846 - RNA, 24 nt, Artificial Sequence
  Synthetic
gaagagagaagagagcagggguug

SEQ ID NO: 37847 - RNA, 18 nt, Artificial Sequence
  Synthetic
agagaagagagcaggggu

SEQ ID NO: 37848 - RNA, 19 nt, Artificial Sequence
  Synthetic
gagagaagagagcaggggu

SEQ ID NO: 37849 - RNA, 20 nt, Artificial Sequence
  Synthetic
agagagaagagagcaggggu

SEQ ID NO: 37850 - RNA, 21 nt, Artificial Sequence
  Synthetic
aagagagaagagagcaggggu

SEQ ID NO: 37851 - RNA, 22 nt, Artificial Sequence
  Synthetic
gaagagagaagagagcaggggu

SEQ ID NO: 37852 - RNA, 23 nt, Artificial Sequence
  Synthetic
ggaagagagaagagagcaggggu

SEQ ID NO: 37853 - RNA, 24 nt, Artificial Sequence
  Synthetic
cggaagagagaagagagcaggggu

SEQ ID NO: 37854 - RNA, 18 nt, Artificial Sequence
  Synthetic
gagaagagagcagggguu

SEQ ID NO: 37855 - RNA, 19 nt, Artificial Sequence
  Synthetic
agagaagagagcagggguu

SEQ ID NO: 37856 - RNA, 20 nt, Artificial Sequence
  Synthetic
gagagaagagagcagggguu

SEQ ID NO: 37857 - RNA, 21 nt, Artificial Sequence
  Synthetic
agagagaagagagcagggguu

SEQ ID NO: 37858 - RNA, 22 nt, Artificial Sequence
  Synthetic
aagagagaagagagcagggguu

SEQ ID NO: 37859 - RNA, 23 nt, Artificial Sequence
  Synthetic
gaagagagaagagagcagggguu

SEQ ID NO: 37860 - RNA, 24 nt, Artificial Sequence
  Synthetic
ggaagagagaagagagcagggguu

SEQ ID NO: 37861 - RNA, 19 nt, Artificial Sequence
  Synthetic
gcuggcuggcggguaaaaa

SEQ ID NO: 37862 - RNA, 20 nt, Artificial Sequence
  Synthetic
ggcuggcuggcggguaaaaa

SEQ ID NO: 37863 - RNA, 21 nt, Artificial Sequence
  Synthetic
gggcuggcuggcggguaaaaa

SEQ ID NO: 37864 - RNA, 23 nt, Artificial Sequence
  Synthetic
gcgggcuggcuggcggguaaaaa

SEQ ID NO: 37865 - RNA, 24 nt, Artificial Sequence
  Synthetic
ggcgggcuggcuggcggguaaaaa

SEQ ID NO: 37866 - RNA, 21 nt, Artificial Sequence
  Synthetic
gcucccccgcgcaggggggcc

SEQ ID NO: 37867 - RNA, 24 nt, Artificial Sequence
  Synthetic
gcagcucccccgcgcaggggggcc

SEQ ID NO: 37868 - RNA, 18 nt, Artificial Sequence
  Synthetic
gcgcuaccugcccaucgc

SEQ ID NO: 37869 - RNA, 19 nt, Artificial Sequence
  Synthetic
gacccuggggguggugggc

SEQ ID NO: 37870 - RNA, 23 nt, Artificial Sequence
  Synthetic
gccagacccuggggguggugggc

SEQ ID NO: 37871 - RNA, 24 nt, Artificial Sequence
  Synthetic
ggccagacccuggggguggugggc

SEQ ID NO: 37872 - RNA, 19 nt, Artificial Sequence
  Synthetic
gacgcccccgcgggccacg

SEQ ID NO: 37873 - RNA, 21 nt, Artificial Sequence
  Synthetic
gcgacgcccccgcgggccacg

SEQ ID NO: 37874 - RNA, 22 nt, Artificial Sequence
  Synthetic
ggcgacgcccccgcgggccacg

SEQ ID NO: 37875 - RNA, 18 nt, Artificial Sequence
  Synthetic
gggcgggggcgagggcgg

SEQ ID NO: 37876 - RNA, 19 nt, Artificial Sequence
  Synthetic
ggggcgggggcgagggcgg

SEQ ID NO: 37877 - RNA, 21 nt, Artificial Sequence
  Synthetic
guggggcgggggcgagggcgg

SEQ ID NO: 37878 - RNA, 20 nt, Artificial Sequence
  Synthetic
gcucggggagggaggagggg

SEQ ID NO: 37879 - RNA, 21 nt, Artificial Sequence
  Synthetic
ggcucggggagggaggagggg

SEQ ID NO: 37880 - RNA, 21 nt, Artificial Sequence
  Synthetic
gcacgcccucugcccccgggg

SEQ ID NO: 37881 - RNA, 18 nt, Artificial Sequence
  Synthetic
gggugggcgggcuggcug

SEQ ID NO: 37882 - RNA, 20 nt, Artificial Sequence
  Synthetic
gugggugggcgggcuggcug

SEQ ID NO: 37883 - RNA, 21 nt, Artificial Sequence
  Synthetic
ggugggugggcgggcuggcug

SEQ ID NO: 37884 - RNA, 19 nt, Artificial Sequence
  Synthetic
guucuggcucccugucuug

SEQ ID NO: 37885 - RNA, 24 nt, Artificial Sequence
  Synthetic
gccucguucuggcucccugucuug

SEQ ID NO: 37886 - RNA, 19 nt, Artificial Sequence
  Synthetic
gucuggccggccagacccu

SEQ ID NO: 37887 - RNA, 23 nt, Artificial Sequence
  Synthetic
gcacgucuggccggccagacccu

SEQ ID NO: 37888 - RNA, 18 nt, Artificial Sequence
  Synthetic
gucggaguggaacagccu

SEQ ID NO: 37889 - RNA, 20 nt, Artificial Sequence
  Synthetic
gcgucggaguggaacagccu

SEQ ID NO: 37890 - RNA, 18 nt, Artificial Sequence
  Synthetic
ggggaggagacaggaagu

SEQ ID NO: 37891 - RNA, 21 nt, Artificial Sequence
  Synthetic
gacggggaggagacaggaagu

SEQ ID NO: 37892 - RNA, 22 nt, Artificial Sequence
  Synthetic
gacuacccgacgccccccgcgu

SEQ ID NO: 37893 - RNA, 18 nt, Artificial Sequence
  Synthetic
gagacaggaagugggggu

SEQ ID NO: 37894 - RNA, 19 nt, Artificial Sequence
  Synthetic
ggagacaggaagugggggu

SEQ ID NO: 37895 - RNA, 21 nt, Artificial Sequence
  Synthetic
gaggagacaggaagugggggu

SEQ ID NO: 37896 - RNA, 22 nt, Artificial Sequence
  Synthetic
ggaggagacaggaagugggggu

SEQ ID NO: 37897 - RNA, 23 nt, Artificial Sequence
  Synthetic
gggaggagacaggaagugggggu

SEQ ID NO: 37898 - RNA, 24 nt, Artificial Sequence
  Synthetic
ggggaggagacaggaagugggggu

SEQ ID NO: 37899 - RNA, 18 nt, Artificial Sequence
  Synthetic
gaaguccagcgcgcccac

SEQ ID NO: 37900 - RNA, 19 nt, Artificial Sequence
  Synthetic
ggaaguccagcgcgcccac

SEQ ID NO: 37901 - RNA, 21 nt, Artificial Sequence
  Synthetic
guggaaguccagcgcgcccac

SEQ ID NO: 37902 - RNA, 24 nt, Artificial Sequence
  Synthetic
gccguggaaguccagcgcgcccac

SEQ ID NO: 37903 - RNA, 21 nt, Artificial Sequence
  Synthetic
gucaaagagcauguugcccac

SEQ ID NO: 37904 - RNA, 22 nt, Artificial Sequence
  Synthetic
ggucaaagagcauguugcccac

SEQ ID NO: 37905 - RNA, 19 nt, Artificial Sequence
  Synthetic
gcgcccugcucccgagacc

SEQ ID NO: 37906 - RNA, 21 nt, Artificial Sequence
  Synthetic
gcgcgcccugcucccgagacc

SEQ ID NO: 37907 - RNA, 22 nt, Artificial Sequence
  Synthetic
ggcgcgcccugcucccgagacc

SEQ ID NO: 37908 - RNA, 23 nt, Artificial Sequence
  Synthetic
gggcgcgcccugcucccgagacc

SEQ ID NO: 37909 - RNA, 19 nt, Artificial Sequence
  Synthetic
guaagugcgggugcaugcc

SEQ ID NO: 37910 - RNA, 21 nt, Artificial Sequence
  Synthetic
gcguaagugcgggugcaugcc

SEQ ID NO: 37911 - RNA, 22 nt, Artificial Sequence
  Synthetic
ggcguaagugcgggugcaugcc

SEQ ID NO: 37912 - RNA, 23 nt, Artificial Sequence
  Synthetic
gggcguaagugcgggugcaugcc

SEQ ID NO: 37913 - RNA, 19 nt, Artificial Sequence
  Synthetic
gugagugcgguugcaugcc

SEQ ID NO: 37914 - RNA, 20 nt, Artificial Sequence
  Synthetic
ggugagugcgguugcaugcc

SEQ ID NO: 37915 - RNA, 21 nt, Artificial Sequence
  Synthetic
gggugagugcgguugcaugcc

SEQ ID NO: 37916 - RNA, 22 nt, Artificial Sequence
  Synthetic
ggggugagugcgguugcaugcc

SEQ ID NO: 37917 - RNA, 24 nt, Artificial Sequence
  Synthetic
guggggugagugcgguugcaugcc

SEQ ID NO: 37918 - RNA, 22 nt, Artificial Sequence
  Synthetic
gcuccuccuccuuucucccagc

SEQ ID NO: 37919 - RNA, 20 nt, Artificial Sequence
  Synthetic
gaugggagucuccccgcagc

SEQ ID NO: 37920 - RNA, 19 nt, Artificial Sequence
  Synthetic
gcggggugggcgccggggc

SEQ ID NO: 37921 - RNA, 20 nt, Artificial Sequence
  Synthetic
ggcggggugggcgccggggc

SEQ ID NO: 37922 - RNA, 21 nt, Artificial Sequence
  Synthetic
gggcggggugggcgccggggc

SEQ ID NO: 37923 - RNA, 23 nt, Artificial Sequence
  Synthetic
gcgggcggggugggcgccggggc

SEQ ID NO: 37924 - RNA, 20 nt, Artificial Sequence
  Synthetic
gauaaagaccaacaggccuc

SEQ ID NO: 37925 - RNA, 19 nt, Artificial Sequence
  Synthetic
gcuuccuucgggcagcaag

SEQ ID NO: 37926 - RNA, 20 nt, Artificial Sequence
  Synthetic
ggcuuccuucgggcagcaag

SEQ ID NO: 37927 - RNA, 22 nt, Artificial Sequence
  Synthetic
gcggcuuccuucgggcagcaag

SEQ ID NO: 37928 - RNA, 23 nt, Artificial Sequence
  Synthetic
ggcggcuuccuucgggcagcaag

SEQ ID NO: 37929 - RNA, 24 nt, Artificial Sequence
  Synthetic
gggcggcuuccuucgggcagcaag

SEQ ID NO: 37930 - RNA, 18 nt, Artificial Sequence
  Synthetic
gcgcgcgugcucggggag

SEQ ID NO: 37931 - RNA, 21 nt, Artificial Sequence
  Synthetic
guugcgcgcgugcucggggag

SEQ ID NO: 37932 - RNA, 24 nt, Artificial Sequence
  Synthetic
gcaguugcgcgcgugcucggggag

SEQ ID NO: 37933 - RNA, 20 nt, Artificial Sequence
  Synthetic
guagcgcgugaggccgggcg

SEQ ID NO: 37934 - RNA, 21 nt, Artificial Sequence
  Synthetic
gguagcgcgugaggccgggcg

SEQ ID NO: 37935 - RNA, 24 nt, Artificial Sequence
  Synthetic
gcagguagcgcgugaggccgggcg

SEQ ID NO: 37936 - RNA, 23 nt, Artificial Sequence
  Synthetic
guuccacuccgacgcggggggcg

SEQ ID NO: 37937 - RNA, 18 nt, Artificial Sequence
  Synthetic
ggcgggcaggugugcggg

SEQ ID NO: 37938 - RNA, 20 nt, Artificial Sequence
  Synthetic
guggcgggcaggugugcggg

SEQ ID NO: 37939 - RNA, 22 nt, Artificial Sequence
  Synthetic
gcguggcgggcaggugugcggg

SEQ ID NO: 37940 - RNA, 23 nt, Artificial Sequence
  Synthetic
ggcguggcgggcaggugugcggg

SEQ ID NO: 37941 - RNA, 24 nt, Artificial Sequence
  Synthetic
gggcguggcgggcaggugugcggg

SEQ ID NO: 37942 - RNA, 18 nt, Artificial Sequence
  Synthetic
gcaggugugcgggcgggg

SEQ ID NO: 37943 - RNA, 19 nt, Artificial Sequence
  Synthetic
ggcaggugugcgggcgggg

SEQ ID NO: 37944 - RNA, 20 nt, Artificial Sequence
  Synthetic
gggcaggugugcgggcgggg

SEQ ID NO: 37945 - RNA, 22 nt, Artificial Sequence
  Synthetic
gcgggcaggugugcgggcgggg

SEQ ID NO: 37946 - RNA, 23 nt, Artificial Sequence
  Synthetic
ggcgggcaggugugcgggcgggg

SEQ ID NO: 37947 - RNA, 18 nt, Artificial Sequence
  Synthetic
gugugcgggcgggguggg

SEQ ID NO: 37948 - RNA, 19 nt, Artificial Sequence
  Synthetic
ggugugcgggcgggguggg

SEQ ID NO: 37949 - RNA, 22 nt, Artificial Sequence
  Synthetic
gcaggugugcgggcgggguggg

SEQ ID NO: 37950 - RNA, 23 nt, Artificial Sequence
  Synthetic
ggcaggugugcgggcgggguggg

SEQ ID NO: 37951 - RNA, 24 nt, Artificial Sequence
  Synthetic
gggcaggugugcgggcgggguggg

SEQ ID NO: 37952 - RNA, 18 nt, Artificial Sequence
  Synthetic
gagcccccucgccccgau

SEQ ID NO: 37953 - RNA, 20 nt, Artificial Sequence
  Synthetic
gcgagcccccucgccccgau

SEQ ID NO: 37954 - RNA, 22 nt, Artificial Sequence
  Synthetic
gcgcgagcccccucgccccgau

SEQ ID NO: 37955 - RNA, 18 nt, Artificial Sequence
  Synthetic
gugggcacgggcguaagu

SEQ ID NO: 37956 - RNA, 19 nt, Artificial Sequence
  Synthetic
ggugggcacgggcguaagu

SEQ ID NO: 37957 - RNA, 20 nt, Artificial Sequence
  Synthetic
gggugggcacgggcguaagu

SEQ ID NO: 37958 - RNA, 21 nt, Artificial Sequence
  Synthetic
ggggugggcacgggcguaagu

SEQ ID NO: 37959 - RNA, 22 nt, Artificial Sequence
  Synthetic
gggggugggcacgggcguaagu

SEQ ID NO: 37960 - RNA, 24 nt, Artificial Sequence
  Synthetic
gcgggggugggcacgggcguaagu

SEQ ID NO: 37961 - RNA, 18 nt, Artificial Sequence
  Synthetic
cuggcuggcggguaaaaa

SEQ ID NO: 37962 - RNA, 22 nt, Artificial Sequence
  Synthetic
cgggcuggcuggcggguaaaaa

SEQ ID NO: 37963 - RNA, 18 nt, Artificial Sequence
  Synthetic
cccccgcgcaggggggcc

SEQ ID NO: 37964 - RNA, 19 nt, Artificial Sequence
  Synthetic
ucccccgcgcaggggggcc

SEQ ID NO: 37965 - RNA, 20 nt, Artificial Sequence
  Synthetic
cucccccgcgcaggggggcc

SEQ ID NO: 37966 - RNA, 22 nt, Artificial Sequence
  Synthetic
agcucccccgcgcaggggggcc

SEQ ID NO: 37967 - RNA, 23 nt, Artificial Sequence
  Synthetic
cagcucccccgcgcaggggggcc

SEQ ID NO: 37968 - RNA, 19 nt, Artificial Sequence
  Synthetic
cgcgcuaccugcccaucgc

SEQ ID NO: 37969 - RNA, 20 nt, Artificial Sequence
  Synthetic
acgcgcuaccugcccaucgc

SEQ ID NO: 37970 - RNA, 21 nt, Artificial Sequence
  Synthetic
cacgcgcuaccugcccaucgc

SEQ ID NO: 37971 - RNA, 22 nt, Artificial Sequence
  Synthetic
ucacgcgcuaccugcccaucgc

SEQ ID NO: 37972 - RNA, 23 nt, Artificial Sequence
  Synthetic
cucacgcgcuaccugcccaucgc

SEQ ID NO: 37973 - RNA, 24 nt, Artificial Sequence
  Synthetic
ccucacgcgcuaccugcccaucgc

SEQ ID NO: 37974 - RNA, 18 nt, Artificial Sequence
  Synthetic
acccuggggguggugggc

SEQ ID NO: 37975 - RNA, 20 nt, Artificial Sequence
  Synthetic
agacccuggggguggugggc

SEQ ID NO: 37976 - RNA, 21 nt, Artificial Sequence
  Synthetic
cagacccuggggguggugggc

SEQ ID NO: 37977 - RNA, 22 nt, Artificial Sequence
  Synthetic
ccagacccuggggguggugggc

SEQ ID NO: 37978 - RNA, 18 nt, Artificial Sequence
  Synthetic
acgcccccgcgggccacg

SEQ ID NO: 37979 - RNA, 20 nt, Artificial Sequence
  Synthetic
cgacgcccccgcgggccacg

SEQ ID NO: 37980 - RNA, 23 nt, Artificial Sequence
  Synthetic
cggcgacgcccccgcgggccacg

SEQ ID NO: 37981 - RNA, 24 nt, Artificial Sequence
  Synthetic
ccggcgacgcccccgcgggccacg

SEQ ID NO: 37982 - RNA, 20 nt, Artificial Sequence
  Synthetic
uggggcgggggcgagggcgg

SEQ ID NO: 37983 - RNA, 22 nt, Artificial Sequence
  Synthetic
aguggggcgggggcgagggcgg

SEQ ID NO: 37984 - RNA, 23 nt, Artificial Sequence
  Synthetic
aaguggggcgggggcgagggcgg

SEQ ID NO: 37985 - RNA, 24 nt, Artificial Sequence
  Synthetic
aaaguggggcgggggcgagggcgg

SEQ ID NO: 37986 - RNA, 18 nt, Artificial Sequence
  Synthetic
ucggggagggaggagggg

SEQ ID NO: 37987 - RNA, 19 nt, Artificial Sequence
  Synthetic
cucggggagggaggagggg

SEQ ID NO: 37988 - RNA, 22 nt, Artificial Sequence
  Synthetic
uggcucggggagggaggagggg

SEQ ID NO: 37989 - RNA, 23 nt, Artificial Sequence
  Synthetic
cuggcucggggagggaggagggg

SEQ ID NO: 37990 - RNA, 24 nt, Artificial Sequence
  Synthetic
ccuggcucggggagggaggagggg

SEQ ID NO: 37991 - RNA, 18 nt, Artificial Sequence
  Synthetic
cgcccucugcccccgggg

SEQ ID NO: 37992 - RNA, 19 nt, Artificial Sequence
  Synthetic
acgcccucugcccccgggg

SEQ ID NO: 37993 - RNA, 20 nt, Artificial Sequence
  Synthetic
cacgcccucugcccccgggg

SEQ ID NO: 37994 - RNA, 22 nt, Artificial Sequence
  Synthetic
ugcacgcccucugcccccgggg

SEQ ID NO: 37995 - RNA, 23 nt, Artificial Sequence
  Synthetic
augcacgcccucugcccccgggg

SEQ ID NO: 37996 - RNA, 24 nt, Artificial Sequence
  Synthetic
caugcacgcccucugcccccgggg

SEQ ID NO: 37997 - RNA, 19 nt, Artificial Sequence
  Synthetic
ugggugggcgggcuggcug

SEQ ID NO: 37998 - RNA, 22 nt, Artificial Sequence
  Synthetic
uggugggugggcgggcuggcug

SEQ ID NO: 37999 - RNA, 23 nt, Artificial Sequence
  Synthetic
uuggugggugggcgggcuggcug

SEQ ID NO: 38000 - RNA, 24 nt, Artificial Sequence
  Synthetic
cuuggugggugggcgggcuggcug

SEQ ID NO: 38001 - RNA, 18 nt, Artificial Sequence
  Synthetic
uucuggcucccugucuug

SEQ ID NO: 38002 - RNA, 20 nt, Artificial Sequence
  Synthetic
cguucuggcucccugucuug

SEQ ID NO: 38003 - RNA, 21 nt, Artificial Sequence
  Synthetic
ucguucuggcucccugucuug

SEQ ID NO: 38004 - RNA, 22 nt, Artificial Sequence
  Synthetic
cucguucuggcucccugucuug

SEQ ID NO: 38005 - RNA, 23 nt, Artificial Sequence
  Synthetic
ccucguucuggcucccugucuug

SEQ ID NO: 38006 - RNA, 18 nt, Artificial Sequence
  Synthetic
ucuggccggccagacccu

SEQ ID NO: 38007 - RNA, 20 nt, Artificial Sequence
  Synthetic
cgucuggccggccagacccu

SEQ ID NO: 38008 - RNA, 21 nt, Artificial Sequence
  Synthetic
acgucuggccggccagacccu

SEQ ID NO: 38009 - RNA, 22 nt, Artificial Sequence
  Synthetic
cacgucuggccggccagacccu

SEQ ID NO: 38010 - RNA, 24 nt, Artificial Sequence
  Synthetic
cgcacgucuggccggccagacccu

SEQ ID NO: 38011 - RNA, 19 nt, Artificial Sequence
  Synthetic
cgucggaguggaacagccu

SEQ ID NO: 38012 - RNA, 21 nt, Artificial Sequence
  Synthetic
cgcgucggaguggaacagccu

SEQ ID NO: 38013 - RNA, 22 nt, Artificial Sequence
  Synthetic
ccgcgucggaguggaacagccu

SEQ ID NO: 38014 - RNA, 23 nt, Artificial Sequence
  Synthetic
cccgcgucggaguggaacagccu

SEQ ID NO: 38015 - RNA, 24 nt, Artificial Sequence
  Synthetic
ccccgcgucggaguggaacagccu

SEQ ID NO: 38016 - RNA, 19 nt, Artificial Sequence
  Synthetic
cggggaggagacaggaagu

SEQ ID NO: 38017 - RNA, 20 nt, Artificial Sequence
  Synthetic
acggggaggagacaggaagu

SEQ ID NO: 38018 - RNA, 22 nt, Artificial Sequence
  Synthetic
agacggggaggagacaggaagu

SEQ ID NO: 38019 - RNA, 23 nt, Artificial Sequence
  Synthetic
aagacggggaggagacaggaagu

SEQ ID NO: 38020 - RNA, 24 nt, Artificial Sequence
  Synthetic
aaagacggggaggagacaggaagu

SEQ ID NO: 38021 - RNA, 18 nt, Artificial Sequence
  Synthetic
acccgacgccccccgcgu

SEQ ID NO: 38022 - RNA, 19 nt, Artificial Sequence
  Synthetic
uacccgacgccccccgcgu

SEQ ID NO: 38023 - RNA, 20 nt, Artificial Sequence
  Synthetic
cuacccgacgccccccgcgu

SEQ ID NO: 38024 - RNA, 21 nt, Artificial Sequence
  Synthetic
acuacccgacgccccccgcgu

SEQ ID NO: 38025 - RNA, 23 nt, Artificial Sequence
  Synthetic
cgacuacccgacgccccccgcgu

SEQ ID NO: 38026 - RNA, 24 nt, Artificial Sequence
  Synthetic
ccgacuacccgacgccccccgcgu

SEQ ID NO: 38027 - RNA, 20 nt, Artificial Sequence
  Synthetic
aggagacaggaagugggggu

SEQ ID NO: 38028 - RNA, 20 nt, Artificial Sequence
  Synthetic
uggaaguccagcgcgcccac

SEQ ID NO: 38029 - RNA, 22 nt, Artificial Sequence
  Synthetic
cguggaaguccagcgcgcccac

SEQ ID NO: 38030 - RNA, 23 nt, Artificial Sequence
  Synthetic
ccguggaaguccagcgcgcccac

SEQ ID NO: 38031 - RNA, 18 nt, Artificial Sequence
  Synthetic
aaagagcauguugcccac

SEQ ID NO: 38032 - RNA, 19 nt, Artificial Sequence
  Synthetic
caaagagcauguugcccac

SEQ ID NO: 38033 - RNA, 20 nt, Artificial Sequence
  Synthetic
ucaaagagcauguugcccac

SEQ ID NO: 38034 - RNA, 23 nt, Artificial Sequence
  Synthetic
uggucaaagagcauguugcccac

SEQ ID NO: 38035 - RNA, 24 nt, Artificial Sequence
  Synthetic
cuggucaaagagcauguugcccac

SEQ ID NO: 38036 - RNA, 18 nt, Artificial Sequence
  Synthetic
cgcccugcucccgagacc

SEQ ID NO: 38037 - RNA, 20 nt, Artificial Sequence
  Synthetic
cgcgcccugcucccgagacc

SEQ ID NO: 38038 - RNA, 24 nt, Artificial Sequence
  Synthetic
cgggcgcgcccugcucccgagacc

SEQ ID NO: 38039 - RNA, 18 nt, Artificial Sequence
  Synthetic
acuccugcccaccacccc

SEQ ID NO: 38040 - RNA, 19 nt, Artificial Sequence
  Synthetic
cacuccugcccaccacccc

SEQ ID NO: 38041 - RNA, 20 nt, Artificial Sequence
  Synthetic
ccacuccugcccaccacccc

SEQ ID NO: 38042 - RNA, 21 nt, Artificial Sequence
  Synthetic
cccacuccugcccaccacccc

SEQ ID NO: 38043 - RNA, 22 nt, Artificial Sequence
  Synthetic
ucccacuccugcccaccacccc

SEQ ID NO: 38044 - RNA, 23 nt, Artificial Sequence
  Synthetic
cucccacuccugcccaccacccc

SEQ ID NO: 38045 - RNA, 24 nt, Artificial Sequence
  Synthetic
ccucccacuccugcccaccacccc

SEQ ID NO: 38046 - RNA, 18 nt, Artificial Sequence
  Synthetic
uaagugcgggugcaugcc

SEQ ID NO: 38047 - RNA, 20 nt, Artificial Sequence
  Synthetic
cguaagugcgggugcaugcc

SEQ ID NO: 38048 - RNA, 24 nt, Artificial Sequence
  Synthetic
cgggcguaagugcgggugcaugcc

SEQ ID NO: 38049 - RNA, 18 nt, Artificial Sequence
  Synthetic
ugagugcgguugcaugcc

SEQ ID NO: 38050 - RNA, 23 nt, Artificial Sequence
  Synthetic
uggggugagugcgguugcaugcc

SEQ ID NO: 38051 - RNA, 18 nt, Artificial Sequence
  Synthetic
cuccuccuuucucccagc

SEQ ID NO: 38052 - RNA, 19 nt, Artificial Sequence
  Synthetic
ccuccuccuuucucccagc

SEQ ID NO: 38053 - RNA, 20 nt, Artificial Sequence
  Synthetic
uccuccuccuuucucccagc

SEQ ID NO: 38054 - RNA, 21 nt, Artificial Sequence
  Synthetic
cuccuccuccuuucucccagc

SEQ ID NO: 38055 - RNA, 23 nt, Artificial Sequence
  Synthetic
ugcuccuccuccuuucucccagc

SEQ ID NO: 38056 - RNA, 24 nt, Artificial Sequence
  Synthetic
cugcuccuccuccuuucucccagc

SEQ ID NO: 38057 - RNA, 18 nt, Artificial Sequence
  Synthetic
ugggagucuccccgcagc

SEQ ID NO: 38058 - RNA, 19 nt, Artificial Sequence
  Synthetic
augggagucuccccgcagc

SEQ ID NO: 38059 - RNA, 21 nt, Artificial Sequence
  Synthetic
cgaugggagucuccccgcagc

SEQ ID NO: 38060 - RNA, 22 nt, Artificial Sequence
  Synthetic
ccgaugggagucuccccgcagc

SEQ ID NO: 38061 - RNA, 23 nt, Artificial Sequence
  Synthetic
cccgaugggagucuccccgcagc

SEQ ID NO: 38062 - RNA, 24 nt, Artificial Sequence
  Synthetic
ccccgaugggagucuccccgcagc

SEQ ID NO: 38063 - RNA, 18 nt, Artificial Sequence
  Synthetic
cggggugggcgccggggc

SEQ ID NO: 38064 - RNA, 22 nt, Artificial Sequence
  Synthetic
cgggcggggugggcgccggggc

SEQ ID NO: 38065 - RNA, 24 nt, Artificial Sequence
  Synthetic
ugcgggcggggugggcgccggggc

SEQ ID NO: 38066 - RNA, 18 nt, Artificial Sequence
  Synthetic
uaaagaccaacaggccuc

SEQ ID NO: 38067 - RNA, 19 nt, Artificial Sequence
  Synthetic
auaaagaccaacaggccuc

SEQ ID NO: 38068 - RNA, 21 nt, Artificial Sequence
  Synthetic
ugauaaagaccaacaggccuc

SEQ ID NO: 38069 - RNA, 22 nt, Artificial Sequence
  Synthetic
augauaaagaccaacaggccuc

SEQ ID NO: 38070 - RNA, 23 nt, Artificial Sequence
  Synthetic
uaugauaaagaccaacaggccuc

SEQ ID NO: 38071 - RNA, 24 nt, Artificial Sequence
  Synthetic
cuaugauaaagaccaacaggccuc

SEQ ID NO: 38072 - RNA, 18 nt, Artificial Sequence
  Synthetic
cuuccuucgggcagcaag

SEQ ID NO: 38073 - RNA, 21 nt, Artificial Sequence
  Synthetic
cggcuuccuucgggcagcaag

SEQ ID NO: 38074 - RNA, 19 nt, Artificial Sequence
  Synthetic
ugcgcgcgugcucggggag

SEQ ID NO: 38075 - RNA, 20 nt, Artificial Sequence
  Synthetic
uugcgcgcgugcucggggag

SEQ ID NO: 38076 - RNA, 22 nt, Artificial Sequence
  Synthetic
aguugcgcgcgugcucggggag

SEQ ID NO: 38077 - RNA, 23 nt, Artificial Sequence
  Synthetic
caguugcgcgcgugcucggggag

SEQ ID NO: 38078 - RNA, 18 nt, Artificial Sequence
  Synthetic
agcgcgugaggccgggcg

SEQ ID NO: 38079 - RNA, 19 nt, Artificial Sequence
  Synthetic
uagcgcgugaggccgggcg

SEQ ID NO: 38080 - RNA, 22 nt, Artificial Sequence
  Synthetic
agguagcgcgugaggccgggcg

SEQ ID NO: 38081 - RNA, 23 nt, Artificial Sequence
  Synthetic
cagguagcgcgugaggccgggcg

SEQ ID NO: 38082 - RNA, 18 nt, Artificial Sequence
  Synthetic
acuccgacgcggggggcg

SEQ ID NO: 38083 - RNA, 19 nt, Artificial Sequence
  Synthetic
cacuccgacgcggggggcg

SEQ ID NO: 38084 - RNA, 20 nt, Artificial Sequence
  Synthetic
ccacuccgacgcggggggcg

SEQ ID NO: 38085 - RNA, 21 nt, Artificial Sequence
  Synthetic
uccacuccgacgcggggggcg

SEQ ID NO: 38086 - RNA, 22 nt, Artificial Sequence
  Synthetic
uuccacuccgacgcggggggcg

SEQ ID NO: 38087 - RNA, 24 nt, Artificial Sequence
  Synthetic
uguuccacuccgacgcggggggcg

SEQ ID NO: 38088 - RNA, 19 nt, Artificial Sequence
  Synthetic
uggcgggcaggugugcggg

SEQ ID NO: 38089 - RNA, 21 nt, Artificial Sequence
  Synthetic
cguggcgggcaggugugcggg

SEQ ID NO: 38090 - RNA, 21 nt, Artificial Sequence
  Synthetic
cgggcaggugugcgggcgggg

SEQ ID NO: 38091 - RNA, 24 nt, Artificial Sequence
  Synthetic
uggcgggcaggugugcgggcgggg

SEQ ID NO: 38092 - RNA, 20 nt, Artificial Sequence
  Synthetic
aggugugcgggcgggguggg

SEQ ID NO: 38093 - RNA, 21 nt, Artificial Sequence
  Synthetic
caggugugcgggcgggguggg

SEQ ID NO: 38094 - RNA, 19 nt, Artificial Sequence
  Synthetic
cgagcccccucgccccgau

SEQ ID NO: 38095 - RNA, 21 nt, Artificial Sequence
  Synthetic
cgcgagcccccucgccccgau

SEQ ID NO: 38096 - RNA, 23 nt, Artificial Sequence
  Synthetic
cgcgcgagcccccucgccccgau

SEQ ID NO: 38097 - RNA, 24 nt, Artificial Sequence
  Synthetic
acgcgcgagcccccucgccccgau

SEQ ID NO: 38098 - RNA, 23 nt, Artificial Sequence
  Synthetic
cgggggugggcacgggcguaagu

SEQ ID NO: 38099 - RNA, 18 nt, Artificial Sequence
  Synthetic
ugauagagaggggggaaa

SEQ ID NO: 38100 - RNA, 19 nt, Artificial Sequence
  Synthetic
uugauagagaggggggaaa

SEQ ID NO: 38101 - RNA, 20 nt, Artificial Sequence
  Synthetic
uuugauagagaggggggaaa

SEQ ID NO: 38102 - RNA, 21 nt, Artificial Sequence
  Synthetic
cuuugauagagaggggggaaa

SEQ ID NO: 38103 - RNA, 22 nt, Artificial Sequence
  Synthetic
acuuugauagagaggggggaaa

SEQ ID NO: 38104 - RNA, 23 nt, Artificial Sequence
  Synthetic
aacuuugauagagaggggggaaa

SEQ ID NO: 38105 - RNA, 24 nt, Artificial Sequence
  Synthetic
gaacuuugauagagaggggggaaa

SEQ ID NO: 38106 - RNA, 18 nt, Artificial Sequence
  Synthetic
aggaaggaggagggagaa

SEQ ID NO: 38107 - RNA, 19 nt, Artificial Sequence
  Synthetic
gaggaaggaggagggagaa

SEQ ID NO: 38108 - RNA, 20 nt, Artificial Sequence
  Synthetic
ggaggaaggaggagggagaa

SEQ ID NO: 38109 - RNA, 21 nt, Artificial Sequence
  Synthetic
gggaggaaggaggagggagaa

SEQ ID NO: 38110 - RNA, 22 nt, Artificial Sequence
  Synthetic
ugggaggaaggaggagggagaa

SEQ ID NO: 38111 - RNA, 23 nt, Artificial Sequence
  Synthetic
gugggaggaaggaggagggagaa

SEQ ID NO: 38112 - RNA, 24 nt, Artificial Sequence
  Synthetic
ggugggaggaaggaggagggagaa

SEQ ID NO: 38113 - RNA, 18 nt, Artificial Sequence
  Synthetic
ucacccuggcugggagaa

SEQ ID NO: 38114 - RNA, 19 nt, Artificial Sequence
  Synthetic
cucacccuggcugggagaa

SEQ ID NO: 38115 - RNA, 20 nt, Artificial Sequence
  Synthetic
ccucacccuggcugggagaa

SEQ ID NO: 38116 - RNA, 21 nt, Artificial Sequence
  Synthetic
uccucacccuggcugggagaa

SEQ ID NO: 38117 - RNA, 22 nt, Artificial Sequence
  Synthetic
cuccucacccuggcugggagaa

SEQ ID NO: 38118 - RNA, 23 nt, Artificial Sequence
  Synthetic
ccuccucacccuggcugggagaa

SEQ ID NO: 38119 - RNA, 24 nt, Artificial Sequence
  Synthetic
cccuccucacccuggcugggagaa

SEQ ID NO: 38120 - RNA, 18 nt, Artificial Sequence
  Synthetic
uuggucuuuaucauagaa

SEQ ID NO: 38121 - RNA, 19 nt, Artificial Sequence
  Synthetic
guuggucuuuaucauagaa

SEQ ID NO: 38122 - RNA, 20 nt, Artificial Sequence
  Synthetic
uguuggucuuuaucauagaa

SEQ ID NO: 38123 - RNA, 21 nt, Artificial Sequence
  Synthetic
cuguuggucuuuaucauagaa

SEQ ID NO: 38124 - RNA, 22 nt, Artificial Sequence
  Synthetic
ccuguuggucuuuaucauagaa

SEQ ID NO: 38125 - RNA, 23 nt, Artificial Sequence
  Synthetic
gccuguuggucuuuaucauagaa

SEQ ID NO: 38126 - RNA, 24 nt, Artificial Sequence
  Synthetic
ggccuguuggucuuuaucauagaa

SEQ ID NO: 38127 - RNA, 18 nt, Artificial Sequence
  Synthetic
acggggaggagacaggaa

SEQ ID NO: 38128 - RNA, 19 nt, Artificial Sequence
  Synthetic
gacggggaggagacaggaa

SEQ ID NO: 38129 - RNA, 20 nt, Artificial Sequence
  Synthetic
agacggggaggagacaggaa

SEQ ID NO: 38130 - RNA, 21 nt, Artificial Sequence
  Synthetic
aagacggggaggagacaggaa

SEQ ID NO: 38131 - RNA, 22 nt, Artificial Sequence
  Synthetic
aaagacggggaggagacaggaa

SEQ ID NO: 38132 - RNA, 23 nt, Artificial Sequence
  Synthetic
gaaagacggggaggagacaggaa

SEQ ID NO: 38133 - RNA, 24 nt, Artificial Sequence
  Synthetic
ggaaagacggggaggagacaggaa

SEQ ID NO: 38134 - RNA, 18 nt, Artificial Sequence
  Synthetic
aaggaggaggagcaggaa

SEQ ID NO: 38135 - RNA, 19 nt, Artificial Sequence
  Synthetic
aaaggaggaggagcaggaa

SEQ ID NO: 38136 - RNA, 20 nt, Artificial Sequence
  Synthetic
gaaaggaggaggagcaggaa

SEQ ID NO: 38137 - RNA, 21 nt, Artificial Sequence
  Synthetic
agaaaggaggaggagcaggaa

SEQ ID NO: 38138 - RNA, 22 nt, Artificial Sequence
  Synthetic
gagaaaggaggaggagcaggaa

SEQ ID NO: 38139 - RNA, 23 nt, Artificial Sequence
  Synthetic
ggagaaaggaggaggagcaggaa

SEQ ID NO: 38140 - RNA, 24 nt, Artificial Sequence
  Synthetic
gggagaaaggaggaggagcaggaa

SEQ ID NO: 38141 - RNA, 18 nt, Artificial Sequence
  Synthetic
gccggggaugggggggaa

SEQ ID NO: 38142 - RNA, 19 nt, Artificial Sequence
  Synthetic
ggccggggaugggggggaa

SEQ ID NO: 38143 - RNA, 20 nt, Artificial Sequence
  Synthetic
gggccggggaugggggggaa

SEQ ID NO: 38144 - RNA, 21 nt, Artificial Sequence
  Synthetic
ggggccggggaugggggggaa

SEQ ID NO: 38145 - RNA, 22 nt, Artificial Sequence
  Synthetic
gggggccggggaugggggggaa

SEQ ID NO: 38146 - RNA, 23 nt, Artificial Sequence
  Synthetic
ggggggccggggaugggggggaa

SEQ ID NO: 38147 - RNA, 24 nt, Artificial Sequence
  Synthetic
aggggggccggggaugggggggaa

SEQ ID NO: 38148 - RNA, 18 nt, Artificial Sequence
  Synthetic
acauggagacgggccaca

SEQ ID NO: 38149 - RNA, 19 nt, Artificial Sequence
  Synthetic
gacauggagacgggccaca

SEQ ID NO: 38150 - RNA, 20 nt, Artificial Sequence
  Synthetic
ggacauggagacgggccaca

SEQ ID NO: 38151 - RNA, 21 nt, Artificial Sequence
  Synthetic
uggacauggagacgggccaca

SEQ ID NO: 38152 - RNA, 22 nt, Artificial Sequence
  Synthetic
cuggacauggagacgggccaca

SEQ ID NO: 38153 - RNA, 23 nt, Artificial Sequence
  Synthetic
ccuggacauggagacgggccaca

SEQ ID NO: 38154 - RNA, 24 nt, Artificial Sequence
  Synthetic
uccuggacauggagacgggccaca

SEQ ID NO: 38155 - RNA, 18 nt, Artificial Sequence
  Synthetic
gccugcccguccuggaca

SEQ ID NO: 38156 - RNA, 19 nt, Artificial Sequence
  Synthetic
ugccugcccguccuggaca

SEQ ID NO: 38157 - RNA, 20 nt, Artificial Sequence
  Synthetic
cugccugcccguccuggaca

SEQ ID NO: 38158 - RNA, 21 nt, Artificial Sequence
  Synthetic
acugccugcccguccuggaca

SEQ ID NO: 38159 - RNA, 22 nt, Artificial Sequence
  Synthetic
gacugccugcccguccuggaca

SEQ ID NO: 38160 - RNA, 23 nt, Artificial Sequence
  Synthetic
ggacugccugcccguccuggaca

SEQ ID NO: 38161 - RNA, 24 nt, Artificial Sequence
  Synthetic
gggacugccugcccguccuggaca

SEQ ID NO: 38162 - RNA, 18 nt, Artificial Sequence
  Synthetic
aguguguccguguugaca

SEQ ID NO: 38163 - RNA, 19 nt, Artificial Sequence
  Synthetic
gaguguguccguguugaca

SEQ ID NO: 38164 - RNA, 20 nt, Artificial Sequence
  Synthetic
agaguguguccguguugaca

SEQ ID NO: 38165 - RNA, 21 nt, Artificial Sequence
  Synthetic
aagaguguguccguguugaca

SEQ ID NO: 38166 - RNA, 22 nt, Artificial Sequence
  Synthetic
aaagaguguguccguguugaca

SEQ ID NO: 38167 - RNA, 23 nt, Artificial Sequence
  Synthetic
aaaagaguguguccguguugaca

SEQ ID NO: 38168 - RNA, 24 nt, Artificial Sequence
  Synthetic
aaaaagaguguguccguguugaca

SEQ ID NO: 38169 - RNA, 18 nt, Artificial Sequence
  Synthetic
gaaggaagccgcccccca

SEQ ID NO: 38170 - RNA, 19 nt, Artificial Sequence
  Synthetic
cgaaggaagccgcccccca

SEQ ID NO: 38171 - RNA, 20 nt, Artificial Sequence
  Synthetic
ccgaaggaagccgcccccca

SEQ ID NO: 38172 - RNA, 21 nt, Artificial Sequence
  Synthetic
cccgaaggaagccgcccccca

SEQ ID NO: 38173 - RNA, 22 nt, Artificial Sequence
  Synthetic
gcccgaaggaagccgcccccca

SEQ ID NO: 38174 - RNA, 23 nt, Artificial Sequence
  Synthetic
ugcccgaaggaagccgcccccca

SEQ ID NO: 38175 - RNA, 24 nt, Artificial Sequence
  Synthetic
cugcccgaaggaagccgcccccca

SEQ ID NO: 38176 - RNA, 18 nt, Artificial Sequence
  Synthetic
gcugcggggagacuccca

SEQ ID NO: 38177 - RNA, 19 nt, Artificial Sequence
  Synthetic
ggcugcggggagacuccca

SEQ ID NO: 38178 - RNA, 20 nt, Artificial Sequence
  Synthetic
uggcugcggggagacuccca

SEQ ID NO: 38179 - RNA, 21 nt, Artificial Sequence
  Synthetic
cuggcugcggggagacuccca

SEQ ID NO: 38180 - RNA, 22 nt, Artificial Sequence
  Synthetic
ccuggcugcggggagacuccca

SEQ ID NO: 38181 - RNA, 23 nt, Artificial Sequence
  Synthetic
cccuggcugcggggagacuccca

SEQ ID NO: 38182 - RNA, 24 nt, Artificial Sequence
  Synthetic
acccuggcugcggggagacuccca

SEQ ID NO: 38183 - RNA, 18 nt, Artificial Sequence
  Synthetic
cgacgcccccgcgggcca

SEQ ID NO: 38184 - RNA, 19 nt, Artificial Sequence
  Synthetic
gcgacgcccccgcgggcca

SEQ ID NO: 38185 - RNA, 20 nt, Artificial Sequence
  Synthetic
ggcgacgcccccgcgggcca

SEQ ID NO: 38186 - RNA, 21 nt, Artificial Sequence
  Synthetic
cggcgacgcccccgcgggcca

SEQ ID NO: 38187 - RNA, 22 nt, Artificial Sequence
  Synthetic
ccggcgacgcccccgcgggcca

SEQ ID NO: 38188 - RNA, 23 nt, Artificial Sequence
  Synthetic
gccggcgacgcccccgcgggcca

SEQ ID NO: 38189 - RNA, 24 nt, Artificial Sequence
  Synthetic
ggccggcgacgcccccgcgggcca

SEQ ID NO: 38190 - RNA, 18 nt, Artificial Sequence
  Synthetic
gcgcgaagccaggggcca

SEQ ID NO: 38191 - RNA, 19 nt, Artificial Sequence
  Synthetic
ggcgcgaagccaggggcca

SEQ ID NO: 38192 - RNA, 20 nt, Artificial Sequence
  Synthetic
cggcgcgaagccaggggcca

SEQ ID NO: 38193 - RNA, 21 nt, Artificial Sequence
  Synthetic
ccggcgcgaagccaggggcca

SEQ ID NO: 38194 - RNA, 22 nt, Artificial Sequence
  Synthetic
accggcgcgaagccaggggcca

SEQ ID NO: 38195 - RNA, 23 nt, Artificial Sequence
  Synthetic
caccggcgcgaagccaggggcca

SEQ ID NO: 38196 - RNA, 24 nt, Artificial Sequence
  Synthetic
ccaccggcgcgaagccaggggcca

SEQ ID NO: 38197 - RNA, 18 nt, Artificial Sequence
  Synthetic
augcagcucccccgcgca

SEQ ID NO: 38198 - RNA, 19 nt, Artificial Sequence
  Synthetic
gaugcagcucccccgcgca

SEQ ID NO: 38199 - RNA, 20 nt, Artificial Sequence
  Synthetic
ugaugcagcucccccgcgca

SEQ ID NO: 38200 - RNA, 21 nt, Artificial Sequence
  Synthetic
uugaugcagcucccccgcgca

SEQ ID NO: 38201 - RNA, 22 nt, Artificial Sequence
  Synthetic
uuugaugcagcucccccgcgca

SEQ ID NO: 38202 - RNA, 23 nt, Artificial Sequence
  Synthetic
cuuugaugcagcucccccgcgca

SEQ ID NO: 38203 - RNA, 24 nt, Artificial Sequence
  Synthetic
ccuuugaugcagcucccccgcgca

SEQ ID NO: 38204 - RNA, 18 nt, Artificial Sequence
  Synthetic
cgaggcgccucgggggca

SEQ ID NO: 38205 - RNA, 19 nt, Artificial Sequence
  Synthetic
ccgaggcgccucgggggca

SEQ ID NO: 38206 - RNA, 20 nt, Artificial Sequence
  Synthetic
gccgaggcgccucgggggca

SEQ ID NO: 38207 - RNA, 21 nt, Artificial Sequence
  Synthetic
ggccgaggcgccucgggggca

SEQ ID NO: 38208 - RNA, 22 nt, Artificial Sequence
  Synthetic
cggccgaggcgccucgggggca

SEQ ID NO: 38209 - RNA, 23 nt, Artificial Sequence
  Synthetic
ccggccgaggcgccucgggggca

SEQ ID NO: 38210 - RNA, 24 nt, Artificial Sequence
  Synthetic
accggccgaggcgccucgggggca

SEQ ID NO: 38211 - RNA, 18 nt, Artificial Sequence
  Synthetic
gccuguuggucuuuauca

SEQ ID NO: 38212 - RNA, 19 nt, Artificial Sequence
  Synthetic
ggccuguuggucuuuauca

SEQ ID NO: 38213 - RNA, 20 nt, Artificial Sequence
  Synthetic
aggccuguuggucuuuauca

SEQ ID NO: 38214 - RNA, 21 nt, Artificial Sequence
  Synthetic
gaggccuguuggucuuuauca

SEQ ID NO: 38215 - RNA, 22 nt, Artificial Sequence
  Synthetic
cgaggccuguuggucuuuauca

SEQ ID NO: 38216 - RNA, 23 nt, Artificial Sequence
  Synthetic
ccgaggccuguuggucuuuauca

SEQ ID NO: 38217 - RNA, 24 nt, Artificial Sequence
  Synthetic
cccgaggccuguuggucuuuauca

SEQ ID NO: 38218 - RNA, 18 nt, Artificial Sequence
  Synthetic
acgugaacaagacgguca

SEQ ID NO: 38219 - RNA, 19 nt, Artificial Sequence
  Synthetic
uacgugaacaagacgguca

SEQ ID NO: 38220 - RNA, 20 nt, Artificial Sequence
  Synthetic
uuacgugaacaagacgguca

SEQ ID NO: 38221 - RNA, 21 nt, Artificial Sequence
  Synthetic
cuuacgugaacaagacgguca

SEQ ID NO: 38222 - RNA, 22 nt, Artificial Sequence
  Synthetic
ccuuacgugaacaagacgguca

SEQ ID NO: 38223 - RNA, 23 nt, Artificial Sequence
  Synthetic
gccuuacgugaacaagacgguca

SEQ ID NO: 38224 - RNA, 24 nt, Artificial Sequence
  Synthetic
cgccuuacgugaacaagacgguca

SEQ ID NO: 38225 - RNA, 18 nt, Artificial Sequence
  Synthetic
gguggggggggggaaaga

SEQ ID NO: 38226 - RNA, 19 nt, Artificial Sequence
  Synthetic
agguggggggggggaaaga

SEQ ID NO: 38227 - RNA, 20 nt, Artificial Sequence
  Synthetic
gagguggggggggggaaaga

SEQ ID NO: 38228 - RNA, 21 nt, Artificial Sequence
  Synthetic
ggagguggggggggggaaaga

SEQ ID NO: 38229 - RNA, 22 nt, Artificial Sequence
  Synthetic
gggagguggggggggggaaaga

SEQ ID NO: 38230 - RNA, 23 nt, Artificial Sequence
  Synthetic
ggggagguggggggggggaaaga

SEQ ID NO: 38231 - RNA, 24 nt, Artificial Sequence
  Synthetic
gggggagguggggggggggaaaga

SEQ ID NO: 38232 - RNA, 18 nt, Artificial Sequence
  Synthetic
ugguccucguggaccaga

SEQ ID NO: 38233 - RNA, 19 nt, Artificial Sequence
  Synthetic
gugguccucguggaccaga

SEQ ID NO: 38234 - RNA, 20 nt, Artificial Sequence
  Synthetic
cgugguccucguggaccaga

SEQ ID NO: 38235 - RNA, 21 nt, Artificial Sequence
  Synthetic
acgugguccucguggaccaga

SEQ ID NO: 38236 - RNA, 22 nt, Artificial Sequence
  Synthetic
uacgugguccucguggaccaga

SEQ ID NO: 38237 - RNA, 23 nt, Artificial Sequence
  Synthetic
cuacgugguccucguggaccaga

SEQ ID NO: 38238 - RNA, 24 nt, Artificial Sequence
  Synthetic
ccuacgugguccucguggaccaga

SEQ ID NO: 38239 - RNA, 18 nt, Artificial Sequence
  Synthetic
agggaacuuugauagaga

SEQ ID NO: 38240 - RNA, 19 nt, Artificial Sequence
  Synthetic
cagggaacuuugauagaga

SEQ ID NO: 38241 - RNA, 20 nt, Artificial Sequence
  Synthetic
ccagggaacuuugauagaga

SEQ ID NO: 38242 - RNA, 21 nt, Artificial Sequence
  Synthetic
gccagggaacuuugauagaga

SEQ ID NO: 38243 - RNA, 22 nt, Artificial Sequence
  Synthetic
ggccagggaacuuugauagaga

SEQ ID NO: 38244 - RNA, 23 nt, Artificial Sequence
  Synthetic
gggccagggaacuuugauagaga

SEQ ID NO: 38245 - RNA, 24 nt, Artificial Sequence
  Synthetic
ggggccagggaacuuugauagaga

SEQ ID NO: 38246 - RNA, 18 nt, Artificial Sequence
  Synthetic
ggaaagacggggaggaga

SEQ ID NO: 38247 - RNA, 19 nt, Artificial Sequence
  Synthetic
gggaaagacggggaggaga

SEQ ID NO: 38248 - RNA, 20 nt, Artificial Sequence
  Synthetic
ggggaaagacggggaggaga

SEQ ID NO: 38249 - RNA, 21 nt, Artificial Sequence
  Synthetic
gggggaaagacggggaggaga

SEQ ID NO: 38250 - RNA, 22 nt, Artificial Sequence
  Synthetic
ggggggaaagacggggaggaga

SEQ ID NO: 38251 - RNA, 23 nt, Artificial Sequence
  Synthetic
gggggggaaagacggggaggaga

SEQ ID NO: 38252 - RNA, 24 nt, Artificial Sequence
  Synthetic
ggggggggaaagacggggaggaga

SEQ ID NO: 38253 - RNA, 18 nt, Artificial Sequence
  Synthetic
cucacccuggcugggaga

SEQ ID NO: 38254 - RNA, 19 nt, Artificial Sequence
  Synthetic
ccucacccuggcugggaga

SEQ ID NO: 38255 - RNA, 20 nt, Artificial Sequence
  Synthetic
uccucacccuggcugggaga

SEQ ID NO: 38256 - RNA, 21 nt, Artificial Sequence
  Synthetic
cuccucacccuggcugggaga

SEQ ID NO: 38257 - RNA, 22 nt, Artificial Sequence
  Synthetic
ccuccucacccuggcugggaga

SEQ ID NO: 38258 - RNA, 23 nt, Artificial Sequence
  Synthetic
cccuccucacccuggcugggaga

SEQ ID NO: 38259 - RNA, 24 nt, Artificial Sequence
  Synthetic
ccccuccucacccuggcugggaga

SEQ ID NO: 38260 - RNA, 18 nt, Artificial Sequence
  Synthetic
ccagggaacuuugauaga

SEQ ID NO: 38261 - RNA, 19 nt, Artificial Sequence
  Synthetic
gccagggaacuuugauaga

SEQ ID NO: 38262 - RNA, 20 nt, Artificial Sequence
  Synthetic
ggccagggaacuuugauaga

SEQ ID NO: 38263 - RNA, 21 nt, Artificial Sequence
  Synthetic
gggccagggaacuuugauaga

SEQ ID NO: 38264 - RNA, 22 nt, Artificial Sequence
  Synthetic
ggggccagggaacuuugauaga

SEQ ID NO: 38265 - RNA, 23 nt, Artificial Sequence
  Synthetic
aggggccagggaacuuugauaga

SEQ ID NO: 38266 - RNA, 24 nt, Artificial Sequence
  Synthetic
caggggccagggaacuuugauaga

SEQ ID NO: 38267 - RNA, 18 nt, Artificial Sequence
  Synthetic
acucggcuugcugcccga

SEQ ID NO: 38268 - RNA, 19 nt, Artificial Sequence
  Synthetic
cacucggcuugcugcccga

SEQ ID NO: 38269 - RNA, 20 nt, Artificial Sequence
  Synthetic
acacucggcuugcugcccga

SEQ ID NO: 38270 - RNA, 21 nt, Artificial Sequence
  Synthetic
aacacucggcuugcugcccga

SEQ ID NO: 38271 - RNA, 22 nt, Artificial Sequence
  Synthetic
uaacacucggcuugcugcccga

SEQ ID NO: 38272 - RNA, 23 nt, Artificial Sequence
  Synthetic
cuaacacucggcuugcugcccga

SEQ ID NO: 38273 - RNA, 24 nt, Artificial Sequence
  Synthetic
gcuaacacucggcuugcugcccga

SEQ ID NO: 38274 - RNA, 18 nt, Artificial Sequence
  Synthetic
agacucccaucggggcga

SEQ ID NO: 38275 - RNA, 19 nt, Artificial Sequence
  Synthetic
gagacucccaucggggcga

SEQ ID NO: 38276 - RNA, 20 nt, Artificial Sequence
  Synthetic
ggagacucccaucggggcga

SEQ ID NO: 38277 - RNA, 21 nt, Artificial Sequence
  Synthetic
gggagacucccaucggggcga

SEQ ID NO: 38278 - RNA, 22 nt, Artificial Sequence
  Synthetic
ggggagacucccaucggggcga

SEQ ID NO: 38279 - RNA, 23 nt, Artificial Sequence
  Synthetic
cggggagacucccaucggggcga

SEQ ID NO: 38280 - RNA, 24 nt, Artificial Sequence
  Synthetic
gcggggagacucccaucggggcga

SEQ ID NO: 38281 - RNA, 18 nt, Artificial Sequence
  Synthetic
uggggguggugggcagga

SEQ ID NO: 38282 - RNA, 19 nt, Artificial Sequence
  Synthetic
cuggggguggugggcagga

SEQ ID NO: 38283 - RNA, 20 nt, Artificial Sequence
  Synthetic
ccuggggguggugggcagga

SEQ ID NO: 38284 - RNA, 21 nt, Artificial Sequence
  Synthetic
cccuggggguggugggcagga

SEQ ID NO: 38285 - RNA, 22 nt, Artificial Sequence
  Synthetic
acccuggggguggugggcagga

SEQ ID NO: 38286 - RNA, 23 nt, Artificial Sequence
  Synthetic
gacccuggggguggugggcagga

SEQ ID NO: 38287 - RNA, 24 nt, Artificial Sequence
  Synthetic
agacccuggggguggugggcagga

SEQ ID NO: 38288 - RNA, 18 nt, Artificial Sequence
  Synthetic
gggugggaggaaggagga

SEQ ID NO: 38289 - RNA, 19 nt, Artificial Sequence
  Synthetic
cgggugggaggaaggagga

SEQ ID NO: 38290 - RNA, 20 nt, Artificial Sequence
  Synthetic
acgggugggaggaaggagga

SEQ ID NO: 38291 - RNA, 21 nt, Artificial Sequence
  Synthetic
gacgggugggaggaaggagga

SEQ ID NO: 38292 - RNA, 22 nt, Artificial Sequence
  Synthetic
ggacgggugggaggaaggagga

SEQ ID NO: 38293 - RNA, 23 nt, Artificial Sequence
  Synthetic
gggacgggugggaggaaggagga

SEQ ID NO: 38294 - RNA, 24 nt, Artificial Sequence
  Synthetic
ggggacgggugggaggaaggagga

SEQ ID NO: 38295 - RNA, 18 nt, Artificial Sequence
  Synthetic
gggaagggaggaggagga

SEQ ID NO: 38296 - RNA, 19 nt, Artificial Sequence
  Synthetic
ggggaagggaggaggagga

SEQ ID NO: 38297 - RNA, 20 nt, Artificial Sequence
  Synthetic
gggggaagggaggaggagga

SEQ ID NO: 38298 - RNA, 21 nt, Artificial Sequence
  Synthetic
ggggggaagggaggaggagga

SEQ ID NO: 38299 - RNA, 22 nt, Artificial Sequence
  Synthetic
gggggggaagggaggaggagga

SEQ ID NO: 38300 - RNA, 23 nt, Artificial Sequence
  Synthetic
ugggggggaagggaggaggagga

SEQ ID NO: 38301 - RNA, 24 nt, Artificial Sequence
  Synthetic
augggggggaagggaggaggagga

SEQ ID NO: 38302 - RNA, 18 nt, Artificial Sequence
  Synthetic
uggcucggggagggagga

SEQ ID NO: 38303 - RNA, 19 nt, Artificial Sequence
  Synthetic
cuggcucggggagggagga

SEQ ID NO: 38304 - RNA, 20 nt, Artificial Sequence
  Synthetic
ccuggcucggggagggagga

SEQ ID NO: 38305 - RNA, 21 nt, Artificial Sequence
  Synthetic
gccuggcucggggagggagga

SEQ ID NO: 38306 - RNA, 22 nt, Artificial Sequence
  Synthetic
cgccuggcucggggagggagga

SEQ ID NO: 38307 - RNA, 23 nt, Artificial Sequence
  Synthetic
gcgccuggcucggggagggagga

SEQ ID NO: 38308 - RNA, 24 nt, Artificial Sequence
  Synthetic
ggcgccuggcucggggagggagga

SEQ ID NO: 38309 - RNA, 18 nt, Artificial Sequence
  Synthetic
cggggacgggugggagga

SEQ ID NO: 38310 - RNA, 19 nt, Artificial Sequence
  Synthetic
ccggggacgggugggagga

SEQ ID NO: 38311 - RNA, 20 nt, Artificial Sequence
  Synthetic
cccggggacgggugggagga

SEQ ID NO: 38312 - RNA, 21 nt, Artificial Sequence
  Synthetic
ccccggggacgggugggagga

SEQ ID NO: 38313 - RNA, 22 nt, Artificial Sequence
  Synthetic
cccccggggacgggugggagga

SEQ ID NO: 38314 - RNA, 23 nt, Artificial Sequence
  Synthetic
gcccccggggacgggugggagga

SEQ ID NO: 38315 - RNA, 24 nt, Artificial Sequence
  Synthetic
ugcccccggggacgggugggagga

SEQ ID NO: 38316 - RNA, 18 nt, Artificial Sequence
  Synthetic
gacgccccccgcgucgga

SEQ ID NO: 38317 - RNA, 19 nt, Artificial Sequence
  Synthetic
cgacgccccccgcgucgga

SEQ ID NO: 38318 - RNA, 20 nt, Artificial Sequence
  Synthetic
ccgacgccccccgcgucgga

SEQ ID NO: 38319 - RNA, 21 nt, Artificial Sequence
  Synthetic
cccgacgccccccgcgucgga

SEQ ID NO: 38320 - RNA, 22 nt, Artificial Sequence
  Synthetic
acccgacgccccccgcgucgga

SEQ ID NO: 38321 - RNA, 23 nt, Artificial Sequence
  Synthetic
uacccgacgccccccgcgucgga

SEQ ID NO: 38322 - RNA, 24 nt, Artificial Sequence
  Synthetic
cuacccgacgccccccgcgucgga

SEQ ID NO: 38323 - RNA, 18 nt, Artificial Sequence
  Synthetic
uguccguguugacaggga

SEQ ID NO: 38324 - RNA, 19 nt, Artificial Sequence
  Synthetic
guguccguguugacaggga

SEQ ID NO: 38325 - RNA, 20 nt, Artificial Sequence
  Synthetic
uguguccguguugacaggga

SEQ ID NO: 38326 - RNA, 21 nt, Artificial Sequence
  Synthetic
guguguccguguugacaggga

SEQ ID NO: 38327 - RNA, 22 nt, Artificial Sequence
  Synthetic
aguguguccguguugacaggga

SEQ ID NO: 38328 - RNA, 23 nt, Artificial Sequence
  Synthetic
gaguguguccguguugacaggga

SEQ ID NO: 38329 - RNA, 24 nt, Artificial Sequence
  Synthetic
agaguguguccguguugacaggga

SEQ ID NO: 38330 - RNA, 18 nt, Artificial Sequence
  Synthetic
gcgcaggggggccgggga

SEQ ID NO: 38331 - RNA, 19 nt, Artificial Sequence
  Synthetic
cgcgcaggggggccgggga

SEQ ID NO: 38332 - RNA, 20 nt, Artificial Sequence
  Synthetic
ccgcgcaggggggccgggga

SEQ ID NO: 38333 - RNA, 21 nt, Artificial Sequence
  Synthetic
cccgcgcaggggggccgggga

SEQ ID NO: 38334 - RNA, 22 nt, Artificial Sequence
  Synthetic
ccccgcgcaggggggccgggga

SEQ ID NO: 38335 - RNA, 23 nt, Artificial Sequence
  Synthetic
cccccgcgcaggggggccgggga

SEQ ID NO: 38336 - RNA, 24 nt, Artificial Sequence
  Synthetic
ucccccgcgcaggggggccgggga

SEQ ID NO: 38337 - RNA, 18 nt, Artificial Sequence
  Synthetic
gggcgccuggcucgggga

SEQ ID NO: 38338 - RNA, 19 nt, Artificial Sequence
  Synthetic
agggcgccuggcucgggga

SEQ ID NO: 38339 - RNA, 20 nt, Artificial Sequence
  Synthetic
gagggcgccuggcucgggga

SEQ ID NO: 38340 - RNA, 21 nt, Artificial Sequence
  Synthetic
ggagggcgccuggcucgggga

SEQ ID NO: 38341 - RNA, 22 nt, Artificial Sequence
  Synthetic
gggagggcgccuggcucgggga

SEQ ID NO: 38342 - RNA, 23 nt, Artificial Sequence
  Synthetic
ugggagggcgccuggcucgggga

SEQ ID NO: 38343 - RNA, 24 nt, Artificial Sequence
  Synthetic
gugggagggcgccuggcucgggga

SEQ ID NO: 38344 - RNA, 18 nt, Artificial Sequence
  Synthetic
ggccggggauggggggga

SEQ ID NO: 38345 - RNA, 19 nt, Artificial Sequence
  Synthetic
gggccggggauggggggga

SEQ ID NO: 38346 - RNA, 20 nt, Artificial Sequence
  Synthetic
ggggccggggauggggggga

SEQ ID NO: 38347 - RNA, 21 nt, Artificial Sequence
  Synthetic
gggggccggggauggggggga

SEQ ID NO: 38348 - RNA, 22 nt, Artificial Sequence
  Synthetic
ggggggccggggauggggggga

SEQ ID NO: 38349 - RNA, 23 nt, Artificial Sequence
  Synthetic
aggggggccggggauggggggga

SEQ ID NO: 38350 - RNA, 24 nt, Artificial Sequence
  Synthetic
caggggggccggggauggggggga

SEQ ID NO: 38351 - RNA, 18 nt, Artificial Sequence
  Synthetic
caggaaguggggguggga

SEQ ID NO: 38352 - RNA, 19 nt, Artificial Sequence
  Synthetic
acaggaaguggggguggga

SEQ ID NO: 38353 - RNA, 20 nt, Artificial Sequence
  Synthetic
gacaggaaguggggguggga

SEQ ID NO: 38354 - RNA, 21 nt, Artificial Sequence
  Synthetic
agacaggaaguggggguggga

SEQ ID NO: 38355 - RNA, 22 nt, Artificial Sequence
  Synthetic
gagacaggaaguggggguggga

SEQ ID NO: 38356 - RNA, 23 nt, Artificial Sequence
  Synthetic
ggagacaggaaguggggguggga

SEQ ID NO: 38357 - RNA, 24 nt, Artificial Sequence
  Synthetic
aggagacaggaaguggggguggga

SEQ ID NO: 38358 - RNA, 18 nt, Artificial Sequence
  Synthetic
agaguguguccguguuga

SEQ ID NO: 38359 - RNA, 19 nt, Artificial Sequence
  Synthetic
aagaguguguccguguuga

SEQ ID NO: 38360 - RNA, 20 nt, Artificial Sequence
  Synthetic
aaagaguguguccguguuga

SEQ ID NO: 38361 - RNA, 21 nt, Artificial Sequence
  Synthetic
aaaagaguguguccguguuga

SEQ ID NO: 38362 - RNA, 22 nt, Artificial Sequence
  Synthetic
aaaaagaguguguccguguuga

SEQ ID NO: 38363 - RNA, 23 nt, Artificial Sequence
  Synthetic
aaaaaagaguguguccguguuga

SEQ ID NO: 38364 - RNA, 24 nt, Artificial Sequence
  Synthetic
aaaaaaagaguguguccguguuga

SEQ ID NO: 38365 - RNA, 18 nt, Artificial Sequence
  Synthetic
ggggccagggaacuuuga

SEQ ID NO: 38366 - RNA, 19 nt, Artificial Sequence
  Synthetic
aggggccagggaacuuuga

SEQ ID NO: 38367 - RNA, 20 nt, Artificial Sequence
  Synthetic
caggggccagggaacuuuga

SEQ ID NO: 38368 - RNA, 21 nt, Artificial Sequence
  Synthetic
ccaggggccagggaacuuuga

SEQ ID NO: 38369 - RNA, 22 nt, Artificial Sequence
  Synthetic
gccaggggccagggaacuuuga

SEQ ID NO: 38370 - RNA, 23 nt, Artificial Sequence
  Synthetic
agccaggggccagggaacuuuga

SEQ ID NO: 38371 - RNA, 24 nt, Artificial Sequence
  Synthetic
aagccaggggccagggaacuuuga

SEQ ID NO: 38372 - RNA, 18 nt, Artificial Sequence
  Synthetic
ggccagggaacuuugaua

SEQ ID NO: 38373 - RNA, 19 nt, Artificial Sequence
  Synthetic
gggccagggaacuuugaua

SEQ ID NO: 38374 - RNA, 20 nt, Artificial Sequence
  Synthetic
ggggccagggaacuuugaua

SEQ ID NO: 38375 - RNA, 21 nt, Artificial Sequence
  Synthetic
aggggccagggaacuuugaua

SEQ ID NO: 38376 - RNA, 22 nt, Artificial Sequence
  Synthetic
caggggccagggaacuuugaua

SEQ ID NO: 38377 - RNA, 23 nt, Artificial Sequence
  Synthetic
ccaggggccagggaacuuugaua

SEQ ID NO: 38378 - RNA, 24 nt, Artificial Sequence
  Synthetic
gccaggggccagggaacuuugaua

SEQ ID NO: 38379 - RNA, 18 nt, Artificial Sequence
  Synthetic
cgcgggccacggggagua

SEQ ID NO: 38380 - RNA, 19 nt, Artificial Sequence
  Synthetic
ccgcgggccacggggagua

SEQ ID NO: 38381 - RNA, 20 nt, Artificial Sequence
  Synthetic
cccgcgggccacggggagua

SEQ ID NO: 38382 - RNA, 21 nt, Artificial Sequence
  Synthetic
ccccgcgggccacggggagua

SEQ ID NO: 38383 - RNA, 22 nt, Artificial Sequence
  Synthetic
cccccgcgggccacggggagua

SEQ ID NO: 38384 - RNA, 23 nt, Artificial Sequence
  Synthetic
gcccccgcgggccacggggagua

SEQ ID NO: 38385 - RNA, 24 nt, Artificial Sequence
  Synthetic
cgcccccgcgggccacggggagua

SEQ ID NO: 38386 - RNA, 18 nt, Artificial Sequence
  Synthetic
ucuggccuuguugaaaac

SEQ ID NO: 38387 - RNA, 19 nt, Artificial Sequence
  Synthetic
uucuggccuuguugaaaac

SEQ ID NO: 38388 - RNA, 20 nt, Artificial Sequence
  Synthetic
uuucuggccuuguugaaaac

SEQ ID NO: 38389 - RNA, 21 nt, Artificial Sequence
  Synthetic
cuuucuggccuuguugaaaac

SEQ ID NO: 38390 - RNA, 22 nt, Artificial Sequence
  Synthetic
acuuucuggccuuguugaaaac

SEQ ID NO: 38391 - RNA, 23 nt, Artificial Sequence
  Synthetic
gacuuucuggccuuguugaaaac

SEQ ID NO: 38392 - RNA, 24 nt, Artificial Sequence
  Synthetic
ggacuuucuggccuuguugaaaac

SEQ ID NO: 38393 - RNA, 18 nt, Artificial Sequence
  Synthetic
gccaggaagacgcgccac

SEQ ID NO: 38394 - RNA, 19 nt, Artificial Sequence
  Synthetic
ugccaggaagacgcgccac

SEQ ID NO: 38395 - RNA, 20 nt, Artificial Sequence
  Synthetic
gugccaggaagacgcgccac

SEQ ID NO: 38396 - RNA, 21 nt, Artificial Sequence
  Synthetic
ugugccaggaagacgcgccac

SEQ ID NO: 38397 - RNA, 22 nt, Artificial Sequence
  Synthetic
gugugccaggaagacgcgccac

SEQ ID NO: 38398 - RNA, 23 nt, Artificial Sequence
  Synthetic
agugugccaggaagacgcgccac

SEQ ID NO: 38399 - RNA, 24 nt, Artificial Sequence
  Synthetic
aagugugccaggaagacgcgccac

SEQ ID NO: 38400 - RNA, 18 nt, Artificial Sequence
  Synthetic
gacgcccccgcgggccac

SEQ ID NO: 38401 - RNA, 19 nt, Artificial Sequence
  Synthetic
cgacgcccccgcgggccac

SEQ ID NO: 38402 - RNA, 20 nt, Artificial Sequence
  Synthetic
gcgacgcccccgcgggccac

SEQ ID NO: 38403 - RNA, 21 nt, Artificial Sequence
  Synthetic
ggcgacgcccccgcgggccac

SEQ ID NO: 38404 - RNA, 22 nt, Artificial Sequence
  Synthetic
cggcgacgcccccgcgggccac

SEQ ID NO: 38405 - RNA, 23 nt, Artificial Sequence
  Synthetic
ccggcgacgcccccgcgggccac

SEQ ID NO: 38406 - RNA, 24 nt, Artificial Sequence
  Synthetic
gccggcgacgcccccgcgggccac

SEQ ID NO: 38407 - RNA, 18 nt, Artificial Sequence
  Synthetic
aggagggggggcgggcac

SEQ ID NO: 38408 - RNA, 19 nt, Artificial Sequence
  Synthetic
gaggagggggggcgggcac

SEQ ID NO: 38409 - RNA, 20 nt, Artificial Sequence
  Synthetic
ggaggagggggggcgggcac

SEQ ID NO: 38410 - RNA, 21 nt, Artificial Sequence
  Synthetic
aggaggagggggggcgggcac

SEQ ID NO: 38411 - RNA, 22 nt, Artificial Sequence
  Synthetic
gaggaggagggggggcgggcac

SEQ ID NO: 38412 - RNA, 23 nt, Artificial Sequence
  Synthetic
ggaggaggagggggggcgggcac

SEQ ID NO: 38413 - RNA, 24 nt, Artificial Sequence
  Synthetic
aggaggaggagggggggcgggcac

SEQ ID NO: 38414 - RNA, 18 nt, Artificial Sequence
  Synthetic
cgugaacaagacggucac

SEQ ID NO: 38415 - RNA, 19 nt, Artificial Sequence
  Synthetic
acgugaacaagacggucac

SEQ ID NO: 38416 - RNA, 20 nt, Artificial Sequence
  Synthetic
uacgugaacaagacggucac

SEQ ID NO: 38417 - RNA, 21 nt, Artificial Sequence
  Synthetic
uuacgugaacaagacggucac

SEQ ID NO: 38418 - RNA, 22 nt, Artificial Sequence
  Synthetic
cuuacgugaacaagacggucac

SEQ ID NO: 38419 - RNA, 23 nt, Artificial Sequence
  Synthetic
ccuuacgugaacaagacggucac

SEQ ID NO: 38420 - RNA, 24 nt, Artificial Sequence
  Synthetic
gccuuacgugaacaagacggucac

SEQ ID NO: 38421 - RNA, 18 nt, Artificial Sequence
  Synthetic
guggggggggggaaagac

SEQ ID NO: 38422 - RNA, 19 nt, Artificial Sequence
  Synthetic
gguggggggggggaaagac

SEQ ID NO: 38423 - RNA, 20 nt, Artificial Sequence
  Synthetic
agguggggggggggaaagac

SEQ ID NO: 38424 - RNA, 21 nt, Artificial Sequence
  Synthetic
gagguggggggggggaaagac

SEQ ID NO: 38425 - RNA, 22 nt, Artificial Sequence
  Synthetic
ggagguggggggggggaaagac

SEQ ID NO: 38426 - RNA, 23 nt, Artificial Sequence
  Synthetic
gggagguggggggggggaaagac

SEQ ID NO: 38427 - RNA, 24 nt, Artificial Sequence
  Synthetic
ggggagguggggggggggaaagac

SEQ ID NO: 38428 - RNA, 18 nt, Artificial Sequence
  Synthetic
ggagggagaagagaagac

SEQ ID NO: 38429 - RNA, 19 nt, Artificial Sequence
  Synthetic
aggagggagaagagaagac

SEQ ID NO: 38430 - RNA, 20 nt, Artificial Sequence
  Synthetic
gaggagggagaagagaagac

SEQ ID NO: 38431 - RNA, 21 nt, Artificial Sequence
  Synthetic
ggaggagggagaagagaagac

SEQ ID NO: 38432 - RNA, 22 nt, Artificial Sequence
  Synthetic
aggaggagggagaagagaagac

SEQ ID NO: 38433 - RNA, 23 nt, Artificial Sequence
  Synthetic
aaggaggagggagaagagaagac

SEQ ID NO: 38434 - RNA, 24 nt, Artificial Sequence
  Synthetic
gaaggaggagggagaagagaagac

SEQ ID NO: 38435 - RNA, 18 nt, Artificial Sequence
  Synthetic
gguccucguggaccagac

SEQ ID NO: 38436 - RNA, 19 nt, Artificial Sequence
  Synthetic
ugguccucguggaccagac

SEQ ID NO: 38437 - RNA, 20 nt, Artificial Sequence
  Synthetic
gugguccucguggaccagac

SEQ ID NO: 38438 - RNA, 21 nt, Artificial Sequence
  Synthetic
cgugguccucguggaccagac

SEQ ID NO: 38439 - RNA, 22 nt, Artificial Sequence
  Synthetic
acgugguccucguggaccagac

SEQ ID NO: 38440 - RNA, 23 nt, Artificial Sequence
  Synthetic
uacgugguccucguggaccagac

SEQ ID NO: 38441 - RNA, 24 nt, Artificial Sequence
  Synthetic
cuacgugguccucguggaccagac

SEQ ID NO: 38442 - RNA, 18 nt, Artificial Sequence
  Synthetic
ccggcgcuggggagagac

SEQ ID NO: 38443 - RNA, 19 nt, Artificial Sequence
  Synthetic
uccggcgcuggggagagac

SEQ ID NO: 38444 - RNA, 20 nt, Artificial Sequence
  Synthetic
guccggcgcuggggagagac

SEQ ID NO: 38445 - RNA, 21 nt, Artificial Sequence
  Synthetic
cguccggcgcuggggagagac

SEQ ID NO: 38446 - RNA, 22 nt, Artificial Sequence
  Synthetic
gcguccggcgcuggggagagac

SEQ ID NO: 38447 - RNA, 23 nt, Artificial Sequence
  Synthetic
cgcguccggcgcuggggagagac

SEQ ID NO: 38448 - RNA, 24 nt, Artificial Sequence
  Synthetic
ccgcguccggcgcuggggagagac

SEQ ID NO: 38449 - RNA, 18 nt, Artificial Sequence
  Synthetic
ggagcaggaagaggagac

SEQ ID NO: 38450 - RNA, 19 nt, Artificial Sequence
  Synthetic
aggagcaggaagaggagac

SEQ ID NO: 38451 - RNA, 20 nt, Artificial Sequence
  Synthetic
gaggagcaggaagaggagac

SEQ ID NO: 38452 - RNA, 21 nt, Artificial Sequence
  Synthetic
ggaggagcaggaagaggagac

SEQ ID NO: 38453 - RNA, 22 nt, Artificial Sequence
  Synthetic
aggaggagcaggaagaggagac

SEQ ID NO: 38454 - RNA, 23 nt, Artificial Sequence
  Synthetic
gaggaggagcaggaagaggagac

SEQ ID NO: 38455 - RNA, 24 nt, Artificial Sequence
  Synthetic
ggaggaggagcaggaagaggagac

SEQ ID NO: 38456 - RNA, 18 nt, Artificial Sequence
  Synthetic
gaaagacggggaggagac

SEQ ID NO: 38457 - RNA, 19 nt, Artificial Sequence
  Synthetic
ggaaagacggggaggagac

SEQ ID NO: 38458 - RNA, 20 nt, Artificial Sequence
  Synthetic
gggaaagacggggaggagac

SEQ ID NO: 38459 - RNA, 21 nt, Artificial Sequence
  Synthetic
ggggaaagacggggaggagac

SEQ ID NO: 38460 - RNA, 22 nt, Artificial Sequence
  Synthetic
gggggaaagacggggaggagac

SEQ ID NO: 38461 - RNA, 23 nt, Artificial Sequence
  Synthetic
ggggggaaagacggggaggagac

SEQ ID NO: 38462 - RNA, 24 nt, Artificial Sequence
  Synthetic
gggggggaaagacggggaggagac

SEQ ID NO: 38463 - RNA, 18 nt, Artificial Sequence
  Synthetic
ugccugcccguccuggac

SEQ ID NO: 38464 - RNA, 19 nt, Artificial Sequence
  Synthetic
cugccugcccguccuggac

SEQ ID NO: 38465 - RNA, 20 nt, Artificial Sequence
  Synthetic
acugccugcccguccuggac

SEQ ID NO: 38466 - RNA, 21 nt, Artificial Sequence
  Synthetic
gacugccugcccguccuggac

SEQ ID NO: 38467 - RNA, 22 nt, Artificial Sequence
  Synthetic
ggacugccugcccguccuggac

SEQ ID NO: 38468 - RNA, 23 nt, Artificial Sequence
  Synthetic
gggacugccugcccguccuggac

SEQ ID NO: 38469 - RNA, 24 nt, Artificial Sequence
  Synthetic
ggggacugccugcccguccuggac

SEQ ID NO: 38470 - RNA, 18 nt, Artificial Sequence
  Synthetic
gaguguguccguguugac

SEQ ID NO: 38471 - RNA, 19 nt, Artificial Sequence
  Synthetic
agaguguguccguguugac

SEQ ID NO: 38472 - RNA, 20 nt, Artificial Sequence
  Synthetic
aagaguguguccguguugac

SEQ ID NO: 38473 - RNA, 21 nt, Artificial Sequence
  Synthetic
aaagaguguguccguguugac

SEQ ID NO: 38474 - RNA, 22 nt, Artificial Sequence
  Synthetic
aaaagaguguguccguguugac

SEQ ID NO: 38475 - RNA, 23 nt, Artificial Sequence
  Synthetic
aaaaagaguguguccguguugac

SEQ ID NO: 38476 - RNA, 24 nt, Artificial Sequence
  Synthetic
aaaaaagaguguguccguguugac

SEQ ID NO: 38477 - RNA, 18 nt, Artificial Sequence
  Synthetic
ggcaacaugcucuuugac

SEQ ID NO: 38478 - RNA, 19 nt, Artificial Sequence
  Synthetic
gggcaacaugcucuuugac

SEQ ID NO: 38479 - RNA, 20 nt, Artificial Sequence
  Synthetic
ugggcaacaugcucuuugac

SEQ ID NO: 38480 - RNA, 21 nt, Artificial Sequence
  Synthetic
gugggcaacaugcucuuugac

SEQ ID NO: 38481 - RNA, 22 nt, Artificial Sequence
  Synthetic
ggugggcaacaugcucuuugac

SEQ ID NO: 38482 - RNA, 23 nt, Artificial Sequence
  Synthetic
cggugggcaacaugcucuuugac

SEQ ID NO: 38483 - RNA, 24 nt, Artificial Sequence
  Synthetic
ccggugggcaacaugcucuuugac

SEQ ID NO: 38484 - RNA, 18 nt, Artificial Sequence
  Synthetic
guggcccuggcgccuuac

SEQ ID NO: 38485 - RNA, 19 nt, Artificial Sequence
  Synthetic
cguggcccuggcgccuuac

SEQ ID NO: 38486 - RNA, 20 nt, Artificial Sequence
  Synthetic
ucguggcccuggcgccuuac

SEQ ID NO: 38487 - RNA, 21 nt, Artificial Sequence
  Synthetic
gucguggcccuggcgccuuac

SEQ ID NO: 38488 - RNA, 22 nt, Artificial Sequence
  Synthetic
cgucguggcccuggcgccuuac

SEQ ID NO: 38489 - RNA, 23 nt, Artificial Sequence
  Synthetic
gcgucguggcccuggcgccuuac

SEQ ID NO: 38490 - RNA, 24 nt, Artificial Sequence
  Synthetic
agcgucguggcccuggcgccuuac

SEQ ID NO: 38491 - RNA, 18 nt, Artificial Sequence
  Synthetic
cgucuggccggccagacc

SEQ ID NO: 38492 - RNA, 19 nt, Artificial Sequence
  Synthetic
acgucuggccggccagacc

SEQ ID NO: 38493 - RNA, 20 nt, Artificial Sequence
  Synthetic
cacgucuggccggccagacc

SEQ ID NO: 38494 - RNA, 21 nt, Artificial Sequence
  Synthetic
gcacgucuggccggccagacc

SEQ ID NO: 38495 - RNA, 22 nt, Artificial Sequence
  Synthetic
cgcacgucuggccggccagacc

SEQ ID NO: 38496 - RNA, 23 nt, Artificial Sequence
  Synthetic
acgcacgucuggccggccagacc

SEQ ID NO: 38497 - RNA, 24 nt, Artificial Sequence
  Synthetic
cacgcacgucuggccggccagacc

SEQ ID NO: 38498 - RNA, 18 nt, Artificial Sequence
  Synthetic
gagaagccgcccccaccc

SEQ ID NO: 38499 - RNA, 19 nt, Artificial Sequence
  Synthetic
cgagaagccgcccccaccc

SEQ ID NO: 38500 - RNA, 20 nt, Artificial Sequence
  Synthetic
acgagaagccgcccccaccc

SEQ ID NO: 38501 - RNA, 21 nt, Artificial Sequence
  Synthetic
cacgagaagccgcccccaccc

SEQ ID NO: 38502 - RNA, 22 nt, Artificial Sequence
  Synthetic
gcacgagaagccgcccccaccc

SEQ ID NO: 38503 - RNA, 23 nt, Artificial Sequence
  Synthetic
ggcacgagaagccgcccccaccc

SEQ ID NO: 38504 - RNA, 24 nt, Artificial Sequence
  Synthetic
gggcacgagaagccgcccccaccc

SEQ ID NO: 38505 - RNA, 18 nt, Artificial Sequence
  Synthetic
gucuggccggccagaccc

SEQ ID NO: 38506 - RNA, 19 nt, Artificial Sequence
  Synthetic
cgucuggccggccagaccc

SEQ ID NO: 38507 - RNA, 20 nt, Artificial Sequence
  Synthetic
acgucuggccggccagaccc

SEQ ID NO: 38508 - RNA, 21 nt, Artificial Sequence
  Synthetic
cacgucuggccggccagaccc

SEQ ID NO: 38509 - RNA, 22 nt, Artificial Sequence
  Synthetic
gcacgucuggccggccagaccc

SEQ ID NO: 38510 - RNA, 23 nt, Artificial Sequence
  Synthetic
cgcacgucuggccggccagaccc

SEQ ID NO: 38511 - RNA, 24 nt, Artificial Sequence
  Synthetic
acgcacgucuggccggccagaccc

SEQ ID NO: 38512 - RNA, 18 nt, Artificial Sequence
  Synthetic
ccggccggcgacgccccc

SEQ ID NO: 38513 - RNA, 19 nt, Artificial Sequence
  Synthetic
gccggccggcgacgccccc

SEQ ID NO: 38514 - RNA, 20 nt, Artificial Sequence
  Synthetic
cgccggccggcgacgccccc

SEQ ID NO: 38515 - RNA, 21 nt, Artificial Sequence
  Synthetic
gcgccggccggcgacgccccc

SEQ ID NO: 38516 - RNA, 22 nt, Artificial Sequence
  Synthetic
cgcgccggccggcgacgccccc

SEQ ID NO: 38517 - RNA, 23 nt, Artificial Sequence
  Synthetic
ccgcgccggccggcgacgccccc

SEQ ID NO: 38518 - RNA, 24 nt, Artificial Sequence
  Synthetic
cccgcgccggccggcgacgccccc

SEQ ID NO: 38519 - RNA, 18 nt, Artificial Sequence
  Synthetic
ugcacgcccucugccccc

SEQ ID NO: 38520 - RNA, 19 nt, Artificial Sequence
  Synthetic
augcacgcccucugccccc

SEQ ID NO: 38521 - RNA, 20 nt, Artificial Sequence
  Synthetic
caugcacgcccucugccccc

SEQ ID NO: 38522 - RNA, 21 nt, Artificial Sequence
  Synthetic
gcaugcacgcccucugccccc

SEQ ID NO: 38523 - RNA, 22 nt, Artificial Sequence
  Synthetic
cgcaugcacgcccucugccccc

SEQ ID NO: 38524 - RNA, 23 nt, Artificial Sequence
  Synthetic
acgcaugcacgcccucugccccc

SEQ ID NO: 38525 - RNA, 24 nt, Artificial Sequence
  Synthetic
aacgcaugcacgcccucugccccc

SEQ ID NO: 38526 - RNA, 18 nt, Artificial Sequence
  Synthetic
augcacgcccucugcccc

SEQ ID NO: 38527 - RNA, 19 nt, Artificial Sequence
  Synthetic
caugcacgcccucugcccc

SEQ ID NO: 38528 - RNA, 20 nt, Artificial Sequence
  Synthetic
gcaugcacgcccucugcccc

SEQ ID NO: 38529 - RNA, 21 nt, Artificial Sequence
  Synthetic
cgcaugcacgcccucugcccc

SEQ ID NO: 38530 - RNA, 22 nt, Artificial Sequence
  Synthetic
acgcaugcacgcccucugcccc

SEQ ID NO: 38531 - RNA, 23 nt, Artificial Sequence
  Synthetic
aacgcaugcacgcccucugcccc

SEQ ID NO: 38532 - RNA, 24 nt, Artificial Sequence
  Synthetic
caacgcaugcacgcccucugcccc

SEQ ID NO: 38533 - RNA, 18 nt, Artificial Sequence
  Synthetic
caugcacgcccucugccc

SEQ ID NO: 38534 - RNA, 19 nt, Artificial Sequence
  Synthetic
gcaugcacgcccucugccc

SEQ ID NO: 38535 - RNA, 20 nt, Artificial Sequence
  Synthetic
cgcaugcacgcccucugccc

SEQ ID NO: 38536 - RNA, 21 nt, Artificial Sequence
  Synthetic
acgcaugcacgcccucugccc

SEQ ID NO: 38537 - RNA, 22 nt, Artificial Sequence
  Synthetic
aacgcaugcacgcccucugccc

SEQ ID NO: 38538 - RNA, 23 nt, Artificial Sequence
  Synthetic
caacgcaugcacgcccucugccc

SEQ ID NO: 38539 - RNA, 24 nt, Artificial Sequence
  Synthetic
acaacgcaugcacgcccucugccc

SEQ ID NO: 38540 - RNA, 18 nt, Artificial Sequence
  Synthetic
caccaccggcgcgaagcc

SEQ ID NO: 38541 - RNA, 19 nt, Artificial Sequence
  Synthetic
gcaccaccggcgcgaagcc

SEQ ID NO: 38542 - RNA, 20 nt, Artificial Sequence
  Synthetic
cgcaccaccggcgcgaagcc

SEQ ID NO: 38543 - RNA, 21 nt, Artificial Sequence
  Synthetic
ccgcaccaccggcgcgaagcc

SEQ ID NO: 38544 - RNA, 22 nt, Artificial Sequence
  Synthetic
gccgcaccaccggcgcgaagcc

SEQ ID NO: 38545 - RNA, 23 nt, Artificial Sequence
  Synthetic
agccgcaccaccggcgcgaagcc

SEQ ID NO: 38546 - RNA, 24 nt, Artificial Sequence
  Synthetic
cagccgcaccaccggcgcgaagcc

SEQ ID NO: 38547 - RNA, 18 nt, Artificial Sequence
  Synthetic
ggagggcggccccgagcc

SEQ ID NO: 38548 - RNA, 19 nt, Artificial Sequence
  Synthetic
cggagggcggccccgagcc

SEQ ID NO: 38549 - RNA, 20 nt, Artificial Sequence
  Synthetic
gcggagggcggccccgagcc

SEQ ID NO: 38550 - RNA, 21 nt, Artificial Sequence
  Synthetic
cgcggagggcggccccgagcc

SEQ ID NO: 38551 - RNA, 22 nt, Artificial Sequence
  Synthetic
acgcggagggcggccccgagcc

SEQ ID NO: 38552 - RNA, 23 nt, Artificial Sequence
  Synthetic
cacgcggagggcggccccgagcc

SEQ ID NO: 38553 - RNA, 24 nt, Artificial Sequence
  Synthetic
ccacgcggagggcggccccgagcc

SEQ ID NO: 38554 - RNA, 18 nt, Artificial Sequence
  Synthetic
accaccggccgaggcgcc

SEQ ID NO: 38555 - RNA, 19 nt, Artificial Sequence
  Synthetic
gaccaccggccgaggcgcc

SEQ ID NO: 38556 - RNA, 20 nt, Artificial Sequence
  Synthetic
ggaccaccggccgaggcgcc

SEQ ID NO: 38557 - RNA, 21 nt, Artificial Sequence
  Synthetic
cggaccaccggccgaggcgcc

SEQ ID NO: 38558 - RNA, 22 nt, Artificial Sequence
  Synthetic
ccggaccaccggccgaggcgcc

SEQ ID NO: 38559 - RNA, 23 nt, Artificial Sequence
  Synthetic
accggaccaccggccgaggcgcc

SEQ ID NO: 38560 - RNA, 24 nt, Artificial Sequence
  Synthetic
caccggaccaccggccgaggcgcc

SEQ ID NO: 38561 - RNA, 18 nt, Artificial Sequence
  Synthetic
cccccgcgcugcugcgcc

SEQ ID NO: 38562 - RNA, 19 nt, Artificial Sequence
  Synthetic
gcccccgcgcugcugcgcc

SEQ ID NO: 38563 - RNA, 20 nt, Artificial Sequence
  Synthetic
ggcccccgcgcugcugcgcc

SEQ ID NO: 38564 - RNA, 21 nt, Artificial Sequence
  Synthetic
cggcccccgcgcugcugcgcc

SEQ ID NO: 38565 - RNA, 22 nt, Artificial Sequence
  Synthetic
ucggcccccgcgcugcugcgcc

SEQ ID NO: 38566 - RNA, 23 nt, Artificial Sequence
  Synthetic
cucggcccccgcgcugcugcgcc

SEQ ID NO: 38567 - RNA, 24 nt, Artificial Sequence
  Synthetic
ccucggcccccgcgcugcugcgcc

SEQ ID NO: 38568 - RNA, 18 nt, Artificial Sequence
  Synthetic
ggggggacggacacggcc

SEQ ID NO: 38569 - RNA, 19 nt, Artificial Sequence
  Synthetic
gggggggacggacacggcc

SEQ ID NO: 38570 - RNA, 20 nt, Artificial Sequence
  Synthetic
ggggggggacggacacggcc

SEQ ID NO: 38571 - RNA, 21 nt, Artificial Sequence
  Synthetic
gggggggggacggacacggcc

SEQ ID NO: 38572 - RNA, 22 nt, Artificial Sequence
  Synthetic
ggggggggggacggacacggcc

SEQ ID NO: 38573 - RNA, 23 nt, Artificial Sequence
  Synthetic
gggggggggggacggacacggcc

SEQ ID NO: 38574 - RNA, 24 nt, Artificial Sequence
  Synthetic
ugggggggggggacggacacggcc

SEQ ID NO: 38575 - RNA, 18 nt, Artificial Sequence
  Synthetic
gccacgcggagggcggcc

SEQ ID NO: 38576 - RNA, 19 nt, Artificial Sequence
  Synthetic
cgccacgcggagggcggcc

SEQ ID NO: 38577 - RNA, 20 nt, Artificial Sequence
  Synthetic
gcgccacgcggagggcggcc

SEQ ID NO: 38578 - RNA, 21 nt, Artificial Sequence
  Synthetic
cgcgccacgcggagggcggcc

SEQ ID NO: 38579 - RNA, 22 nt, Artificial Sequence
  Synthetic
acgcgccacgcggagggcggcc

SEQ ID NO: 38580 - RNA, 23 nt, Artificial Sequence
  Synthetic
gacgcgccacgcggagggcggcc

SEQ ID NO: 38581 - RNA, 24 nt, Artificial Sequence
  Synthetic
agacgcgccacgcggagggcggcc

SEQ ID NO: 38582 - RNA, 18 nt, Artificial Sequence
  Synthetic
gcgacgcccccgcgggcc

SEQ ID NO: 38583 - RNA, 19 nt, Artificial Sequence
  Synthetic
ggcgacgcccccgcgggcc

SEQ ID NO: 38584 - RNA, 20 nt, Artificial Sequence
  Synthetic
cggcgacgcccccgcgggcc

SEQ ID NO: 38585 - RNA, 21 nt, Artificial Sequence
  Synthetic
ccggcgacgcccccgcgggcc

SEQ ID NO: 38586 - RNA, 22 nt, Artificial Sequence
  Synthetic
gccggcgacgcccccgcgggcc

SEQ ID NO: 38587 - RNA, 23 nt, Artificial Sequence
  Synthetic
ggccggcgacgcccccgcgggcc

SEQ ID NO: 38588 - RNA, 24 nt, Artificial Sequence
  Synthetic
cggccggcgacgcccccgcgggcc

SEQ ID NO: 38589 - RNA, 18 nt, Artificial Sequence
  Synthetic
ggcgcgaagccaggggcc

SEQ ID NO: 38590 - RNA, 19 nt, Artificial Sequence
  Synthetic
cggcgcgaagccaggggcc

SEQ ID NO: 38591 - RNA, 20 nt, Artificial Sequence
  Synthetic
ccggcgcgaagccaggggcc

SEQ ID NO: 38592 - RNA, 21 nt, Artificial Sequence
  Synthetic
accggcgcgaagccaggggcc

SEQ ID NO: 38593 - RNA, 22 nt, Artificial Sequence
  Synthetic
caccggcgcgaagccaggggcc

SEQ ID NO: 38594 - RNA, 23 nt, Artificial Sequence
  Synthetic
ccaccggcgcgaagccaggggcc

SEQ ID NO: 38595 - RNA, 24 nt, Artificial Sequence
  Synthetic
accaccggcgcgaagccaggggcc

SEQ ID NO: 38596 - RNA, 18 nt, Artificial Sequence
  Synthetic
ugcugcgccgcgggggcc

SEQ ID NO: 38597 - RNA, 19 nt, Artificial Sequence
  Synthetic
cugcugcgccgcgggggcc

SEQ ID NO: 38598 - RNA, 20 nt, Artificial Sequence
  Synthetic
gcugcugcgccgcgggggcc

SEQ ID NO: 38599 - RNA, 21 nt, Artificial Sequence
  Synthetic
cgcugcugcgccgcgggggcc

SEQ ID NO: 38600 - RNA, 22 nt, Artificial Sequence
  Synthetic
gcgcugcugcgccgcgggggcc

SEQ ID NO: 38601 - RNA, 23 nt, Artificial Sequence
  Synthetic
cgcgcugcugcgccgcgggggcc

SEQ ID NO: 38602 - RNA, 24 nt, Artificial Sequence
  Synthetic
ccgcgcugcugcgccgcgggggcc

SEQ ID NO: 38603 - RNA, 18 nt, Artificial Sequence
  Synthetic
gggccgaggaagugugcc

SEQ ID NO: 38604 - RNA, 19 nt, Artificial Sequence
  Synthetic
ggggccgaggaagugugcc

SEQ ID NO: 38605 - RNA, 20 nt, Artificial Sequence
  Synthetic
gggggccgaggaagugugcc

SEQ ID NO: 38606 - RNA, 21 nt, Artificial Sequence
  Synthetic
cgggggccgaggaagugugcc

SEQ ID NO: 38607 - RNA, 22 nt, Artificial Sequence
  Synthetic
gcgggggccgaggaagugugcc

SEQ ID NO: 38608 - RNA, 23 nt, Artificial Sequence
  Synthetic
cgcgggggccgaggaagugugcc

SEQ ID NO: 38609 - RNA, 24 nt, Artificial Sequence
  Synthetic
ccgcgggggccgaggaagugugcc

SEQ ID NO: 38610 - RNA, 18 nt, Artificial Sequence
  Synthetic
gccgccgcacccugcucc

SEQ ID NO: 38611 - RNA, 19 nt, Artificial Sequence
  Synthetic
agccgccgcacccugcucc

SEQ ID NO: 38612 - RNA, 20 nt, Artificial Sequence
  Synthetic
gagccgccgcacccugcucc

SEQ ID NO: 38613 - RNA, 21 nt, Artificial Sequence
  Synthetic
ggagccgccgcacccugcucc

SEQ ID NO: 38614 - RNA, 22 nt, Artificial Sequence
  Synthetic
uggagccgccgcacccugcucc

SEQ ID NO: 38615 - RNA, 23 nt, Artificial Sequence
  Synthetic
guggagccgccgcacccugcucc

SEQ ID NO: 38616 - RNA, 24 nt, Artificial Sequence
  Synthetic
cguggagccgccgcacccugcucc

SEQ ID NO: 38617 - RNA, 18 nt, Artificial Sequence
  Synthetic
gcaccaccggcgcgaagc

SEQ ID NO: 38618 - RNA, 19 nt, Artificial Sequence
  Synthetic
cgcaccaccggcgcgaagc

SEQ ID NO: 38619 - RNA, 20 nt, Artificial Sequence
  Synthetic
ccgcaccaccggcgcgaagc

SEQ ID NO: 38620 - RNA, 21 nt, Artificial Sequence
  Synthetic
gccgcaccaccggcgcgaagc

SEQ ID NO: 38621 - RNA, 22 nt, Artificial Sequence
  Synthetic
agccgcaccaccggcgcgaagc

SEQ ID NO: 38622 - RNA, 23 nt, Artificial Sequence
  Synthetic
cagccgcaccaccggcgcgaagc

SEQ ID NO: 38623 - RNA, 24 nt, Artificial Sequence
  Synthetic
ucagccgcaccaccggcgcgaagc

SEQ ID NO: 38624 - RNA, 18 nt, Artificial Sequence
  Synthetic
uuuaucauagaacagagc

SEQ ID NO: 38625 - RNA, 19 nt, Artificial Sequence
  Synthetic
cuuuaucauagaacagagc

SEQ ID NO: 38626 - RNA, 20 nt, Artificial Sequence
  Synthetic
ucuuuaucauagaacagagc

SEQ ID NO: 38627 - RNA, 21 nt, Artificial Sequence
  Synthetic
gucuuuaucauagaacagagc

SEQ ID NO: 38628 - RNA, 22 nt, Artificial Sequence
  Synthetic
ggucuuuaucauagaacagagc

SEQ ID NO: 38629 - RNA, 23 nt, Artificial Sequence
  Synthetic
uggucuuuaucauagaacagagc

SEQ ID NO: 38630 - RNA, 24 nt, Artificial Sequence
  Synthetic
uuggucuuuaucauagaacagagc

SEQ ID NO: 38631 - RNA, 18 nt, Artificial Sequence
  Synthetic
cggagggcggccccgagc

SEQ ID NO: 38632 - RNA, 19 nt, Artificial Sequence
  Synthetic
gcggagggcggccccgagc

SEQ ID NO: 38633 - RNA, 20 nt, Artificial Sequence
  Synthetic
cgcggagggcggccccgagc

SEQ ID NO: 38634 - RNA, 21 nt, Artificial Sequence
  Synthetic
acgcggagggcggccccgagc

SEQ ID NO: 38635 - RNA, 22 nt, Artificial Sequence
  Synthetic
cacgcggagggcggccccgagc

SEQ ID NO: 38636 - RNA, 23 nt, Artificial Sequence
  Synthetic
ccacgcggagggcggccccgagc

SEQ ID NO: 38637 - RNA, 24 nt, Artificial Sequence
  Synthetic
gccacgcggagggcggccccgagc

SEQ ID NO: 38638 - RNA, 18 nt, Artificial Sequence
  Synthetic
ggagaaaggaggaggagc

SEQ ID NO: 38639 - RNA, 19 nt, Artificial Sequence
  Synthetic
gggagaaaggaggaggagc

SEQ ID NO: 38640 - RNA, 20 nt, Artificial Sequence
  Synthetic
ugggagaaaggaggaggagc

SEQ ID NO: 38641 - RNA, 21 nt, Artificial Sequence
  Synthetic
cugggagaaaggaggaggagc

SEQ ID NO: 38642 - RNA, 22 nt, Artificial Sequence
  Synthetic
gcugggagaaaggaggaggagc

SEQ ID NO: 38643 - RNA, 23 nt, Artificial Sequence
  Synthetic
ggcugggagaaaggaggaggagc

SEQ ID NO: 38644 - RNA, 24 nt, Artificial Sequence
  Synthetic
uggcugggagaaaggaggaggagc

SEQ ID NO: 38645 - RNA, 18 nt, Artificial Sequence
  Synthetic
gcgggccgcggcccccgc

SEQ ID NO: 38646 - RNA, 19 nt, Artificial Sequence
  Synthetic
ugcgggccgcggcccccgc

SEQ ID NO: 38647 - RNA, 20 nt, Artificial Sequence
  Synthetic
cugcgggccgcggcccccgc

SEQ ID NO: 38648 - RNA, 21 nt, Artificial Sequence
  Synthetic
gcugcgggccgcggcccccgc

SEQ ID NO: 38649 - RNA, 22 nt, Artificial Sequence
  Synthetic
ugcugcgggccgcggcccccgc

SEQ ID NO: 38650 - RNA, 23 nt, Artificial Sequence
  Synthetic
cugcugcgggccgcggcccccgc

SEQ ID NO: 38651 - RNA, 24 nt, Artificial Sequence
  Synthetic
ccugcugcgggccgcggcccccgc

SEQ ID NO: 38652 - RNA, 18 nt, Artificial Sequence
  Synthetic
cccgcgcugcugcgccgc

SEQ ID NO: 38653 - RNA, 19 nt, Artificial Sequence
  Synthetic
ccccgcgcugcugcgccgc

SEQ ID NO: 38654 - RNA, 20 nt, Artificial Sequence
  Synthetic
cccccgcgcugcugcgccgc

SEQ ID NO: 38655 - RNA, 21 nt, Artificial Sequence
  Synthetic
gcccccgcgcugcugcgccgc

SEQ ID NO: 38656 - RNA, 22 nt, Artificial Sequence
  Synthetic
ggcccccgcgcugcugcgccgc

SEQ ID NO: 38657 - RNA, 23 nt, Artificial Sequence
  Synthetic
cggcccccgcgcugcugcgccgc

SEQ ID NO: 38658 - RNA, 24 nt, Artificial Sequence
  Synthetic
ucggcccccgcgcugcugcgccgc

SEQ ID NO: 38659 - RNA, 18 nt, Artificial Sequence
  Synthetic
gaugcagcucccccgcgc

SEQ ID NO: 38660 - RNA, 19 nt, Artificial Sequence
  Synthetic
ugaugcagcucccccgcgc

SEQ ID NO: 38661 - RNA, 20 nt, Artificial Sequence
  Synthetic
uugaugcagcucccccgcgc

SEQ ID NO: 38662 - RNA, 21 nt, Artificial Sequence
  Synthetic
uuugaugcagcucccccgcgc

SEQ ID NO: 38663 - RNA, 22 nt, Artificial Sequence
  Synthetic
cuuugaugcagcucccccgcgc

SEQ ID NO: 38664 - RNA, 23 nt, Artificial Sequence
  Synthetic
ccuuugaugcagcucccccgcgc

SEQ ID NO: 38665 - RNA, 24 nt, Artificial Sequence
  Synthetic
gccuuugaugcagcucccccgcgc

SEQ ID NO: 38666 - RNA, 18 nt, Artificial Sequence
  Synthetic
cgcguccgcguccggcgc

SEQ ID NO: 38667 - RNA, 19 nt, Artificial Sequence
  Synthetic
ucgcguccgcguccggcgc

SEQ ID NO: 38668 - RNA, 20 nt, Artificial Sequence
  Synthetic
gucgcguccgcguccggcgc

SEQ ID NO: 38669 - RNA, 21 nt, Artificial Sequence
  Synthetic
cgucgcguccgcguccggcgc

SEQ ID NO: 38670 - RNA, 22 nt, Artificial Sequence
  Synthetic
gcgucgcguccgcguccggcgc

SEQ ID NO: 38671 - RNA, 23 nt, Artificial Sequence
  Synthetic
agcgucgcguccgcguccggcgc

SEQ ID NO: 38672 - RNA, 24 nt, Artificial Sequence
  Synthetic
gagcgucgcguccgcguccggcgc

SEQ ID NO: 38673 - RNA, 18 nt, Artificial Sequence
  Synthetic
gucagccgcaccaccggc

SEQ ID NO: 38674 - RNA, 19 nt, Artificial Sequence
  Synthetic
ggucagccgcaccaccggc

SEQ ID NO: 38675 - RNA, 20 nt, Artificial Sequence
  Synthetic
gggucagccgcaccaccggc

SEQ ID NO: 38676 - RNA, 21 nt, Artificial Sequence
  Synthetic
ggggucagccgcaccaccggc

SEQ ID NO: 38677 - RNA, 22 nt, Artificial Sequence
  Synthetic
gggggucagccgcaccaccggc

SEQ ID NO: 38678 - RNA, 23 nt, Artificial Sequence
  Synthetic
ggggggucagccgcaccaccggc

SEQ ID NO: 38679 - RNA, 24 nt, Artificial Sequence
  Synthetic
gggggggucagccgcaccaccggc

SEQ ID NO: 38680 - RNA, 18 nt, Artificial Sequence
  Synthetic
ggaggagggggggcgggc

SEQ ID NO: 38681 - RNA, 19 nt, Artificial Sequence
  Synthetic
aggaggagggggggcgggc

SEQ ID NO: 38682 - RNA, 20 nt, Artificial Sequence
  Synthetic
gaggaggagggggggcgggc

SEQ ID NO: 38683 - RNA, 21 nt, Artificial Sequence
  Synthetic
ggaggaggagggggggcgggc

SEQ ID NO: 38684 - RNA, 22 nt, Artificial Sequence
  Synthetic
aggaggaggagggggggcgggc

SEQ ID NO: 38685 - RNA, 23 nt, Artificial Sequence
  Synthetic
gaggaggaggagggggggcgggc

SEQ ID NO: 38686 - RNA, 24 nt, Artificial Sequence
  Synthetic
ggaggaggaggagggggggcgggc

SEQ ID NO: 38687 - RNA, 18 nt, Artificial Sequence
  Synthetic
cggcgcgaagccaggggc

SEQ ID NO: 38688 - RNA, 19 nt, Artificial Sequence
  Synthetic
ccggcgcgaagccaggggc

SEQ ID NO: 38689 - RNA, 20 nt, Artificial Sequence
  Synthetic
accggcgcgaagccaggggc

SEQ ID NO: 38690 - RNA, 21 nt, Artificial Sequence
  Synthetic
caccggcgcgaagccaggggc

SEQ ID NO: 38691 - RNA, 22 nt, Artificial Sequence
  Synthetic
ccaccggcgcgaagccaggggc

SEQ ID NO: 38692 - RNA, 23 nt, Artificial Sequence
  Synthetic
accaccggcgcgaagccaggggc

SEQ ID NO: 38693 - RNA, 24 nt, Artificial Sequence
  Synthetic
caccaccggcgcgaagccaggggc

SEQ ID NO: 38694 - RNA, 18 nt, Artificial Sequence
  Synthetic
ggagacucccaucggggc

SEQ ID NO: 38695 - RNA, 19 nt, Artificial Sequence
  Synthetic
gggagacucccaucggggc

SEQ ID NO: 38696 - RNA, 20 nt, Artificial Sequence
  Synthetic
ggggagacucccaucggggc

SEQ ID NO: 38697 - RNA, 21 nt, Artificial Sequence
  Synthetic
cggggagacucccaucggggc

SEQ ID NO: 38698 - RNA, 22 nt, Artificial Sequence
  Synthetic
gcggggagacucccaucggggc

SEQ ID NO: 38699 - RNA, 23 nt, Artificial Sequence
  Synthetic
ugcggggagacucccaucggggc

SEQ ID NO: 38700 - RNA, 24 nt, Artificial Sequence
  Synthetic
cugcggggagacucccaucggggc

SEQ ID NO: 38701 - RNA, 18 nt, Artificial Sequence
  Synthetic
ggaaaguggggcgggggc

SEQ ID NO: 38702 - RNA, 19 nt, Artificial Sequence
  Synthetic
gggaaaguggggcgggggc

SEQ ID NO: 38703 - RNA, 20 nt, Artificial Sequence
  Synthetic
ggggaaaguggggcgggggc

SEQ ID NO: 38704 - RNA, 21 nt, Artificial Sequence
  Synthetic
gggggaaaguggggcgggggc

SEQ ID NO: 38705 - RNA, 22 nt, Artificial Sequence
  Synthetic
ggggggaaaguggggcgggggc

SEQ ID NO: 38706 - RNA, 23 nt, Artificial Sequence
  Synthetic
aggggggaaaguggggcgggggc

SEQ ID NO: 38707 - RNA, 24 nt, Artificial Sequence
  Synthetic
gaggggggaaaguggggcgggggc

SEQ ID NO: 38708 - RNA, 18 nt, Artificial Sequence
  Synthetic
ccgaggcgccucgggggc

SEQ ID NO: 38709 - RNA, 19 nt, Artificial Sequence
  Synthetic
gccgaggcgccucgggggc

SEQ ID NO: 38710 - RNA, 20 nt, Artificial Sequence
  Synthetic
ggccgaggcgccucgggggc

SEQ ID NO: 38711 - RNA, 21 nt, Artificial Sequence
  Synthetic
cggccgaggcgccucgggggc

SEQ ID NO: 38712 - RNA, 22 nt, Artificial Sequence
  Synthetic
ccggccgaggcgccucgggggc

SEQ ID NO: 38713 - RNA, 23 nt, Artificial Sequence
  Synthetic
accggccgaggcgccucgggggc

SEQ ID NO: 38714 - RNA, 24 nt, Artificial Sequence
  Synthetic
caccggccgaggcgccucgggggc

SEQ ID NO: 38715 - RNA, 18 nt, Artificial Sequence
  Synthetic
ucccccgcgcaggggggc

SEQ ID NO: 38716 - RNA, 19 nt, Artificial Sequence
  Synthetic
cucccccgcgcaggggggc

SEQ ID NO: 38717 - RNA, 20 nt, Artificial Sequence
  Synthetic
gcucccccgcgcaggggggc

SEQ ID NO: 38718 - RNA, 21 nt, Artificial Sequence
  Synthetic
agcucccccgcgcaggggggc

SEQ ID NO: 38719 - RNA, 22 nt, Artificial Sequence
  Synthetic
cagcucccccgcgcaggggggc

SEQ ID NO: 38720 - RNA, 23 nt, Artificial Sequence
  Synthetic
gcagcucccccgcgcaggggggc

SEQ ID NO: 38721 - RNA, 24 nt, Artificial Sequence
  Synthetic
ugcagcucccccgcgcaggggggc

SEQ ID NO: 38722 - RNA, 18 nt, Artificial Sequence
  Synthetic
gaggggggaaaguggggc

SEQ ID NO: 38723 - RNA, 19 nt, Artificial Sequence
  Synthetic
agaggggggaaaguggggc

SEQ ID NO: 38724 - RNA, 20 nt, Artificial Sequence
  Synthetic
gagaggggggaaaguggggc

SEQ ID NO: 38725 - RNA, 21 nt, Artificial Sequence
  Synthetic
agagaggggggaaaguggggc

SEQ ID NO: 38726 - RNA, 22 nt, Artificial Sequence
  Synthetic
uagagaggggggaaaguggggc

SEQ ID NO: 38727 - RNA, 23 nt, Artificial Sequence
  Synthetic
auagagaggggggaaaguggggc

SEQ ID NO: 38728 - RNA, 24 nt, Artificial Sequence
  Synthetic
gauagagaggggggaaaguggggc

SEQ ID NO: 38729 - RNA, 18 nt, Artificial Sequence
  Synthetic
gccccuccucacccuggc

SEQ ID NO: 38730 - RNA, 19 nt, Artificial Sequence
  Synthetic
cgccccuccucacccuggc

SEQ ID NO: 38731 - RNA, 20 nt, Artificial Sequence
  Synthetic
ccgccccuccucacccuggc

SEQ ID NO: 38732 - RNA, 21 nt, Artificial Sequence
  Synthetic
cccgccccuccucacccuggc

SEQ ID NO: 38733 - RNA, 22 nt, Artificial Sequence
  Synthetic
gcccgccccuccucacccuggc

SEQ ID NO: 38734 - RNA, 23 nt, Artificial Sequence
  Synthetic
cgcccgccccuccucacccuggc

SEQ ID NO: 38735 - RNA, 24 nt, Artificial Sequence
  Synthetic
acgcccgccccuccucacccuggc

SEQ ID NO: 38736 - RNA, 18 nt, Artificial Sequence
  Synthetic
agugggagggcgccuggc

SEQ ID NO: 38737 - RNA, 19 nt, Artificial Sequence
  Synthetic
gagugggagggcgccuggc

SEQ ID NO: 38738 - RNA, 20 nt, Artificial Sequence
  Synthetic
ggagugggagggcgccuggc

SEQ ID NO: 38739 - RNA, 21 nt, Artificial Sequence
  Synthetic
aggagugggagggcgccuggc

SEQ ID NO: 38740 - RNA, 22 nt, Artificial Sequence
  Synthetic
caggagugggagggcgccuggc

SEQ ID NO: 38741 - RNA, 23 nt, Artificial Sequence
  Synthetic
gcaggagugggagggcgccuggc

SEQ ID NO: 38742 - RNA, 24 nt, Artificial Sequence
  Synthetic
ggcaggagugggagggcgccuggc

SEQ ID NO: 38743 - RNA, 18 nt, Artificial Sequence
  Synthetic
gagcacgcgcgcaacugc

SEQ ID NO: 38744 - RNA, 19 nt, Artificial Sequence
  Synthetic
cgagcacgcgcgcaacugc

SEQ ID NO: 38745 - RNA, 20 nt, Artificial Sequence
  Synthetic
ccgagcacgcgcgcaacugc

SEQ ID NO: 38746 - RNA, 21 nt, Artificial Sequence
  Synthetic
cccgagcacgcgcgcaacugc

SEQ ID NO: 38747 - RNA, 22 nt, Artificial Sequence
  Synthetic
ccccgagcacgcgcgcaacugc

SEQ ID NO: 38748 - RNA, 23 nt, Artificial Sequence
  Synthetic
uccccgagcacgcgcgcaacugc

SEQ ID NO: 38749 - RNA, 24 nt, Artificial Sequence
  Synthetic
cuccccgagcacgcgcgcaacugc

SEQ ID NO: 38750 - RNA, 18 nt, Artificial Sequence
  Synthetic
ccuccuuacccuggcugc

SEQ ID NO: 38751 - RNA, 19 nt, Artificial Sequence
  Synthetic
cccuccuuacccuggcugc

SEQ ID NO: 38752 - RNA, 20 nt, Artificial Sequence
  Synthetic
ccccuccuuacccuggcugc

SEQ ID NO: 38753 - RNA, 21 nt, Artificial Sequence
  Synthetic
gccccuccuuacccuggcugc

SEQ ID NO: 38754 - RNA, 22 nt, Artificial Sequence
  Synthetic
cgccccuccuuacccuggcugc

SEQ ID NO: 38755 - RNA, 23 nt, Artificial Sequence
  Synthetic
ccgccccuccuuacccuggcugc

SEQ ID NO: 38756 - RNA, 24 nt, Artificial Sequence
  Synthetic
cccgccccuccuuacccuggcugc

SEQ ID NO: 38757 - RNA, 18 nt, Artificial Sequence
  Synthetic
uaacacucggcuugcugc

SEQ ID NO: 38758 - RNA, 19 nt, Artificial Sequence
  Synthetic
cuaacacucggcuugcugc

SEQ ID NO: 38759 - RNA, 20 nt, Artificial Sequence
  Synthetic
gcuaacacucggcuugcugc

SEQ ID NO: 38760 - RNA, 21 nt, Artificial Sequence
  Synthetic
agcuaacacucggcuugcugc

SEQ ID NO: 38761 - RNA, 22 nt, Artificial Sequence
  Synthetic
gagcuaacacucggcuugcugc

SEQ ID NO: 38762 - RNA, 23 nt, Artificial Sequence
  Synthetic
ggagcuaacacucggcuugcugc

SEQ ID NO: 38763 - RNA, 24 nt, Artificial Sequence
  Synthetic
gggagcuaacacucggcuugcugc

SEQ ID NO: 38764 - RNA, 18 nt, Artificial Sequence
  Synthetic
ggggccgaggaagugugc

SEQ ID NO: 38765 - RNA, 19 nt, Artificial Sequence
  Synthetic
gggggccgaggaagugugc

SEQ ID NO: 38766 - RNA, 20 nt, Artificial Sequence
  Synthetic
cgggggccgaggaagugugc

SEQ ID NO: 38767 - RNA, 21 nt, Artificial Sequence
  Synthetic
gcgggggccgaggaagugugc

SEQ ID NO: 38768 - RNA, 22 nt, Artificial Sequence
  Synthetic
cgcgggggccgaggaagugugc

SEQ ID NO: 38769 - RNA, 23 nt, Artificial Sequence
  Synthetic
ccgcgggggccgaggaagugugc

SEQ ID NO: 38770 - RNA, 24 nt, Artificial Sequence
  Synthetic
gccgcgggggccgaggaagugugc

SEQ ID NO: 38771 - RNA, 18 nt, Artificial Sequence
  Synthetic
acgcgcuaccugcccauc

SEQ ID NO: 38772 - RNA, 19 nt, Artificial Sequence
  Synthetic
cacgcgcuaccugcccauc

SEQ ID NO: 38773 - RNA, 20 nt, Artificial Sequence
  Synthetic
ucacgcgcuaccugcccauc

SEQ ID NO: 38774 - RNA, 21 nt, Artificial Sequence
  Synthetic
cucacgcgcuaccugcccauc

SEQ ID NO: 38775 - RNA, 22 nt, Artificial Sequence
  Synthetic
ccucacgcgcuaccugcccauc

SEQ ID NO: 38776 - RNA, 23 nt, Artificial Sequence
  Synthetic
gccucacgcgcuaccugcccauc

SEQ ID NO: 38777 - RNA, 24 nt, Artificial Sequence
  Synthetic
ggccucacgcgcuaccugcccauc

SEQ ID NO: 38778 - RNA, 18 nt, Artificial Sequence
  Synthetic
caccggccgaggcgccuc

SEQ ID NO: 38779 - RNA, 19 nt, Artificial Sequence
  Synthetic
ccaccggccgaggcgccuc

SEQ ID NO: 38780 - RNA, 20 nt, Artificial Sequence
  Synthetic
accaccggccgaggcgccuc

SEQ ID NO: 38781 - RNA, 21 nt, Artificial Sequence
  Synthetic
gaccaccggccgaggcgccuc

SEQ ID NO: 38782 - RNA, 22 nt, Artificial Sequence
  Synthetic
ggaccaccggccgaggcgccuc

SEQ ID NO: 38783 - RNA, 23 nt, Artificial Sequence
  Synthetic
cggaccaccggccgaggcgccuc

SEQ ID NO: 38784 - RNA, 24 nt, Artificial Sequence
  Synthetic
ccggaccaccggccgaggcgccuc

SEQ ID NO: 38785 - RNA, 18 nt, Artificial Sequence
  Synthetic
ggggccuacgugguccuc

SEQ ID NO: 38786 - RNA, 19 nt, Artificial Sequence
  Synthetic
aggggccuacgugguccuc

SEQ ID NO: 38787 - RNA, 20 nt, Artificial Sequence
  Synthetic
uaggggccuacgugguccuc

SEQ ID NO: 38788 - RNA, 21 nt, Artificial Sequence
  Synthetic
auaggggccuacgugguccuc

SEQ ID NO: 38789 - RNA, 22 nt, Artificial Sequence
  Synthetic
cauaggggccuacgugguccuc

SEQ ID NO: 38790 - RNA, 23 nt, Artificial Sequence
  Synthetic
acauaggggccuacgugguccuc

SEQ ID NO: 38791 - RNA, 24 nt, Artificial Sequence
  Synthetic
cacauaggggccuacgugguccuc

SEQ ID NO: 38792 - RNA, 18 nt, Artificial Sequence
  Synthetic
ugggagggcgccuggcuc

SEQ ID NO: 38793 - RNA, 19 nt, Artificial Sequence
  Synthetic
gugggagggcgccuggcuc

SEQ ID NO: 38794 - RNA, 20 nt, Artificial Sequence
  Synthetic
agugggagggcgccuggcuc

SEQ ID NO: 38795 - RNA, 21 nt, Artificial Sequence
  Synthetic
gagugggagggcgccuggcuc

SEQ ID NO: 38796 - RNA, 22 nt, Artificial Sequence
  Synthetic
ggagugggagggcgccuggcuc

SEQ ID NO: 38797 - RNA, 23 nt, Artificial Sequence
  Synthetic
aggagugggagggcgccuggcuc

SEQ ID NO: 38798 - RNA, 24 nt, Artificial Sequence
  Synthetic
caggagugggagggcgccuggcuc

SEQ ID NO: 38799 - RNA, 18 nt, Artificial Sequence
  Synthetic
cgcgccacccguggucuc

SEQ ID NO: 38800 - RNA, 19 nt, Artificial Sequence
  Synthetic
ucgcgccacccguggucuc

SEQ ID NO: 38801 - RNA, 20 nt, Artificial Sequence
  Synthetic
gucgcgccacccguggucuc

SEQ ID NO: 38802 - RNA, 21 nt, Artificial Sequence
  Synthetic
ggucgcgccacccguggucuc

SEQ ID NO: 38803 - RNA, 22 nt, Artificial Sequence
  Synthetic
cggucgcgccacccguggucuc

SEQ ID NO: 38804 - RNA, 23 nt, Artificial Sequence
  Synthetic
ccggucgcgccacccguggucuc

SEQ ID NO: 38805 - RNA, 24 nt, Artificial Sequence
  Synthetic
uccggucgcgccacccguggucuc

SEQ ID NO: 38806 - RNA, 18 nt, Artificial Sequence
  Synthetic
ggggacugccugcccguc

SEQ ID NO: 38807 - RNA, 19 nt, Artificial Sequence
  Synthetic
gggggacugccugcccguc

SEQ ID NO: 38808 - RNA, 20 nt, Artificial Sequence
  Synthetic
cgggggacugccugcccguc

SEQ ID NO: 38809 - RNA, 21 nt, Artificial Sequence
  Synthetic
acgggggacugccugcccguc

SEQ ID NO: 38810 - RNA, 22 nt, Artificial Sequence
  Synthetic
cacgggggacugccugcccguc

SEQ ID NO: 38811 - RNA, 23 nt, Artificial Sequence
  Synthetic
ucacgggggacugccugcccguc

SEQ ID NO: 38812 - RNA, 24 nt, Artificial Sequence
  Synthetic
gucacgggggacugccugcccguc

SEQ ID NO: 38813 - RNA, 18 nt, Artificial Sequence
  Synthetic
uacgugaacaagacgguc

SEQ ID NO: 38814 - RNA, 19 nt, Artificial Sequence
  Synthetic
uuacgugaacaagacgguc

SEQ ID NO: 38815 - RNA, 20 nt, Artificial Sequence
  Synthetic
cuuacgugaacaagacgguc

SEQ ID NO: 38816 - RNA, 21 nt, Artificial Sequence
  Synthetic
ccuuacgugaacaagacgguc

SEQ ID NO: 38817 - RNA, 22 nt, Artificial Sequence
  Synthetic
gccuuacgugaacaagacgguc

SEQ ID NO: 38818 - RNA, 23 nt, Artificial Sequence
  Synthetic
cgccuuacgugaacaagacgguc

SEQ ID NO: 38819 - RNA, 24 nt, Artificial Sequence
  Synthetic
gcgccuuacgugaacaagacgguc

SEQ ID NO: 38820 - RNA, 18 nt, Artificial Sequence
  Synthetic
cugcccaucgcggggguc

SEQ ID NO: 38821 - RNA, 19 nt, Artificial Sequence
  Synthetic
ccugcccaucgcggggguc

SEQ ID NO: 38822 - RNA, 20 nt, Artificial Sequence
  Synthetic
accugcccaucgcggggguc

SEQ ID NO: 38823 - RNA, 21 nt, Artificial Sequence
  Synthetic
uaccugcccaucgcggggguc

SEQ ID NO: 38824 - RNA, 22 nt, Artificial Sequence
  Synthetic
cuaccugcccaucgcggggguc

SEQ ID NO: 38825 - RNA, 23 nt, Artificial Sequence
  Synthetic
gcuaccugcccaucgcggggguc

SEQ ID NO: 38826 - RNA, 24 nt, Artificial Sequence
  Synthetic
cgcuaccugcccaucgcggggguc

SEQ ID NO: 38827 - RNA, 18 nt, Artificial Sequence
  Synthetic
gucgcgccacccgugguc

SEQ ID NO: 38828 - RNA, 19 nt, Artificial Sequence
  Synthetic
ggucgcgccacccgugguc

SEQ ID NO: 38829 - RNA, 20 nt, Artificial Sequence
  Synthetic
cggucgcgccacccgugguc

SEQ ID NO: 38830 - RNA, 21 nt, Artificial Sequence
  Synthetic
ccggucgcgccacccgugguc

SEQ ID NO: 38831 - RNA, 22 nt, Artificial Sequence
  Synthetic
uccggucgcgccacccgugguc

SEQ ID NO: 38832 - RNA, 23 nt, Artificial Sequence
  Synthetic
cuccggucgcgccacccgugguc

SEQ ID NO: 38833 - RNA, 24 nt, Artificial Sequence
  Synthetic
ccuccggucgcgccacccgugguc

SEQ ID NO: 38834 - RNA, 18 nt, Artificial Sequence
  Synthetic
acccuggcugggagaaag

SEQ ID NO: 38835 - RNA, 19 nt, Artificial Sequence
  Synthetic
cacccuggcugggagaaag

SEQ ID NO: 38836 - RNA, 20 nt, Artificial Sequence
  Synthetic
ucacccuggcugggagaaag

SEQ ID NO: 38837 - RNA, 21 nt, Artificial Sequence
  Synthetic
cucacccuggcugggagaaag

SEQ ID NO: 38838 - RNA, 22 nt, Artificial Sequence
  Synthetic
ccucacccuggcugggagaaag

SEQ ID NO: 38839 - RNA, 23 nt, Artificial Sequence
  Synthetic
uccucacccuggcugggagaaag

SEQ ID NO: 38840 - RNA, 24 nt, Artificial Sequence
  Synthetic
cuccucacccuggcugggagaaag

SEQ ID NO: 38841 - RNA, 18 nt, Artificial Sequence
  Synthetic
gauagagaggggggaaag

SEQ ID NO: 38842 - RNA, 19 nt, Artificial Sequence
  Synthetic
ugauagagaggggggaaag

SEQ ID NO: 38843 - RNA, 20 nt, Artificial Sequence
  Synthetic
uugauagagaggggggaaag

SEQ ID NO: 38844 - RNA, 21 nt, Artificial Sequence
  Synthetic
uuugauagagaggggggaaag

SEQ ID NO: 38845 - RNA, 22 nt, Artificial Sequence
  Synthetic
cuuugauagagaggggggaaag

SEQ ID NO: 38846 - RNA, 23 nt, Artificial Sequence
  Synthetic
acuuugauagagaggggggaaag

SEQ ID NO: 38847 - RNA, 24 nt, Artificial Sequence
  Synthetic
aacuuugauagagaggggggaaag

SEQ ID NO: 38848 - RNA, 18 nt, Artificial Sequence
  Synthetic
agguggggggggggaaag

SEQ ID NO: 38849 - RNA, 19 nt, Artificial Sequence
  Synthetic
gagguggggggggggaaag

SEQ ID NO: 38850 - RNA, 20 nt, Artificial Sequence
  Synthetic
ggagguggggggggggaaag

SEQ ID NO: 38851 - RNA, 21 nt, Artificial Sequence
  Synthetic
gggagguggggggggggaaag

SEQ ID NO: 38852 - RNA, 22 nt, Artificial Sequence
  Synthetic
ggggagguggggggggggaaag

SEQ ID NO: 38853 - RNA, 23 nt, Artificial Sequence
  Synthetic
gggggagguggggggggggaaag

SEQ ID NO: 38854 - RNA, 24 nt, Artificial Sequence
  Synthetic
agggggagguggggggggggaaag

SEQ ID NO: 38855 - RNA, 18 nt, Artificial Sequence
  Synthetic
cggggaggagacaggaag

SEQ ID NO: 38856 - RNA, 19 nt, Artificial Sequence
  Synthetic
acggggaggagacaggaag

SEQ ID NO: 38857 - RNA, 20 nt, Artificial Sequence
  Synthetic
gacggggaggagacaggaag

SEQ ID NO: 38858 - RNA, 21 nt, Artificial Sequence
  Synthetic
agacggggaggagacaggaag

SEQ ID NO: 38859 - RNA, 22 nt, Artificial Sequence
  Synthetic
aagacggggaggagacaggaag

SEQ ID NO: 38860 - RNA, 23 nt, Artificial Sequence
  Synthetic
aaagacggggaggagacaggaag

SEQ ID NO: 38861 - RNA, 24 nt, Artificial Sequence
  Synthetic
gaaagacggggaggagacaggaag

SEQ ID NO: 38862 - RNA, 18 nt, Artificial Sequence
  Synthetic
aggaggaggagcaggaag

SEQ ID NO: 38863 - RNA, 19 nt, Artificial Sequence
  Synthetic
aaggaggaggagcaggaag

SEQ ID NO: 38864 - RNA, 20 nt, Artificial Sequence
  Synthetic
aaaggaggaggagcaggaag

SEQ ID NO: 38865 - RNA, 21 nt, Artificial Sequence
  Synthetic
gaaaggaggaggagcaggaag

SEQ ID NO: 38866 - RNA, 22 nt, Artificial Sequence
  Synthetic
agaaaggaggaggagcaggaag

SEQ ID NO: 38867 - RNA, 23 nt, Artificial Sequence
  Synthetic
gagaaaggaggaggagcaggaag

SEQ ID NO: 38868 - RNA, 24 nt, Artificial Sequence
  Synthetic
ggagaaaggaggaggagcaggaag

SEQ ID NO: 38869 - RNA, 18 nt, Artificial Sequence
  Synthetic
gggacgggugggaggaag

SEQ ID NO: 38870 - RNA, 19 nt, Artificial Sequence
  Synthetic
ggggacgggugggaggaag

SEQ ID NO: 38871 - RNA, 20 nt, Artificial Sequence
  Synthetic
cggggacgggugggaggaag

SEQ ID NO: 38872 - RNA, 21 nt, Artificial Sequence
  Synthetic
ccggggacgggugggaggaag

SEQ ID NO: 38873 - RNA, 22 nt, Artificial Sequence
  Synthetic
cccggggacgggugggaggaag

SEQ ID NO: 38874 - RNA, 23 nt, Artificial Sequence
  Synthetic
ccccggggacgggugggaggaag

SEQ ID NO: 38875 - RNA, 24 nt, Artificial Sequence
  Synthetic
cccccggggacgggugggaggaag

SEQ ID NO: 38876 - RNA, 18 nt, Artificial Sequence
  Synthetic
gugguccucguggaccag

SEQ ID NO: 38877 - RNA, 19 nt, Artificial Sequence
  Synthetic
cgugguccucguggaccag

SEQ ID NO: 38878 - RNA, 20 nt, Artificial Sequence
  Synthetic
acgugguccucguggaccag

SEQ ID NO: 38879 - RNA, 21 nt, Artificial Sequence
  Synthetic
uacgugguccucguggaccag

SEQ ID NO: 38880 - RNA, 22 nt, Artificial Sequence
  Synthetic
cuacgugguccucguggaccag

SEQ ID NO: 38881 - RNA, 23 nt, Artificial Sequence
  Synthetic
ccuacgugguccucguggaccag

SEQ ID NO: 38882 - RNA, 24 nt, Artificial Sequence
  Synthetic
gccuacgugguccucguggaccag

SEQ ID NO: 38883 - RNA, 18 nt, Artificial Sequence
  Synthetic
ugcagcucccccgcgcag

SEQ ID NO: 38884 - RNA, 19 nt, Artificial Sequence
  Synthetic
augcagcucccccgcgcag

SEQ ID NO: 38885 - RNA, 20 nt, Artificial Sequence
  Synthetic
gaugcagcucccccgcgcag

SEQ ID NO: 38886 - RNA, 21 nt, Artificial Sequence
  Synthetic
ugaugcagcucccccgcgcag

SEQ ID NO: 38887 - RNA, 22 nt, Artificial Sequence
  Synthetic
uugaugcagcucccccgcgcag

SEQ ID NO: 38888 - RNA, 23 nt, Artificial Sequence
  Synthetic
uuugaugcagcucccccgcgcag

SEQ ID NO: 38889 - RNA, 24 nt, Artificial Sequence
  Synthetic
cuuugaugcagcucccccgcgcag

SEQ ID NO: 38890 - RNA, 18 nt, Artificial Sequence
  Synthetic
gaggcgccucgggggcag

SEQ ID NO: 38891 - RNA, 19 nt, Artificial Sequence
  Synthetic
cgaggcgccucgggggcag

SEQ ID NO: 38892 - RNA, 20 nt, Artificial Sequence
  Synthetic
ccgaggcgccucgggggcag

SEQ ID NO: 38893 - RNA, 21 nt, Artificial Sequence
  Synthetic
gccgaggcgccucgggggcag

SEQ ID NO: 38894 - RNA, 22 nt, Artificial Sequence
  Synthetic
ggccgaggcgccucgggggcag

SEQ ID NO: 38895 - RNA, 23 nt, Artificial Sequence
  Synthetic
cggccgaggcgccucgggggcag

SEQ ID NO: 38896 - RNA, 24 nt, Artificial Sequence
  Synthetic
ccggccgaggcgccucgggggcag

SEQ ID NO: 38897 - RNA, 18 nt, Artificial Sequence
  Synthetic
cuuuaucauagaacagag

SEQ ID NO: 38898 - RNA, 19 nt, Artificial Sequence
  Synthetic
ucuuuaucauagaacagag

SEQ ID NO: 38899 - RNA, 20 nt, Artificial Sequence
  Synthetic
gucuuuaucauagaacagag

SEQ ID NO: 38900 - RNA, 21 nt, Artificial Sequence
  Synthetic
ggucuuuaucauagaacagag

SEQ ID NO: 38901 - RNA, 22 nt, Artificial Sequence
  Synthetic
uggucuuuaucauagaacagag

SEQ ID NO: 38902 - RNA, 23 nt, Artificial Sequence
  Synthetic
uuggucuuuaucauagaacagag

SEQ ID NO: 38903 - RNA, 24 nt, Artificial Sequence
  Synthetic
guuggucuuuaucauagaacagag

SEQ ID NO: 38904 - RNA, 18 nt, Artificial Sequence
  Synthetic
gggaacuuugauagagag

SEQ ID NO: 38905 - RNA, 19 nt, Artificial Sequence
  Synthetic
agggaacuuugauagagag

SEQ ID NO: 38906 - RNA, 20 nt, Artificial Sequence
  Synthetic
cagggaacuuugauagagag

SEQ ID NO: 38907 - RNA, 21 nt, Artificial Sequence
  Synthetic
ccagggaacuuugauagagag

SEQ ID NO: 38908 - RNA, 22 nt, Artificial Sequence
  Synthetic
gccagggaacuuugauagagag

SEQ ID NO: 38909 - RNA, 23 nt, Artificial Sequence
  Synthetic
ggccagggaacuuugauagagag

SEQ ID NO: 38910 - RNA, 24 nt, Artificial Sequence
  Synthetic
gggccagggaacuuugauagagag

SEQ ID NO: 38911 - RNA, 18 nt, Artificial Sequence
  Synthetic
guccggcgcuggggagag

SEQ ID NO: 38912 - RNA, 19 nt, Artificial Sequence
  Synthetic
cguccggcgcuggggagag

SEQ ID NO: 38913 - RNA, 20 nt, Artificial Sequence
  Synthetic
gcguccggcgcuggggagag

SEQ ID NO: 38914 - RNA, 21 nt, Artificial Sequence
  Synthetic
cgcguccggcgcuggggagag

SEQ ID NO: 38915 - RNA, 22 nt, Artificial Sequence
  Synthetic
ccgcguccggcgcuggggagag

SEQ ID NO: 38916 - RNA, 23 nt, Artificial Sequence
  Synthetic
uccgcguccggcgcuggggagag

SEQ ID NO: 38917 - RNA, 24 nt, Artificial Sequence
  Synthetic
guccgcguccggcgcuggggagag

SEQ ID NO: 38918 - RNA, 18 nt, Artificial Sequence
  Synthetic
cagggaacuuugauagag

SEQ ID NO: 38919 - RNA, 19 nt, Artificial Sequence
  Synthetic
ccagggaacuuugauagag

SEQ ID NO: 38920 - RNA, 20 nt, Artificial Sequence
  Synthetic
gccagggaacuuugauagag

SEQ ID NO: 38921 - RNA, 21 nt, Artificial Sequence
  Synthetic
ggccagggaacuuugauagag

SEQ ID NO: 38922 - RNA, 22 nt, Artificial Sequence
  Synthetic
gggccagggaacuuugauagag

SEQ ID NO: 38923 - RNA, 23 nt, Artificial Sequence
  Synthetic
ggggccagggaacuuugauagag

SEQ ID NO: 38924 - RNA, 24 nt, Artificial Sequence
  Synthetic
aggggccagggaacuuugauagag

SEQ ID NO: 38925 - RNA, 18 nt, Artificial Sequence
  Synthetic
cuggcugggagaaaggag

SEQ ID NO: 38926 - RNA, 19 nt, Artificial Sequence
  Synthetic
ccuggcugggagaaaggag

SEQ ID NO: 38927 - RNA, 20 nt, Artificial Sequence
  Synthetic
cccuggcugggagaaaggag

SEQ ID NO: 38928 - RNA, 21 nt, Artificial Sequence
  Synthetic
acccuggcugggagaaaggag

SEQ ID NO: 38929 - RNA, 22 nt, Artificial Sequence
  Synthetic
cacccuggcugggagaaaggag

SEQ ID NO: 38930 - RNA, 23 nt, Artificial Sequence
  Synthetic
ucacccuggcugggagaaaggag

SEQ ID NO: 38931 - RNA, 24 nt, Artificial Sequence
  Synthetic
cucacccuggcugggagaaaggag

SEQ ID NO: 38932 - RNA, 18 nt, Artificial Sequence
  Synthetic
acgggugggaggaaggag

SEQ ID NO: 38933 - RNA, 19 nt, Artificial Sequence
  Synthetic
gacgggugggaggaaggag

SEQ ID NO: 38934 - RNA, 20 nt, Artificial Sequence
  Synthetic
ggacgggugggaggaaggag

SEQ ID NO: 38935 - RNA, 21 nt, Artificial Sequence
  Synthetic
gggacgggugggaggaaggag

SEQ ID NO: 38936 - RNA, 22 nt, Artificial Sequence
  Synthetic
ggggacgggugggaggaaggag

SEQ ID NO: 38937 - RNA, 23 nt, Artificial Sequence
  Synthetic
cggggacgggugggaggaaggag

SEQ ID NO: 38938 - RNA, 24 nt, Artificial Sequence
  Synthetic
ccggggacgggugggaggaaggag

SEQ ID NO: 38939 - RNA, 18 nt, Artificial Sequence
  Synthetic
ggggguggugggcaggag

SEQ ID NO: 38940 - RNA, 19 nt, Artificial Sequence
  Synthetic
uggggguggugggcaggag

SEQ ID NO: 38941 - RNA, 20 nt, Artificial Sequence
  Synthetic
cuggggguggugggcaggag

SEQ ID NO: 38942 - RNA, 21 nt, Artificial Sequence
  Synthetic
ccuggggguggugggcaggag

SEQ ID NO: 38943 - RNA, 22 nt, Artificial Sequence
  Synthetic
cccuggggguggugggcaggag

SEQ ID NO: 38944 - RNA, 23 nt, Artificial Sequence
  Synthetic
acccuggggguggugggcaggag

SEQ ID NO: 38945 - RNA, 24 nt, Artificial Sequence
  Synthetic
gacccuggggguggugggcaggag

SEQ ID NO: 38946 - RNA, 18 nt, Artificial Sequence
  Synthetic
gggagaaaggaggaggag

SEQ ID NO: 38947 - RNA, 19 nt, Artificial Sequence
  Synthetic
ugggagaaaggaggaggag

SEQ ID NO: 38948 - RNA, 20 nt, Artificial Sequence
  Synthetic
cugggagaaaggaggaggag

SEQ ID NO: 38949 - RNA, 21 nt, Artificial Sequence
  Synthetic
gcugggagaaaggaggaggag

SEQ ID NO: 38950 - RNA, 22 nt, Artificial Sequence
  Synthetic
ggcugggagaaaggaggaggag

SEQ ID NO: 38951 - RNA, 23 nt, Artificial Sequence
  Synthetic
uggcugggagaaaggaggaggag

SEQ ID NO: 38952 - RNA, 24 nt, Artificial Sequence
  Synthetic
cuggcugggagaaaggaggaggag

SEQ ID NO: 38953 - RNA, 18 nt, Artificial Sequence
  Synthetic
ggaagggaggaggaggag

SEQ ID NO: 38954 - RNA, 19 nt, Artificial Sequence
  Synthetic
gggaagggaggaggaggag

SEQ ID NO: 38955 - RNA, 20 nt, Artificial Sequence
  Synthetic
ggggaagggaggaggaggag

SEQ ID NO: 38956 - RNA, 21 nt, Artificial Sequence
  Synthetic
gggggaagggaggaggaggag

SEQ ID NO: 38957 - RNA, 22 nt, Artificial Sequence
  Synthetic
ggggggaagggaggaggaggag

SEQ ID NO: 38958 - RNA, 23 nt, Artificial Sequence
  Synthetic
gggggggaagggaggaggaggag

SEQ ID NO: 38959 - RNA, 24 nt, Artificial Sequence
  Synthetic
ugggggggaagggaggaggaggag

SEQ ID NO: 38960 - RNA, 18 nt, Artificial Sequence
  Synthetic
gggggaagggaggaggag

SEQ ID NO: 38961 - RNA, 19 nt, Artificial Sequence
  Synthetic
ggggggaagggaggaggag

SEQ ID NO: 38962 - RNA, 20 nt, Artificial Sequence
  Synthetic
gggggggaagggaggaggag

SEQ ID NO: 38963 - RNA, 21 nt, Artificial Sequence
  Synthetic
ugggggggaagggaggaggag

SEQ ID NO: 38964 - RNA, 22 nt, Artificial Sequence
  Synthetic
augggggggaagggaggaggag

SEQ ID NO: 38965 - RNA, 23 nt, Artificial Sequence
  Synthetic
gaugggggggaagggaggaggag

SEQ ID NO: 38966 - RNA, 24 nt, Artificial Sequence
  Synthetic
ggaugggggggaagggaggaggag

SEQ ID NO: 38967 - RNA, 18 nt, Artificial Sequence
  Synthetic
ugggggggaagggaggag

SEQ ID NO: 38968 - RNA, 19 nt, Artificial Sequence
  Synthetic
augggggggaagggaggag

SEQ ID NO: 38969 - RNA, 20 nt, Artificial Sequence
  Synthetic
gaugggggggaagggaggag

SEQ ID NO: 38970 - RNA, 21 nt, Artificial Sequence
  Synthetic
ggaugggggggaagggaggag

SEQ ID NO: 38971 - RNA, 22 nt, Artificial Sequence
  Synthetic
gggaugggggggaagggaggag

SEQ ID NO: 38972 - RNA, 23 nt, Artificial Sequence
  Synthetic
ggggaugggggggaagggaggag

SEQ ID NO: 38973 - RNA, 24 nt, Artificial Sequence
  Synthetic
cggggaugggggggaagggaggag

SEQ ID NO: 38974 - RNA, 18 nt, Artificial Sequence
  Synthetic
ggcucggggagggaggag

SEQ ID NO: 38975 - RNA, 19 nt, Artificial Sequence
  Synthetic
uggcucggggagggaggag

SEQ ID NO: 38976 - RNA, 20 nt, Artificial Sequence
  Synthetic
cuggcucggggagggaggag

SEQ ID NO: 38977 - RNA, 21 nt, Artificial Sequence
  Synthetic
ccuggcucggggagggaggag

SEQ ID NO: 38978 - RNA, 22 nt, Artificial Sequence
  Synthetic
gccuggcucggggagggaggag

SEQ ID NO: 38979 - RNA, 23 nt, Artificial Sequence
  Synthetic
cgccuggcucggggagggaggag

SEQ ID NO: 38980 - RNA, 24 nt, Artificial Sequence
  Synthetic
gcgccuggcucggggagggaggag

SEQ ID NO: 38981 - RNA, 18 nt, Artificial Sequence
  Synthetic
acgccccccgcgucggag

SEQ ID NO: 38982 - RNA, 19 nt, Artificial Sequence
  Synthetic
gacgccccccgcgucggag

SEQ ID NO: 38983 - RNA, 20 nt, Artificial Sequence
  Synthetic
cgacgccccccgcgucggag

SEQ ID NO: 38984 - RNA, 21 nt, Artificial Sequence
  Synthetic
ccgacgccccccgcgucggag

SEQ ID NO: 38985 - RNA, 22 nt, Artificial Sequence
  Synthetic
cccgacgccccccgcgucggag

SEQ ID NO: 38986 - RNA, 23 nt, Artificial Sequence
  Synthetic
acccgacgccccccgcgucggag

SEQ ID NO: 38987 - RNA, 24 nt, Artificial Sequence
  Synthetic
uacccgacgccccccgcgucggag

SEQ ID NO: 38988 - RNA, 18 nt, Artificial Sequence
  Synthetic
ggaugggggggaagggag

SEQ ID NO: 38989 - RNA, 19 nt, Artificial Sequence
  Synthetic
gggaugggggggaagggag

SEQ ID NO: 38990 - RNA, 20 nt, Artificial Sequence
  Synthetic
ggggaugggggggaagggag

SEQ ID NO: 38991 - RNA, 21 nt, Artificial Sequence
  Synthetic
cggggaugggggggaagggag

SEQ ID NO: 38992 - RNA, 22 nt, Artificial Sequence
  Synthetic
ccggggaugggggggaagggag

SEQ ID NO: 38993 - RNA, 23 nt, Artificial Sequence
  Synthetic
gccggggaugggggggaagggag

SEQ ID NO: 38994 - RNA, 24 nt, Artificial Sequence
  Synthetic
ggccggggaugggggggaagggag

SEQ ID NO: 38995 - RNA, 18 nt, Artificial Sequence
  Synthetic
guccguguugacagggag

SEQ ID NO: 38996 - RNA, 19 nt, Artificial Sequence
  Synthetic
uguccguguugacagggag

SEQ ID NO: 38997 - RNA, 20 nt, Artificial Sequence
  Synthetic
guguccguguugacagggag

SEQ ID NO: 38998 - RNA, 21 nt, Artificial Sequence
  Synthetic
uguguccguguugacagggag

SEQ ID NO: 38999 - RNA, 22 nt, Artificial Sequence
  Synthetic
guguguccguguugacagggag

SEQ ID NO: 39000 - RNA, 23 nt, Artificial Sequence
  Synthetic
aguguguccguguugacagggag

SEQ ID NO: 39001 - RNA, 24 nt, Artificial Sequence
  Synthetic
gaguguguccguguugacagggag

SEQ ID NO: 39002 - RNA, 18 nt, Artificial Sequence
  Synthetic
ggaggaaggaggagggag

SEQ ID NO: 39003 - RNA, 19 nt, Artificial Sequence
  Synthetic
gggaggaaggaggagggag

SEQ ID NO: 39004 - RNA, 20 nt, Artificial Sequence
  Synthetic
ugggaggaaggaggagggag

SEQ ID NO: 39005 - RNA, 21 nt, Artificial Sequence
  Synthetic
gugggaggaaggaggagggag

SEQ ID NO: 39006 - RNA, 22 nt, Artificial Sequence
  Synthetic
ggugggaggaaggaggagggag

SEQ ID NO: 39007 - RNA, 23 nt, Artificial Sequence
  Synthetic
gggugggaggaaggaggagggag

SEQ ID NO: 39008 - RNA, 24 nt, Artificial Sequence
  Synthetic
cgggugggaggaaggaggagggag

SEQ ID NO: 39009 - RNA, 18 nt, Artificial Sequence
  Synthetic
ccuggcucggggagggag

SEQ ID NO: 39010 - RNA, 19 nt, Artificial Sequence
  Synthetic
gccuggcucggggagggag

SEQ ID NO: 39011 - RNA, 20 nt, Artificial Sequence
  Synthetic
cgccuggcucggggagggag

SEQ ID NO: 39012 - RNA, 21 nt, Artificial Sequence
  Synthetic
gcgccuggcucggggagggag

SEQ ID NO: 39013 - RNA, 22 nt, Artificial Sequence
  Synthetic
ggcgccuggcucggggagggag

SEQ ID NO: 39014 - RNA, 23 nt, Artificial Sequence
  Synthetic
gggcgccuggcucggggagggag

SEQ ID NO: 39015 - RNA, 24 nt, Artificial Sequence
  Synthetic
agggcgccuggcucggggagggag

SEQ ID NO: 39016 - RNA, 18 nt, Artificial Sequence
  Synthetic
cacccguggucucgggag

SEQ ID NO: 39017 - RNA, 19 nt, Artificial Sequence
  Synthetic
ccacccguggucucgggag

SEQ ID NO: 39018 - RNA, 20 nt, Artificial Sequence
  Synthetic
gccacccguggucucgggag

SEQ ID NO: 39019 - RNA, 21 nt, Artificial Sequence
  Synthetic
cgccacccguggucucgggag

SEQ ID NO: 39020 - RNA, 22 nt, Artificial Sequence
  Synthetic
gcgccacccguggucucgggag

SEQ ID NO: 39021 - RNA, 23 nt, Artificial Sequence
  Synthetic
cgcgccacccguggucucgggag

SEQ ID NO: 39022 - RNA, 24 nt, Artificial Sequence
  Synthetic
ucgcgccacccguggucucgggag

SEQ ID NO: 39023 - RNA, 18 nt, Artificial Sequence
  Synthetic
cccgcgggccacggggag

SEQ ID NO: 39024 - RNA, 19 nt, Artificial Sequence
  Synthetic
ccccgcgggccacggggag

SEQ ID NO: 39025 - RNA, 20 nt, Artificial Sequence
  Synthetic
cccccgcgggccacggggag

SEQ ID NO: 39026 - RNA, 21 nt, Artificial Sequence
  Synthetic
gcccccgcgggccacggggag

SEQ ID NO: 39027 - RNA, 22 nt, Artificial Sequence
  Synthetic
cgcccccgcgggccacggggag

SEQ ID NO: 39028 - RNA, 23 nt, Artificial Sequence
  Synthetic
acgcccccgcgggccacggggag

SEQ ID NO: 39029 - RNA, 24 nt, Artificial Sequence
  Synthetic
gacgcccccgcgggccacggggag

SEQ ID NO: 39030 - RNA, 18 nt, Artificial Sequence
  Synthetic
ccucgggggcagggggag

SEQ ID NO: 39031 - RNA, 19 nt, Artificial Sequence
  Synthetic
gccucgggggcagggggag

SEQ ID NO: 39032 - RNA, 20 nt, Artificial Sequence
  Synthetic
cgccucgggggcagggggag

SEQ ID NO: 39033 - RNA, 21 nt, Artificial Sequence
  Synthetic
gcgccucgggggcagggggag

SEQ ID NO: 39034 - RNA, 22 nt, Artificial Sequence
  Synthetic
ggcgccucgggggcagggggag

SEQ ID NO: 39035 - RNA, 23 nt, Artificial Sequence
  Synthetic
aggcgccucgggggcagggggag

SEQ ID NO: 39036 - RNA, 24 nt, Artificial Sequence
  Synthetic
gaggcgccucgggggcagggggag

SEQ ID NO: 39037 - RNA, 18 nt, Artificial Sequence
  Synthetic
aggaagugggggugggag

SEQ ID NO: 39038 - RNA, 19 nt, Artificial Sequence
  Synthetic
caggaagugggggugggag

SEQ ID NO: 39039 - RNA, 20 nt, Artificial Sequence
  Synthetic
acaggaagugggggugggag

SEQ ID NO: 39040 - RNA, 21 nt, Artificial Sequence
  Synthetic
gacaggaagugggggugggag

SEQ ID NO: 39041 - RNA, 22 nt, Artificial Sequence
  Synthetic
agacaggaagugggggugggag

SEQ ID NO: 39042 - RNA, 23 nt, Artificial Sequence
  Synthetic
gagacaggaagugggggugggag

SEQ ID NO: 39043 - RNA, 24 nt, Artificial Sequence
  Synthetic
ggagacaggaagugggggugggag

SEQ ID NO: 39044 - RNA, 18 nt, Artificial Sequence
  Synthetic
cccguccuggacauggag

SEQ ID NO: 39045 - RNA, 19 nt, Artificial Sequence
  Synthetic
gcccguccuggacauggag

SEQ ID NO: 39046 - RNA, 20 nt, Artificial Sequence
  Synthetic
ugcccguccuggacauggag

SEQ ID NO: 39047 - RNA, 21 nt, Artificial Sequence
  Synthetic
cugcccguccuggacauggag

SEQ ID NO: 39048 - RNA, 22 nt, Artificial Sequence
  Synthetic
ccugcccguccuggacauggag

SEQ ID NO: 39049 - RNA, 23 nt, Artificial Sequence
  Synthetic
gccugcccguccuggacauggag

SEQ ID NO: 39050 - RNA, 24 nt, Artificial Sequence
  Synthetic
ugccugcccguccuggacauggag

SEQ ID NO: 39051 - RNA, 18 nt, Artificial Sequence
  Synthetic
gcgggccacggggaguag

SEQ ID NO: 39052 - RNA, 19 nt, Artificial Sequence
  Synthetic
cgcgggccacggggaguag

SEQ ID NO: 39053 - RNA, 20 nt, Artificial Sequence
  Synthetic
ccgcgggccacggggaguag

SEQ ID NO: 39054 - RNA, 21 nt, Artificial Sequence
  Synthetic
cccgcgggccacggggaguag

SEQ ID NO: 39055 - RNA, 22 nt, Artificial Sequence
  Synthetic
ccccgcgggccacggggaguag

SEQ ID NO: 39056 - RNA, 23 nt, Artificial Sequence
  Synthetic
cccccgcgggccacggggaguag

SEQ ID NO: 39057 - RNA, 24 nt, Artificial Sequence
  Synthetic
gcccccgcgggccacggggaguag

SEQ ID NO: 39058 - RNA, 18 nt, Artificial Sequence
  Synthetic
ccaggaagacgcgccacg

SEQ ID NO: 39059 - RNA, 19 nt, Artificial Sequence
  Synthetic
gccaggaagacgcgccacg

SEQ ID NO: 39060 - RNA, 20 nt, Artificial Sequence
  Synthetic
ugccaggaagacgcgccacg

SEQ ID NO: 39061 - RNA, 21 nt, Artificial Sequence
  Synthetic
gugccaggaagacgcgccacg

SEQ ID NO: 39062 - RNA, 22 nt, Artificial Sequence
  Synthetic
ugugccaggaagacgcgccacg

SEQ ID NO: 39063 - RNA, 23 nt, Artificial Sequence
  Synthetic
gugugccaggaagacgcgccacg

SEQ ID NO: 39064 - RNA, 24 nt, Artificial Sequence
  Synthetic
agugugccaggaagacgcgccacg

SEQ ID NO: 39065 - RNA, 18 nt, Artificial Sequence
  Synthetic
gugaacaagacggucacg

SEQ ID NO: 39066 - RNA, 19 nt, Artificial Sequence
  Synthetic
cgugaacaagacggucacg

SEQ ID NO: 39067 - RNA, 20 nt, Artificial Sequence
  Synthetic
acgugaacaagacggucacg

SEQ ID NO: 39068 - RNA, 21 nt, Artificial Sequence
  Synthetic
uacgugaacaagacggucacg

SEQ ID NO: 39069 - RNA, 22 nt, Artificial Sequence
  Synthetic
uuacgugaacaagacggucacg

SEQ ID NO: 39070 - RNA, 23 nt, Artificial Sequence
  Synthetic
cuuacgugaacaagacggucacg

SEQ ID NO: 39071 - RNA, 24 nt, Artificial Sequence
  Synthetic
ccuuacgugaacaagacggucacg

SEQ ID NO: 39072 - RNA, 18 nt, Artificial Sequence
  Synthetic
uggggggggggaaagacg

SEQ ID NO: 39073 - RNA, 19 nt, Artificial Sequence
  Synthetic
guggggggggggaaagacg

SEQ ID NO: 39074 - RNA, 20 nt, Artificial Sequence
  Synthetic
gguggggggggggaaagacg

SEQ ID NO: 39075 - RNA, 21 nt, Artificial Sequence
  Synthetic
agguggggggggggaaagacg

SEQ ID NO: 39076 - RNA, 22 nt, Artificial Sequence
  Synthetic
gagguggggggggggaaagacg

SEQ ID NO: 39077 - RNA, 23 nt, Artificial Sequence
  Synthetic
ggagguggggggggggaaagacg

SEQ ID NO: 39078 - RNA, 24 nt, Artificial Sequence
  Synthetic
gggagguggggggggggaaagacg

SEQ ID NO: 39079 - RNA, 18 nt, Artificial Sequence
  Synthetic
guccucguggaccagacg

SEQ ID NO: 39080 - RNA, 19 nt, Artificial Sequence
  Synthetic
gguccucguggaccagacg

SEQ ID NO: 39081 - RNA, 20 nt, Artificial Sequence
  Synthetic
ugguccucguggaccagacg

SEQ ID NO: 39082 - RNA, 21 nt, Artificial Sequence
  Synthetic
gugguccucguggaccagacg

SEQ ID NO: 39083 - RNA, 22 nt, Artificial Sequence
  Synthetic
cgugguccucguggaccagacg

SEQ ID NO: 39084 - RNA, 23 nt, Artificial Sequence
  Synthetic
acgugguccucguggaccagacg

SEQ ID NO: 39085 - RNA, 24 nt, Artificial Sequence
  Synthetic
uacgugguccucguggaccagacg

SEQ ID NO: 39086 - RNA, 18 nt, Artificial Sequence
  Synthetic
agccucuggaugaccccg

SEQ ID NO: 39087 - RNA, 19 nt, Artificial Sequence
  Synthetic
cagccucuggaugaccccg

SEQ ID NO: 39088 - RNA, 20 nt, Artificial Sequence
  Synthetic
acagccucuggaugaccccg

SEQ ID NO: 39089 - RNA, 21 nt, Artificial Sequence
  Synthetic
aacagccucuggaugaccccg

SEQ ID NO: 39090 - RNA, 22 nt, Artificial Sequence
  Synthetic
gaacagccucuggaugaccccg

SEQ ID NO: 39091 - RNA, 23 nt, Artificial Sequence
  Synthetic
ggaacagccucuggaugaccccg

SEQ ID NO: 39092 - RNA, 24 nt, Artificial Sequence
  Synthetic
uggaacagccucuggaugaccccg

SEQ ID NO: 39093 - RNA, 18 nt, Artificial Sequence
  Synthetic
cacucggcuugcugcccg

SEQ ID NO: 39094 - RNA, 19 nt, Artificial Sequence
  Synthetic
acacucggcuugcugcccg

SEQ ID NO: 39095 - RNA, 20 nt, Artificial Sequence
  Synthetic
aacacucggcuugcugcccg

SEQ ID NO: 39096 - RNA, 21 nt, Artificial Sequence
  Synthetic
uaacacucggcuugcugcccg

SEQ ID NO: 39097 - RNA, 22 nt, Artificial Sequence
  Synthetic
cuaacacucggcuugcugcccg

SEQ ID NO: 39098 - RNA, 23 nt, Artificial Sequence
  Synthetic
gcuaacacucggcuugcugcccg

SEQ ID NO: 39099 - RNA, 24 nt, Artificial Sequence
  Synthetic
agcuaacacucggcuugcugcccg

SEQ ID NO: 39100 - RNA, 18 nt, Artificial Sequence
  Synthetic
ccccgcgcugcugcgccg

SEQ ID NO: 39101 - RNA, 19 nt, Artificial Sequence
  Synthetic
cccccgcgcugcugcgccg

SEQ ID NO: 39102 - RNA, 20 nt, Artificial Sequence
  Synthetic
gcccccgcgcugcugcgccg

SEQ ID NO: 39103 - RNA, 21 nt, Artificial Sequence
  Synthetic
ggcccccgcgcugcugcgccg

SEQ ID NO: 39104 - RNA, 22 nt, Artificial Sequence
  Synthetic
cggcccccgcgcugcugcgccg

SEQ ID NO: 39105 - RNA, 23 nt, Artificial Sequence
  Synthetic
ucggcccccgcgcugcugcgccg

SEQ ID NO: 39106 - RNA, 24 nt, Artificial Sequence
  Synthetic
cucggcccccgcgcugcugcgccg

SEQ ID NO: 39107 - RNA, 18 nt, Artificial Sequence
  Synthetic
gcugcgccgcgggggccg

SEQ ID NO: 39108 - RNA, 19 nt, Artificial Sequence
  Synthetic
ugcugcgccgcgggggccg

SEQ ID NO: 39109 - RNA, 20 nt, Artificial Sequence
  Synthetic
cugcugcgccgcgggggccg

SEQ ID NO: 39110 - RNA, 21 nt, Artificial Sequence
  Synthetic
gcugcugcgccgcgggggccg

SEQ ID NO: 39111 - RNA, 22 nt, Artificial Sequence
  Synthetic
cgcugcugcgccgcgggggccg

SEQ ID NO: 39112 - RNA, 23 nt, Artificial Sequence
  Synthetic
gcgcugcugcgccgcgggggccg

SEQ ID NO: 39113 - RNA, 24 nt, Artificial Sequence
  Synthetic
cgcgcugcugcgccgcgggggccg

SEQ ID NO: 39114 - RNA, 18 nt, Artificial Sequence
  Synthetic
aggaagacgcgccacgcg

SEQ ID NO: 39115 - RNA, 19 nt, Artificial Sequence
  Synthetic
caggaagacgcgccacgcg

SEQ ID NO: 39116 - RNA, 20 nt, Artificial Sequence
  Synthetic
ccaggaagacgcgccacgcg

SEQ ID NO: 39117 - RNA, 21 nt, Artificial Sequence
  Synthetic
gccaggaagacgcgccacgcg

SEQ ID NO: 39118 - RNA, 22 nt, Artificial Sequence
  Synthetic
ugccaggaagacgcgccacgcg

SEQ ID NO: 39119 - RNA, 23 nt, Artificial Sequence
  Synthetic
gugccaggaagacgcgccacgcg

SEQ ID NO: 39120 - RNA, 24 nt, Artificial Sequence
  Synthetic
ugugccaggaagacgcgccacgcg

SEQ ID NO: 39121 - RNA, 18 nt, Artificial Sequence
  Synthetic
uacccgacgccccccgcg

SEQ ID NO: 39122 - RNA, 19 nt, Artificial Sequence
  Synthetic
cuacccgacgccccccgcg

SEQ ID NO: 39123 - RNA, 20 nt, Artificial Sequence
  Synthetic
acuacccgacgccccccgcg

SEQ ID NO: 39124 - RNA, 21 nt, Artificial Sequence
  Synthetic
gacuacccgacgccccccgcg

SEQ ID NO: 39125 - RNA, 22 nt, Artificial Sequence
  Synthetic
cgacuacccgacgccccccgcg

SEQ ID NO: 39126 - RNA, 23 nt, Artificial Sequence
  Synthetic
ccgacuacccgacgccccccgcg

SEQ ID NO: 39127 - RNA, 24 nt, Artificial Sequence
  Synthetic
cccgacuacccgacgccccccgcg

SEQ ID NO: 39128 - RNA, 18 nt, Artificial Sequence
  Synthetic
cgggccgcggcccccgcg

SEQ ID NO: 39129 - RNA, 19 nt, Artificial Sequence
  Synthetic
gcgggccgcggcccccgcg

SEQ ID NO: 39130 - RNA, 20 nt, Artificial Sequence
  Synthetic
ugcgggccgcggcccccgcg

SEQ ID NO: 39131 - RNA, 21 nt, Artificial Sequence
  Synthetic
cugcgggccgcggcccccgcg

SEQ ID NO: 39132 - RNA, 22 nt, Artificial Sequence
  Synthetic
gcugcgggccgcggcccccgcg

SEQ ID NO: 39133 - RNA, 23 nt, Artificial Sequence
  Synthetic
ugcugcgggccgcggcccccgcg

SEQ ID NO: 39134 - RNA, 24 nt, Artificial Sequence
  Synthetic
cugcugcgggccgcggcccccgcg

SEQ ID NO: 39135 - RNA, 18 nt, Artificial Sequence
  Synthetic
ugaugcagcucccccgcg

SEQ ID NO: 39136 - RNA, 19 nt, Artificial Sequence
  Synthetic
uugaugcagcucccccgcg

SEQ ID NO: 39137 - RNA, 20 nt, Artificial Sequence
  Synthetic
uuugaugcagcucccccgcg

SEQ ID NO: 39138 - RNA, 21 nt, Artificial Sequence
  Synthetic
cuuugaugcagcucccccgcg

SEQ ID NO: 39139 - RNA, 22 nt, Artificial Sequence
  Synthetic
ccuuugaugcagcucccccgcg

SEQ ID NO: 39140 - RNA, 23 nt, Artificial Sequence
  Synthetic
gccuuugaugcagcucccccgcg

SEQ ID NO: 39141 - RNA, 24 nt, Artificial Sequence
  Synthetic
ggccuuugaugcagcucccccgcg

SEQ ID NO: 39142 - RNA, 18 nt, Artificial Sequence
  Synthetic
ggcacccuggugggcgcg

SEQ ID NO: 39143 - RNA, 19 nt, Artificial Sequence
  Synthetic
gggcacccuggugggcgcg

SEQ ID NO: 39144 - RNA, 20 nt, Artificial Sequence
  Synthetic
agggcacccuggugggcgcg

SEQ ID NO: 39145 - RNA, 21 nt, Artificial Sequence
  Synthetic
cagggcacccuggugggcgcg

SEQ ID NO: 39146 - RNA, 22 nt, Artificial Sequence
  Synthetic
ccagggcacccuggugggcgcg

SEQ ID NO: 39147 - RNA, 23 nt, Artificial Sequence
  Synthetic
accagggcacccuggugggcgcg

SEQ ID NO: 39148 - RNA, 24 nt, Artificial Sequence
  Synthetic
gaccagggcacccuggugggcgcg

SEQ ID NO: 39149 - RNA, 18 nt, Artificial Sequence
  Synthetic
ucgcguccgcguccggcg

SEQ ID NO: 39150 - RNA, 19 nt, Artificial Sequence
  Synthetic
gucgcguccgcguccggcg

SEQ ID NO: 39151 - RNA, 20 nt, Artificial Sequence
  Synthetic
cgucgcguccgcguccggcg

SEQ ID NO: 39152 - RNA, 21 nt, Artificial Sequence
  Synthetic
gcgucgcguccgcguccggcg

SEQ ID NO: 39153 - RNA, 22 nt, Artificial Sequence
  Synthetic
agcgucgcguccgcguccggcg

SEQ ID NO: 39154 - RNA, 23 nt, Artificial Sequence
  Synthetic
gagcgucgcguccgcguccggcg

SEQ ID NO: 39155 - RNA, 24 nt, Artificial Sequence
  Synthetic
ggagcgucgcguccgcguccggcg

SEQ ID NO: 39156 - RNA, 18 nt, Artificial Sequence
  Synthetic
gagacucccaucggggcg

SEQ ID NO: 39157 - RNA, 19 nt, Artificial Sequence
  Synthetic
ggagacucccaucggggcg

SEQ ID NO: 39158 - RNA, 20 nt, Artificial Sequence
  Synthetic
gggagacucccaucggggcg

SEQ ID NO: 39159 - RNA, 21 nt, Artificial Sequence
  Synthetic
ggggagacucccaucggggcg

SEQ ID NO: 39160 - RNA, 22 nt, Artificial Sequence
  Synthetic
cggggagacucccaucggggcg

SEQ ID NO: 39161 - RNA, 23 nt, Artificial Sequence
  Synthetic
gcggggagacucccaucggggcg

SEQ ID NO: 39162 - RNA, 24 nt, Artificial Sequence
  Synthetic
ugcggggagacucccaucggggcg

SEQ ID NO: 39163 - RNA, 18 nt, Artificial Sequence
  Synthetic
cuccuuacccuggcugcg

SEQ ID NO: 39164 - RNA, 19 nt, Artificial Sequence
  Synthetic
ccuccuuacccuggcugcg

SEQ ID NO: 39165 - RNA, 20 nt, Artificial Sequence
  Synthetic
cccuccuuacccuggcugcg

SEQ ID NO: 39166 - RNA, 21 nt, Artificial Sequence
  Synthetic
ccccuccuuacccuggcugcg

SEQ ID NO: 39167 - RNA, 22 nt, Artificial Sequence
  Synthetic
gccccuccuuacccuggcugcg

SEQ ID NO: 39168 - RNA, 23 nt, Artificial Sequence
  Synthetic
cgccccuccuuacccuggcugcg

SEQ ID NO: 39169 - RNA, 24 nt, Artificial Sequence
  Synthetic
ccgccccuccuuacccuggcugcg

SEQ ID NO: 39170 - RNA, 18 nt, Artificial Sequence
  Synthetic
cgcgcuaccugcccaucg

SEQ ID NO: 39171 - RNA, 19 nt, Artificial Sequence
  Synthetic
acgcgcuaccugcccaucg

SEQ ID NO: 39172 - RNA, 20 nt, Artificial Sequence
  Synthetic
cacgcgcuaccugcccaucg

SEQ ID NO: 39173 - RNA, 21 nt, Artificial Sequence
  Synthetic
ucacgcgcuaccugcccaucg

SEQ ID NO: 39174 - RNA, 22 nt, Artificial Sequence
  Synthetic
cucacgcgcuaccugcccaucg

SEQ ID NO: 39175 - RNA, 23 nt, Artificial Sequence
  Synthetic
ccucacgcgcuaccugcccaucg

SEQ ID NO: 39176 - RNA, 24 nt, Artificial Sequence
  Synthetic
gccucacgcgcuaccugcccaucg

SEQ ID NO: 39177 - RNA, 18 nt, Artificial Sequence
  Synthetic
gggagggcgccuggcucg

SEQ ID NO: 39178 - RNA, 19 nt, Artificial Sequence
  Synthetic
ugggagggcgccuggcucg

SEQ ID NO: 39179 - RNA, 20 nt, Artificial Sequence
  Synthetic
gugggagggcgccuggcucg

SEQ ID NO: 39180 - RNA, 21 nt, Artificial Sequence
  Synthetic
agugggagggcgccuggcucg

SEQ ID NO: 39181 - RNA, 22 nt, Artificial Sequence
  Synthetic
gagugggagggcgccuggcucg

SEQ ID NO: 39182 - RNA, 23 nt, Artificial Sequence
  Synthetic
ggagugggagggcgccuggcucg

SEQ ID NO: 39183 - RNA, 24 nt, Artificial Sequence
  Synthetic
aggagugggagggcgccuggcucg

SEQ ID NO: 39184 - RNA, 18 nt, Artificial Sequence
  Synthetic
cccuggcugggagaaagg

SEQ ID NO: 39185 - RNA, 19 nt, Artificial Sequence
  Synthetic
acccuggcugggagaaagg

SEQ ID NO: 39186 - RNA, 20 nt, Artificial Sequence
  Synthetic
cacccuggcugggagaaagg

SEQ ID NO: 39187 - RNA, 21 nt, Artificial Sequence
  Synthetic
ucacccuggcugggagaaagg

SEQ ID NO: 39188 - RNA, 22 nt, Artificial Sequence
  Synthetic
cucacccuggcugggagaaagg

SEQ ID NO: 39189 - RNA, 23 nt, Artificial Sequence
  Synthetic
ccucacccuggcugggagaaagg

SEQ ID NO: 39190 - RNA, 24 nt, Artificial Sequence
  Synthetic
uccucacccuggcugggagaaagg

SEQ ID NO: 39191 - RNA, 18 nt, Artificial Sequence
  Synthetic
ggacgggugggaggaagg

SEQ ID NO: 39192 - RNA, 19 nt, Artificial Sequence
  Synthetic
gggacgggugggaggaagg

SEQ ID NO: 39193 - RNA, 20 nt, Artificial Sequence
  Synthetic
ggggacgggugggaggaagg

SEQ ID NO: 39194 - RNA, 21 nt, Artificial Sequence
  Synthetic
cggggacgggugggaggaagg

SEQ ID NO: 39195 - RNA, 22 nt, Artificial Sequence
  Synthetic
ccggggacgggugggaggaagg

SEQ ID NO: 39196 - RNA, 23 nt, Artificial Sequence
  Synthetic
cccggggacgggugggaggaagg

SEQ ID NO: 39197 - RNA, 24 nt, Artificial Sequence
  Synthetic
ccccggggacgggugggaggaagg

SEQ ID NO: 39198 - RNA, 18 nt, Artificial Sequence
  Synthetic
cggggaugggggggaagg

SEQ ID NO: 39199 - RNA, 19 nt, Artificial Sequence
  Synthetic
ccggggaugggggggaagg

SEQ ID NO: 39200 - RNA, 20 nt, Artificial Sequence
  Synthetic
gccggggaugggggggaagg

SEQ ID NO: 39201 - RNA, 21 nt, Artificial Sequence
  Synthetic
ggccggggaugggggggaagg

SEQ ID NO: 39202 - RNA, 22 nt, Artificial Sequence
  Synthetic
gggccggggaugggggggaagg

SEQ ID NO: 39203 - RNA, 23 nt, Artificial Sequence
  Synthetic
ggggccggggaugggggggaagg

SEQ ID NO: 39204 - RNA, 24 nt, Artificial Sequence
  Synthetic
gggggccggggaugggggggaagg

SEQ ID NO: 39205 - RNA, 18 nt, Artificial Sequence
  Synthetic
uguguccguguugacagg

SEQ ID NO: 39206 - RNA, 19 nt, Artificial Sequence
  Synthetic
guguguccguguugacagg

SEQ ID NO: 39207 - RNA, 20 nt, Artificial Sequence
  Synthetic
aguguguccguguugacagg

SEQ ID NO: 39208 - RNA, 21 nt, Artificial Sequence
  Synthetic
gaguguguccguguugacagg

SEQ ID NO: 39209 - RNA, 22 nt, Artificial Sequence
  Synthetic
agaguguguccguguugacagg

SEQ ID NO: 39210 - RNA, 23 nt, Artificial Sequence
  Synthetic
aagaguguguccguguugacagg

SEQ ID NO: 39211 - RNA, 24 nt, Artificial Sequence
  Synthetic
aaagaguguguccguguugacagg

SEQ ID NO: 39212 - RNA, 18 nt, Artificial Sequence
  Synthetic
gaaaggaggaggagcagg

SEQ ID NO: 39213 - RNA, 19 nt, Artificial Sequence
  Synthetic
agaaaggaggaggagcagg

SEQ ID NO: 39214 - RNA, 20 nt, Artificial Sequence
  Synthetic
gagaaaggaggaggagcagg

SEQ ID NO: 39215 - RNA, 21 nt, Artificial Sequence
  Synthetic
ggagaaaggaggaggagcagg

SEQ ID NO: 39216 - RNA, 22 nt, Artificial Sequence
  Synthetic
gggagaaaggaggaggagcagg

SEQ ID NO: 39217 - RNA, 23 nt, Artificial Sequence
  Synthetic
ugggagaaaggaggaggagcagg

SEQ ID NO: 39218 - RNA, 24 nt, Artificial Sequence
  Synthetic
cugggagaaaggaggaggagcagg

SEQ ID NO: 39219 - RNA, 18 nt, Artificial Sequence
  Synthetic
aggcgccucgggggcagg

SEQ ID NO: 39220 - RNA, 19 nt, Artificial Sequence
  Synthetic
gaggcgccucgggggcagg

SEQ ID NO: 39221 - RNA, 20 nt, Artificial Sequence
  Synthetic
cgaggcgccucgggggcagg

SEQ ID NO: 39222 - RNA, 21 nt, Artificial Sequence
  Synthetic
ccgaggcgccucgggggcagg

SEQ ID NO: 39223 - RNA, 22 nt, Artificial Sequence
  Synthetic
gccgaggcgccucgggggcagg

SEQ ID NO: 39224 - RNA, 23 nt, Artificial Sequence
  Synthetic
ggccgaggcgccucgggggcagg

SEQ ID NO: 39225 - RNA, 24 nt, Artificial Sequence
  Synthetic
cggccgaggcgccucgggggcagg

SEQ ID NO: 39226 - RNA, 18 nt, Artificial Sequence
  Synthetic
ggaacuuugauagagagg

SEQ ID NO: 39227 - RNA, 19 nt, Artificial Sequence
  Synthetic
gggaacuuugauagagagg

SEQ ID NO: 39228 - RNA, 20 nt, Artificial Sequence
  Synthetic
agggaacuuugauagagagg

SEQ ID NO: 39229 - RNA, 21 nt, Artificial Sequence
  Synthetic
cagggaacuuugauagagagg

SEQ ID NO: 39230 - RNA, 22 nt, Artificial Sequence
  Synthetic
ccagggaacuuugauagagagg

SEQ ID NO: 39231 - RNA, 23 nt, Artificial Sequence
  Synthetic
gccagggaacuuugauagagagg

SEQ ID NO: 39232 - RNA, 24 nt, Artificial Sequence
  Synthetic
ggccagggaacuuugauagagagg

SEQ ID NO: 39233 - RNA, 18 nt, Artificial Sequence
  Synthetic
uggcugggagaaaggagg

SEQ ID NO: 39234 - RNA, 19 nt, Artificial Sequence
  Synthetic
cuggcugggagaaaggagg

SEQ ID NO: 39235 - RNA, 20 nt, Artificial Sequence
  Synthetic
ccuggcugggagaaaggagg

SEQ ID NO: 39236 - RNA, 21 nt, Artificial Sequence
  Synthetic
cccuggcugggagaaaggagg

SEQ ID NO: 39237 - RNA, 22 nt, Artificial Sequence
  Synthetic
acccuggcugggagaaaggagg

SEQ ID NO: 39238 - RNA, 23 nt, Artificial Sequence
  Synthetic
cacccuggcugggagaaaggagg

SEQ ID NO: 39239 - RNA, 24 nt, Artificial Sequence
  Synthetic
ucacccuggcugggagaaaggagg

SEQ ID NO: 39240 - RNA, 18 nt, Artificial Sequence
  Synthetic
cgggugggaggaaggagg

SEQ ID NO: 39241 - RNA, 19 nt, Artificial Sequence
  Synthetic
acgggugggaggaaggagg

SEQ ID NO: 39242 - RNA, 20 nt, Artificial Sequence
  Synthetic
gacgggugggaggaaggagg

SEQ ID NO: 39243 - RNA, 21 nt, Artificial Sequence
  Synthetic
ggacgggugggaggaaggagg

SEQ ID NO: 39244 - RNA, 22 nt, Artificial Sequence
  Synthetic
gggacgggugggaggaaggagg

SEQ ID NO: 39245 - RNA, 23 nt, Artificial Sequence
  Synthetic
ggggacgggugggaggaaggagg

SEQ ID NO: 39246 - RNA, 24 nt, Artificial Sequence
  Synthetic
cggggacgggugggaggaaggagg

SEQ ID NO: 39247 - RNA, 18 nt, Artificial Sequence
  Synthetic
gugggaggaaggaggagg

SEQ ID NO: 39248 - RNA, 19 nt, Artificial Sequence
  Synthetic
ggugggaggaaggaggagg

SEQ ID NO: 39249 - RNA, 20 nt, Artificial Sequence
  Synthetic
gggugggaggaaggaggagg

SEQ ID NO: 39250 - RNA, 21 nt, Artificial Sequence
  Synthetic
cgggugggaggaaggaggagg

SEQ ID NO: 39251 - RNA, 22 nt, Artificial Sequence
  Synthetic
acgggugggaggaaggaggagg

SEQ ID NO: 39252 - RNA, 23 nt, Artificial Sequence
  Synthetic
gacgggugggaggaaggaggagg

SEQ ID NO: 39253 - RNA, 24 nt, Artificial Sequence
  Synthetic
ggacgggugggaggaaggaggagg

SEQ ID NO: 39254 - RNA, 18 nt, Artificial Sequence
  Synthetic
gaagggaggaggaggagg

SEQ ID NO: 39255 - RNA, 19 nt, Artificial Sequence
  Synthetic
ggaagggaggaggaggagg

SEQ ID NO: 39256 - RNA, 20 nt, Artificial Sequence
  Synthetic
gggaagggaggaggaggagg

SEQ ID NO: 39257 - RNA, 21 nt, Artificial Sequence
  Synthetic
ggggaagggaggaggaggagg

SEQ ID NO: 39258 - RNA, 22 nt, Artificial Sequence
  Synthetic
gggggaagggaggaggaggagg

SEQ ID NO: 39259 - RNA, 23 nt, Artificial Sequence
  Synthetic
ggggggaagggaggaggaggagg

SEQ ID NO: 39260 - RNA, 24 nt, Artificial Sequence
  Synthetic
gggggggaagggaggaggaggagg

SEQ ID NO: 39261 - RNA, 18 nt, Artificial Sequence
  Synthetic
ggggaagggaggaggagg

SEQ ID NO: 39262 - RNA, 19 nt, Artificial Sequence
  Synthetic
gggggaagggaggaggagg

SEQ ID NO: 39263 - RNA, 20 nt, Artificial Sequence
  Synthetic
ggggggaagggaggaggagg

SEQ ID NO: 39264 - RNA, 21 nt, Artificial Sequence
  Synthetic
gggggggaagggaggaggagg

SEQ ID NO: 39265 - RNA, 22 nt, Artificial Sequence
  Synthetic
ugggggggaagggaggaggagg

SEQ ID NO: 39266 - RNA, 23 nt, Artificial Sequence
  Synthetic
augggggggaagggaggaggagg

SEQ ID NO: 39267 - RNA, 24 nt, Artificial Sequence
  Synthetic
gaugggggggaagggaggaggagg

SEQ ID NO: 39268 - RNA, 18 nt, Artificial Sequence
  Synthetic
gggggggaagggaggagg

SEQ ID NO: 39269 - RNA, 19 nt, Artificial Sequence
  Synthetic
ugggggggaagggaggagg

SEQ ID NO: 39270 - RNA, 20 nt, Artificial Sequence
  Synthetic
augggggggaagggaggagg

SEQ ID NO: 39271 - RNA, 21 nt, Artificial Sequence
  Synthetic
gaugggggggaagggaggagg

SEQ ID NO: 39272 - RNA, 22 nt, Artificial Sequence
  Synthetic
ggaugggggggaagggaggagg

SEQ ID NO: 39273 - RNA, 23 nt, Artificial Sequence
  Synthetic
gggaugggggggaagggaggagg

SEQ ID NO: 39274 - RNA, 24 nt, Artificial Sequence
  Synthetic
ggggaugggggggaagggaggagg

SEQ ID NO: 39275 - RNA, 18 nt, Artificial Sequence
  Synthetic
gcucggggagggaggagg

SEQ ID NO: 39276 - RNA, 19 nt, Artificial Sequence
  Synthetic
ggcucggggagggaggagg

SEQ ID NO: 39277 - RNA, 20 nt, Artificial Sequence
  Synthetic
uggcucggggagggaggagg

SEQ ID NO: 39278 - RNA, 21 nt, Artificial Sequence
  Synthetic
cuggcucggggagggaggagg

SEQ ID NO: 39279 - RNA, 22 nt, Artificial Sequence
  Synthetic
ccuggcucggggagggaggagg

SEQ ID NO: 39280 - RNA, 23 nt, Artificial Sequence
  Synthetic
gccuggcucggggagggaggagg

SEQ ID NO: 39281 - RNA, 24 nt, Artificial Sequence
  Synthetic
cgccuggcucggggagggaggagg

SEQ ID NO: 39282 - RNA, 18 nt, Artificial Sequence
  Synthetic
gaugggggggaagggagg

SEQ ID NO: 39283 - RNA, 19 nt, Artificial Sequence
  Synthetic
ggaugggggggaagggagg

SEQ ID NO: 39284 - RNA, 20 nt, Artificial Sequence
  Synthetic
gggaugggggggaagggagg

SEQ ID NO: 39285 - RNA, 21 nt, Artificial Sequence
  Synthetic
ggggaugggggggaagggagg

SEQ ID NO: 39286 - RNA, 22 nt, Artificial Sequence
  Synthetic
cggggaugggggggaagggagg

SEQ ID NO: 39287 - RNA, 23 nt, Artificial Sequence
  Synthetic
ccggggaugggggggaagggagg

SEQ ID NO: 39288 - RNA, 24 nt, Artificial Sequence
  Synthetic
gccggggaugggggggaagggagg

SEQ ID NO: 39289 - RNA, 18 nt, Artificial Sequence
  Synthetic
cuggcucggggagggagg

SEQ ID NO: 39290 - RNA, 19 nt, Artificial Sequence
  Synthetic
ccuggcucggggagggagg

SEQ ID NO: 39291 - RNA, 20 nt, Artificial Sequence
  Synthetic
gccuggcucggggagggagg

SEQ ID NO: 39292 - RNA, 21 nt, Artificial Sequence
  Synthetic
cgccuggcucggggagggagg

SEQ ID NO: 39293 - RNA, 22 nt, Artificial Sequence
  Synthetic
gcgccuggcucggggagggagg

SEQ ID NO: 39294 - RNA, 23 nt, Artificial Sequence
  Synthetic
ggcgccuggcucggggagggagg

SEQ ID NO: 39295 - RNA, 24 nt, Artificial Sequence
  Synthetic
gggcgccuggcucggggagggagg

SEQ ID NO: 39296 - RNA, 18 nt, Artificial Sequence
  Synthetic
gcgccuggcucggggagg

SEQ ID NO: 39297 - RNA, 19 nt, Artificial Sequence
  Synthetic
ggcgccuggcucggggagg

SEQ ID NO: 39298 - RNA, 20 nt, Artificial Sequence
  Synthetic
gggcgccuggcucggggagg

SEQ ID NO: 39299 - RNA, 21 nt, Artificial Sequence
  Synthetic
agggcgccuggcucggggagg

SEQ ID NO: 39300 - RNA, 22 nt, Artificial Sequence
  Synthetic
gagggcgccuggcucggggagg

SEQ ID NO: 39301 - RNA, 23 nt, Artificial Sequence
  Synthetic
ggagggcgccuggcucggggagg

SEQ ID NO: 39302 - RNA, 24 nt, Artificial Sequence
  Synthetic
gggagggcgccuggcucggggagg

SEQ ID NO: 39303 - RNA, 18 nt, Artificial Sequence
  Synthetic
cucgggggcagggggagg

SEQ ID NO: 39304 - RNA, 19 nt, Artificial Sequence
  Synthetic
ccucgggggcagggggagg

SEQ ID NO: 39305 - RNA, 20 nt, Artificial Sequence
  Synthetic
gccucgggggcagggggagg

SEQ ID NO: 39306 - RNA, 21 nt, Artificial Sequence
  Synthetic
cgccucgggggcagggggagg

SEQ ID NO: 39307 - RNA, 22 nt, Artificial Sequence
  Synthetic
gcgccucgggggcagggggagg

SEQ ID NO: 39308 - RNA, 23 nt, Artificial Sequence
  Synthetic
ggcgccucgggggcagggggagg

SEQ ID NO: 39309 - RNA, 24 nt, Artificial Sequence
  Synthetic
aggcgccucgggggcagggggagg

SEQ ID NO: 39310 - RNA, 18 nt, Artificial Sequence
  Synthetic
ccggggacgggugggagg

SEQ ID NO: 39311 - RNA, 19 nt, Artificial Sequence
  Synthetic
cccggggacgggugggagg

SEQ ID NO: 39312 - RNA, 20 nt, Artificial Sequence
  Synthetic
ccccggggacgggugggagg

SEQ ID NO: 39313 - RNA, 21 nt, Artificial Sequence
  Synthetic
cccccggggacgggugggagg

SEQ ID NO: 39314 - RNA, 22 nt, Artificial Sequence
  Synthetic
gcccccggggacgggugggagg

SEQ ID NO: 39315 - RNA, 23 nt, Artificial Sequence
  Synthetic
ugcccccggggacgggugggagg

SEQ ID NO: 39316 - RNA, 24 nt, Artificial Sequence
  Synthetic
cugcccccggggacgggugggagg

SEQ ID NO: 39317 - RNA, 18 nt, Artificial Sequence
  Synthetic
cgggccacggggaguagg

SEQ ID NO: 39318 - RNA, 19 nt, Artificial Sequence
  Synthetic
gcgggccacggggaguagg

SEQ ID NO: 39319 - RNA, 20 nt, Artificial Sequence
  Synthetic
cgcgggccacggggaguagg

SEQ ID NO: 39320 - RNA, 21 nt, Artificial Sequence
  Synthetic
ccgcgggccacggggaguagg

SEQ ID NO: 39321 - RNA, 22 nt, Artificial Sequence
  Synthetic
cccgcgggccacggggaguagg

SEQ ID NO: 39322 - RNA, 23 nt, Artificial Sequence
  Synthetic
ccccgcgggccacggggaguagg

SEQ ID NO: 39323 - RNA, 24 nt, Artificial Sequence
  Synthetic
cccccgcgggccacggggaguagg

SEQ ID NO: 39324 - RNA, 18 nt, Artificial Sequence
  Synthetic
cucugcccccggggacgg

SEQ ID NO: 39325 - RNA, 19 nt, Artificial Sequence
  Synthetic
ccucugcccccggggacgg

SEQ ID NO: 39326 - RNA, 20 nt, Artificial Sequence
  Synthetic
cccucugcccccggggacgg

SEQ ID NO: 39327 - RNA, 21 nt, Artificial Sequence
  Synthetic
gcccucugcccccggggacgg

SEQ ID NO: 39328 - RNA, 22 nt, Artificial Sequence
  Synthetic
cgcccucugcccccggggacgg

SEQ ID NO: 39329 - RNA, 23 nt, Artificial Sequence
  Synthetic
acgcccucugcccccggggacgg

SEQ ID NO: 39330 - RNA, 24 nt, Artificial Sequence
  Synthetic
cacgcccucugcccccggggacgg

SEQ ID NO: 39331 - RNA, 18 nt, Artificial Sequence
  Synthetic
cccccaccggaccaccgg

SEQ ID NO: 39332 - RNA, 19 nt, Artificial Sequence
  Synthetic
ccccccaccggaccaccgg

SEQ ID NO: 39333 - RNA, 20 nt, Artificial Sequence
  Synthetic
gccccccaccggaccaccgg

SEQ ID NO: 39334 - RNA, 21 nt, Artificial Sequence
  Synthetic
cgccccccaccggaccaccgg

SEQ ID NO: 39335 - RNA, 22 nt, Artificial Sequence
  Synthetic
ccgccccccaccggaccaccgg

SEQ ID NO: 39336 - RNA, 23 nt, Artificial Sequence
  Synthetic
gccgccccccaccggaccaccgg

SEQ ID NO: 39337 - RNA, 24 nt, Artificial Sequence
  Synthetic
agccgccccccaccggaccaccgg

SEQ ID NO: 39338 - RNA, 18 nt, Artificial Sequence
  Synthetic
ccgccucuuccucugcgg

SEQ ID NO: 39339 - RNA, 19 nt, Artificial Sequence
  Synthetic
uccgccucuuccucugcgg

SEQ ID NO: 39340 - RNA, 20 nt, Artificial Sequence
  Synthetic
cuccgccucuuccucugcgg

SEQ ID NO: 39341 - RNA, 21 nt, Artificial Sequence
  Synthetic
ccuccgccucuuccucugcgg

SEQ ID NO: 39342 - RNA, 22 nt, Artificial Sequence
  Synthetic
uccuccgccucuuccucugcgg

SEQ ID NO: 39343 - RNA, 23 nt, Artificial Sequence
  Synthetic
cuccuccgccucuuccucugcgg

SEQ ID NO: 39344 - RNA, 24 nt, Artificial Sequence
  Synthetic
ccuccuccgccucuuccucugcgg

SEQ ID NO: 39345 - RNA, 18 nt, Artificial Sequence
  Synthetic
ggggaugggggggaaggg

SEQ ID NO: 39346 - RNA, 19 nt, Artificial Sequence
  Synthetic
cggggaugggggggaaggg

SEQ ID NO: 39347 - RNA, 20 nt, Artificial Sequence
  Synthetic
ccggggaugggggggaaggg

SEQ ID NO: 39348 - RNA, 21 nt, Artificial Sequence
  Synthetic
gccggggaugggggggaaggg

SEQ ID NO: 39349 - RNA, 22 nt, Artificial Sequence
  Synthetic
ggccggggaugggggggaaggg

SEQ ID NO: 39350 - RNA, 23 nt, Artificial Sequence
  Synthetic
gggccggggaugggggggaaggg

SEQ ID NO: 39351 - RNA, 24 nt, Artificial Sequence
  Synthetic
ggggccggggaugggggggaaggg

SEQ ID NO: 39352 - RNA, 18 nt, Artificial Sequence
  Synthetic
guguccguguugacaggg

SEQ ID NO: 39353 - RNA, 19 nt, Artificial Sequence
  Synthetic
uguguccguguugacaggg

SEQ ID NO: 39354 - RNA, 20 nt, Artificial Sequence
  Synthetic
guguguccguguugacaggg

SEQ ID NO: 39355 - RNA, 21 nt, Artificial Sequence
  Synthetic
aguguguccguguugacaggg

SEQ ID NO: 39356 - RNA, 22 nt, Artificial Sequence
  Synthetic
gaguguguccguguugacaggg

SEQ ID NO: 39357 - RNA, 23 nt, Artificial Sequence
  Synthetic
agaguguguccguguugacaggg

SEQ ID NO: 39358 - RNA, 24 nt, Artificial Sequence
  Synthetic
aagaguguguccguguugacaggg

SEQ ID NO: 39359 - RNA, 18 nt, Artificial Sequence
  Synthetic
gaacuuugauagagaggg

SEQ ID NO: 39360 - RNA, 19 nt, Artificial Sequence
  Synthetic
ggaacuuugauagagaggg

SEQ ID NO: 39361 - RNA, 20 nt, Artificial Sequence
  Synthetic
gggaacuuugauagagaggg

SEQ ID NO: 39362 - RNA, 21 nt, Artificial Sequence
  Synthetic
agggaacuuugauagagaggg

SEQ ID NO: 39363 - RNA, 22 nt, Artificial Sequence
  Synthetic
cagggaacuuugauagagaggg

SEQ ID NO: 39364 - RNA, 23 nt, Artificial Sequence
  Synthetic
ccagggaacuuugauagagaggg

SEQ ID NO: 39365 - RNA, 24 nt, Artificial Sequence
  Synthetic
gccagggaacuuugauagagaggg

SEQ ID NO: 39366 - RNA, 18 nt, Artificial Sequence
  Synthetic
cucggggagggaggaggg

SEQ ID NO: 39367 - RNA, 19 nt, Artificial Sequence
  Synthetic
gcucggggagggaggaggg

SEQ ID NO: 39368 - RNA, 20 nt, Artificial Sequence
  Synthetic
ggcucggggagggaggaggg

SEQ ID NO: 39369 - RNA, 21 nt, Artificial Sequence
  Synthetic
uggcucggggagggaggaggg

SEQ ID NO: 39370 - RNA, 22 nt, Artificial Sequence
  Synthetic
cuggcucggggagggaggaggg

SEQ ID NO: 39371 - RNA, 23 nt, Artificial Sequence
  Synthetic
ccuggcucggggagggaggaggg

SEQ ID NO: 39372 - RNA, 24 nt, Artificial Sequence
  Synthetic
gccuggcucggggagggaggaggg

SEQ ID NO: 39373 - RNA, 18 nt, Artificial Sequence
  Synthetic
cgccuggcucggggaggg

SEQ ID NO: 39374 - RNA, 19 nt, Artificial Sequence
  Synthetic
gcgccuggcucggggaggg

SEQ ID NO: 39375 - RNA, 20 nt, Artificial Sequence
  Synthetic
ggcgccuggcucggggaggg

SEQ ID NO: 39376 - RNA, 21 nt, Artificial Sequence
  Synthetic
gggcgccuggcucggggaggg

SEQ ID NO: 39377 - RNA, 22 nt, Artificial Sequence
  Synthetic
agggcgccuggcucggggaggg

SEQ ID NO: 39378 - RNA, 23 nt, Artificial Sequence
  Synthetic
gagggcgccuggcucggggaggg

SEQ ID NO: 39379 - RNA, 24 nt, Artificial Sequence
  Synthetic
ggagggcgccuggcucggggaggg

SEQ ID NO: 39380 - RNA, 18 nt, Artificial Sequence
  Synthetic
gggggggggaaagacggg

SEQ ID NO: 39381 - RNA, 19 nt, Artificial Sequence
  Synthetic
ggggggggggaaagacggg

SEQ ID NO: 39382 - RNA, 20 nt, Artificial Sequence
  Synthetic
uggggggggggaaagacggg

SEQ ID NO: 39383 - RNA, 21 nt, Artificial Sequence
  Synthetic
guggggggggggaaagacggg

SEQ ID NO: 39384 - RNA, 22 nt, Artificial Sequence
  Synthetic
gguggggggggggaaagacggg

SEQ ID NO: 39385 - RNA, 23 nt, Artificial Sequence
  Synthetic
agguggggggggggaaagacggg

SEQ ID NO: 39386 - RNA, 24 nt, Artificial Sequence
  Synthetic
gagguggggggggggaaagacggg

SEQ ID NO: 39387 - RNA, 18 nt, Artificial Sequence
  Synthetic
ucugcccccggggacggg

SEQ ID NO: 39388 - RNA, 19 nt, Artificial Sequence
  Synthetic
cucugcccccggggacggg

SEQ ID NO: 39389 - RNA, 20 nt, Artificial Sequence
  Synthetic
ccucugcccccggggacggg

SEQ ID NO: 39390 - RNA, 21 nt, Artificial Sequence
  Synthetic
cccucugcccccggggacggg

SEQ ID NO: 39391 - RNA, 22 nt, Artificial Sequence
  Synthetic
gcccucugcccccggggacggg

SEQ ID NO: 39392 - RNA, 23 nt, Artificial Sequence
  Synthetic
cgcccucugcccccggggacggg

SEQ ID NO: 39393 - RNA, 24 nt, Artificial Sequence
  Synthetic
acgcccucugcccccggggacggg

SEQ ID NO: 39394 - RNA, 18 nt, Artificial Sequence
  Synthetic
cgccucuuccucugcggg

SEQ ID NO: 39395 - RNA, 19 nt, Artificial Sequence
  Synthetic
ccgccucuuccucugcggg

SEQ ID NO: 39396 - RNA, 20 nt, Artificial Sequence
  Synthetic
uccgccucuuccucugcggg

SEQ ID NO: 39397 - RNA, 21 nt, Artificial Sequence
  Synthetic
cuccgccucuuccucugcggg

SEQ ID NO: 39398 - RNA, 22 nt, Artificial Sequence
  Synthetic
ccuccgccucuuccucugcggg

SEQ ID NO: 39399 - RNA, 23 nt, Artificial Sequence
  Synthetic
uccuccgccucuuccucugcggg

SEQ ID NO: 39400 - RNA, 24 nt, Artificial Sequence
  Synthetic
cuccuccgccucuuccucugcggg

SEQ ID NO: 39401 - RNA, 18 nt, Artificial Sequence
  Synthetic
ggggagacucccaucggg

SEQ ID NO: 39402 - RNA, 19 nt, Artificial Sequence
  Synthetic
cggggagacucccaucggg

SEQ ID NO: 39403 - RNA, 20 nt, Artificial Sequence
  Synthetic
gcggggagacucccaucggg

SEQ ID NO: 39404 - RNA, 21 nt, Artificial Sequence
  Synthetic
ugcggggagacucccaucggg

SEQ ID NO: 39405 - RNA, 22 nt, Artificial Sequence
  Synthetic
cugcggggagacucccaucggg

SEQ ID NO: 39406 - RNA, 23 nt, Artificial Sequence
  Synthetic
gcugcggggagacucccaucggg

SEQ ID NO: 39407 - RNA, 24 nt, Artificial Sequence
  Synthetic
ggcugcggggagacucccaucggg

SEQ ID NO: 39408 - RNA, 18 nt, Artificial Sequence
  Synthetic
gagggcgccuggcucggg

SEQ ID NO: 39409 - RNA, 19 nt, Artificial Sequence
  Synthetic
ggagggcgccuggcucggg

SEQ ID NO: 39410 - RNA, 20 nt, Artificial Sequence
  Synthetic
gggagggcgccuggcucggg

SEQ ID NO: 39411 - RNA, 21 nt, Artificial Sequence
  Synthetic
ugggagggcgccuggcucggg

SEQ ID NO: 39412 - RNA, 22 nt, Artificial Sequence
  Synthetic
gugggagggcgccuggcucggg

SEQ ID NO: 39413 - RNA, 23 nt, Artificial Sequence
  Synthetic
agugggagggcgccuggcucggg

SEQ ID NO: 39414 - RNA, 24 nt, Artificial Sequence
  Synthetic
gagugggagggcgccuggcucggg

SEQ ID NO: 39415 - RNA, 18 nt, Artificial Sequence
  Synthetic
ggggggggaaagacgggg

SEQ ID NO: 39416 - RNA, 19 nt, Artificial Sequence
  Synthetic
gggggggggaaagacgggg

SEQ ID NO: 39417 - RNA, 20 nt, Artificial Sequence
  Synthetic
ggggggggggaaagacgggg

SEQ ID NO: 39418 - RNA, 21 nt, Artificial Sequence
  Synthetic
uggggggggggaaagacgggg

SEQ ID NO: 39419 - RNA, 22 nt, Artificial Sequence
  Synthetic
guggggggggggaaagacgggg

SEQ ID NO: 39420 - RNA, 23 nt, Artificial Sequence
  Synthetic
gguggggggggggaaagacgggg

SEQ ID NO: 39421 - RNA, 24 nt, Artificial Sequence
  Synthetic
agguggggggggggaaagacgggg

SEQ ID NO: 39422 - RNA, 18 nt, Artificial Sequence
  Synthetic
cgcgcaggggggccgggg

SEQ ID NO: 39423 - RNA, 19 nt, Artificial Sequence
  Synthetic
ccgcgcaggggggccgggg

SEQ ID NO: 39424 - RNA, 20 nt, Artificial Sequence
  Synthetic
cccgcgcaggggggccgggg

SEQ ID NO: 39425 - RNA, 21 nt, Artificial Sequence
  Synthetic
ccccgcgcaggggggccgggg

SEQ ID NO: 39426 - RNA, 22 nt, Artificial Sequence
  Synthetic
cccccgcgcaggggggccgggg

SEQ ID NO: 39427 - RNA, 23 nt, Artificial Sequence
  Synthetic
ucccccgcgcaggggggccgggg

SEQ ID NO: 39428 - RNA, 24 nt, Artificial Sequence
  Synthetic
cucccccgcgcaggggggccgggg

SEQ ID NO: 39429 - RNA, 18 nt, Artificial Sequence
  Synthetic
ggggaaaguggggcgggg

SEQ ID NO: 39430 - RNA, 19 nt, Artificial Sequence
  Synthetic
gggggaaaguggggcgggg

SEQ ID NO: 39431 - RNA, 20 nt, Artificial Sequence
  Synthetic
ggggggaaaguggggcgggg

SEQ ID NO: 39432 - RNA, 21 nt, Artificial Sequence
  Synthetic
aggggggaaaguggggcgggg

SEQ ID NO: 39433 - RNA, 22 nt, Artificial Sequence
  Synthetic
gaggggggaaaguggggcgggg

SEQ ID NO: 39434 - RNA, 23 nt, Artificial Sequence
  Synthetic
agaggggggaaaguggggcgggg

SEQ ID NO: 39435 - RNA, 24 nt, Artificial Sequence
  Synthetic
gagaggggggaaaguggggcgggg

SEQ ID NO: 39436 - RNA, 18 nt, Artificial Sequence
  Synthetic
agggcgccuggcucgggg

SEQ ID NO: 39437 - RNA, 19 nt, Artificial Sequence
  Synthetic
gagggcgccuggcucgggg

SEQ ID NO: 39438 - RNA, 20 nt, Artificial Sequence
  Synthetic
ggagggcgccuggcucgggg

SEQ ID NO: 39439 - RNA, 21 nt, Artificial Sequence
  Synthetic
gggagggcgccuggcucgggg

SEQ ID NO: 39440 - RNA, 22 nt, Artificial Sequence
  Synthetic
ugggagggcgccuggcucgggg

SEQ ID NO: 39441 - RNA, 23 nt, Artificial Sequence
  Synthetic
gugggagggcgccuggcucgggg

SEQ ID NO: 39442 - RNA, 24 nt, Artificial Sequence
  Synthetic
agugggagggcgccuggcucgggg

SEQ ID NO: 39443 - RNA, 18 nt, Artificial Sequence
  Synthetic
gcugcugcgccgcggggg

SEQ ID NO: 39444 - RNA, 19 nt, Artificial Sequence
  Synthetic
cgcugcugcgccgcggggg

SEQ ID NO: 39445 - RNA, 20 nt, Artificial Sequence
  Synthetic
gcgcugcugcgccgcggggg

SEQ ID NO: 39446 - RNA, 21 nt, Artificial Sequence
  Synthetic
cgcgcugcugcgccgcggggg

SEQ ID NO: 39447 - RNA, 22 nt, Artificial Sequence
  Synthetic
ccgcgcugcugcgccgcggggg

SEQ ID NO: 39448 - RNA, 23 nt, Artificial Sequence
  Synthetic
cccgcgcugcugcgccgcggggg

SEQ ID NO: 39449 - RNA, 24 nt, Artificial Sequence
  Synthetic
ccccgcgcugcugcgccgcggggg

SEQ ID NO: 39450 - RNA, 18 nt, Artificial Sequence
  Synthetic
gccgaggcgccucggggg

SEQ ID NO: 39451 - RNA, 19 nt, Artificial Sequence
  Synthetic
ggccgaggcgccucggggg

SEQ ID NO: 39452 - RNA, 20 nt, Artificial Sequence
  Synthetic
cggccgaggcgccucggggg

SEQ ID NO: 39453 - RNA, 21 nt, Artificial Sequence
  Synthetic
ccggccgaggcgccucggggg

SEQ ID NO: 39454 - RNA, 22 nt, Artificial Sequence
  Synthetic
accggccgaggcgccucggggg

SEQ ID NO: 39455 - RNA, 23 nt, Artificial Sequence
  Synthetic
caccggccgaggcgccucggggg

SEQ ID NO: 39456 - RNA, 24 nt, Artificial Sequence
  Synthetic
ccaccggccgaggcgccucggggg

SEQ ID NO: 39457 - RNA, 18 nt, Artificial Sequence
  Synthetic
cucccccgcgcagggggg

SEQ ID NO: 39458 - RNA, 19 nt, Artificial Sequence
  Synthetic
gcucccccgcgcagggggg

SEQ ID NO: 39459 - RNA, 20 nt, Artificial Sequence
  Synthetic
agcucccccgcgcagggggg

SEQ ID NO: 39460 - RNA, 21 nt, Artificial Sequence
  Synthetic
cagcucccccgcgcagggggg

SEQ ID NO: 39461 - RNA, 22 nt, Artificial Sequence
  Synthetic
gcagcucccccgcgcagggggg

SEQ ID NO: 39462 - RNA, 23 nt, Artificial Sequence
  Synthetic
ugcagcucccccgcgcagggggg

SEQ ID NO: 39463 - RNA, 24 nt, Artificial Sequence
  Synthetic
augcagcucccccgcgcagggggg

SEQ ID NO: 39464 - RNA, 18 nt, Artificial Sequence
  Synthetic
ggaggaggaggagggggg

SEQ ID NO: 39465 - RNA, 19 nt, Artificial Sequence
  Synthetic
gggaggaggaggagggggg

SEQ ID NO: 39466 - RNA, 20 nt, Artificial Sequence
  Synthetic
agggaggaggaggagggggg

SEQ ID NO: 39467 - RNA, 21 nt, Artificial Sequence
  Synthetic
aagggaggaggaggagggggg

SEQ ID NO: 39468 - RNA, 22 nt, Artificial Sequence
  Synthetic
gaagggaggaggaggagggggg

SEQ ID NO: 39469 - RNA, 23 nt, Artificial Sequence
  Synthetic
ggaagggaggaggaggagggggg

SEQ ID NO: 39470 - RNA, 24 nt, Artificial Sequence
  Synthetic
gggaagggaggaggaggagggggg

SEQ ID NO: 39471 - RNA, 18 nt, Artificial Sequence
  Synthetic
ugggaguggggggggggg

SEQ ID NO: 39472 - RNA, 19 nt, Artificial Sequence
  Synthetic
gugggaguggggggggggg

SEQ ID NO: 39473 - RNA, 20 nt, Artificial Sequence
  Synthetic
ggugggaguggggggggggg

SEQ ID NO: 39474 - RNA, 21 nt, Artificial Sequence
  Synthetic
gggugggaguggggggggggg

SEQ ID NO: 39475 - RNA, 22 nt, Artificial Sequence
  Synthetic
ggggugggaguggggggggggg

SEQ ID NO: 39476 - RNA, 23 nt, Artificial Sequence
  Synthetic
gggggugggaguggggggggggg

SEQ ID NO: 39477 - RNA, 24 nt, Artificial Sequence
  Synthetic
ugggggugggaguggggggggggg

SEQ ID NO: 39478 - RNA, 18 nt, Artificial Sequence
  Synthetic
gggccggggauggggggg

SEQ ID NO: 39479 - RNA, 19 nt, Artificial Sequence
  Synthetic
ggggccggggauggggggg

SEQ ID NO: 39480 - RNA, 20 nt, Artificial Sequence
  Synthetic
gggggccggggauggggggg

SEQ ID NO: 39481 - RNA, 21 nt, Artificial Sequence
  Synthetic
ggggggccggggauggggggg

SEQ ID NO: 39482 - RNA, 22 nt, Artificial Sequence
  Synthetic
aggggggccggggauggggggg

SEQ ID NO: 39483 - RNA, 23 nt, Artificial Sequence
  Synthetic
caggggggccggggauggggggg

SEQ ID NO: 39484 - RNA, 24 nt, Artificial Sequence
  Synthetic
gcaggggggccggggauggggggg

SEQ ID NO: 39485 - RNA, 18 nt, Artificial Sequence
  Synthetic
ggggugggaguggggggg

SEQ ID NO: 39486 - RNA, 19 nt, Artificial Sequence
  Synthetic
gggggugggaguggggggg

SEQ ID NO: 39487 - RNA, 20 nt, Artificial Sequence
  Synthetic
ugggggugggaguggggggg

SEQ ID NO: 39488 - RNA, 21 nt, Artificial Sequence
  Synthetic
gugggggugggaguggggggg

SEQ ID NO: 39489 - RNA, 22 nt, Artificial Sequence
  Synthetic
agugggggugggaguggggggg

SEQ ID NO: 39490 - RNA, 23 nt, Artificial Sequence
  Synthetic
aagugggggugggaguggggggg

SEQ ID NO: 39491 - RNA, 24 nt, Artificial Sequence
  Synthetic
gaagugggggugggaguggggggg

SEQ ID NO: 39492 - RNA, 18 nt, Artificial Sequence
  Synthetic
cagggggagguggggggg

SEQ ID NO: 39493 - RNA, 19 nt, Artificial Sequence
  Synthetic
gcagggggagguggggggg

SEQ ID NO: 39494 - RNA, 20 nt, Artificial Sequence
  Synthetic
ggcagggggagguggggggg

SEQ ID NO: 39495 - RNA, 21 nt, Artificial Sequence
  Synthetic
gggcagggggagguggggggg

SEQ ID NO: 39496 - RNA, 22 nt, Artificial Sequence
  Synthetic
ggggcagggggagguggggggg

SEQ ID NO: 39497 - RNA, 23 nt, Artificial Sequence
  Synthetic
gggggcagggggagguggggggg

SEQ ID NO: 39498 - RNA, 24 nt, Artificial Sequence
  Synthetic
cgggggcagggggagguggggggg

SEQ ID NO: 39499 - RNA, 18 nt, Artificial Sequence
  Synthetic
gggggugggagugggggg

SEQ ID NO: 39500 - RNA, 19 nt, Artificial Sequence
  Synthetic
ugggggugggagugggggg

SEQ ID NO: 39501 - RNA, 20 nt, Artificial Sequence
  Synthetic
gugggggugggagugggggg

SEQ ID NO: 39502 - RNA, 21 nt, Artificial Sequence
  Synthetic
agugggggugggagugggggg

SEQ ID NO: 39503 - RNA, 22 nt, Artificial Sequence
  Synthetic
aagugggggugggagugggggg

SEQ ID NO: 39504 - RNA, 23 nt, Artificial Sequence
  Synthetic
gaagugggggugggagugggggg

SEQ ID NO: 39505 - RNA, 24 nt, Artificial Sequence
  Synthetic
ggaagugggggugggagugggggg

SEQ ID NO: 39506 - RNA, 18 nt, Artificial Sequence
  Synthetic
gcagggggaggugggggg

SEQ ID NO: 39507 - RNA, 19 nt, Artificial Sequence
  Synthetic
ggcagggggaggugggggg

SEQ ID NO: 39508 - RNA, 20 nt, Artificial Sequence
  Synthetic
gggcagggggaggugggggg

SEQ ID NO: 39509 - RNA, 21 nt, Artificial Sequence
  Synthetic
ggggcagggggaggugggggg

SEQ ID NO: 39510 - RNA, 22 nt, Artificial Sequence
  Synthetic
gggggcagggggaggugggggg

SEQ ID NO: 39511 - RNA, 23 nt, Artificial Sequence
  Synthetic
cgggggcagggggaggugggggg

SEQ ID NO: 39512 - RNA, 24 nt, Artificial Sequence
  Synthetic
ucgggggcagggggaggugggggg

SEQ ID NO: 39513 - RNA, 18 nt, Artificial Sequence
  Synthetic
ggagacaggaaguggggg

SEQ ID NO: 39514 - RNA, 19 nt, Artificial Sequence
  Synthetic
aggagacaggaaguggggg

SEQ ID NO: 39515 - RNA, 20 nt, Artificial Sequence
  Synthetic
gaggagacaggaaguggggg

SEQ ID NO: 39516 - RNA, 21 nt, Artificial Sequence
  Synthetic
ggaggagacaggaaguggggg

SEQ ID NO: 39517 - RNA, 22 nt, Artificial Sequence
  Synthetic
gggaggagacaggaaguggggg

SEQ ID NO: 39518 - RNA, 23 nt, Artificial Sequence
  Synthetic
ggggaggagacaggaaguggggg

SEQ ID NO: 39519 - RNA, 24 nt, Artificial Sequence
  Synthetic
cggggaggagacaggaaguggggg

SEQ ID NO: 39520 - RNA, 18 nt, Artificial Sequence
  Synthetic
ugggggugggaguggggg

SEQ ID NO: 39521 - RNA, 19 nt, Artificial Sequence
  Synthetic
gugggggugggaguggggg

SEQ ID NO: 39522 - RNA, 20 nt, Artificial Sequence
  Synthetic
agugggggugggaguggggg

SEQ ID NO: 39523 - RNA, 21 nt, Artificial Sequence
  Synthetic
aagugggggugggaguggggg

SEQ ID NO: 39524 - RNA, 22 nt, Artificial Sequence
  Synthetic
gaagugggggugggaguggggg

SEQ ID NO: 39525 - RNA, 23 nt, Artificial Sequence
  Synthetic
ggaagugggggugggaguggggg

SEQ ID NO: 39526 - RNA, 24 nt, Artificial Sequence
  Synthetic
aggaagugggggugggaguggggg

SEQ ID NO: 39527 - RNA, 18 nt, Artificial Sequence
  Synthetic
ggcagggggagguggggg

SEQ ID NO: 39528 - RNA, 19 nt, Artificial Sequence
  Synthetic
gggcagggggagguggggg

SEQ ID NO: 39529 - RNA, 20 nt, Artificial Sequence
  Synthetic
ggggcagggggagguggggg

SEQ ID NO: 39530 - RNA, 21 nt, Artificial Sequence
  Synthetic
gggggcagggggagguggggg

SEQ ID NO: 39531 - RNA, 22 nt, Artificial Sequence
  Synthetic
cgggggcagggggagguggggg

SEQ ID NO: 39532 - RNA, 23 nt, Artificial Sequence
  Synthetic
ucgggggcagggggagguggggg

SEQ ID NO: 39533 - RNA, 24 nt, Artificial Sequence
  Synthetic
cucgggggcagggggagguggggg

SEQ ID NO: 39534 - RNA, 18 nt, Artificial Sequence
  Synthetic
ggggggccggggaugggg

SEQ ID NO: 39535 - RNA, 19 nt, Artificial Sequence
  Synthetic
aggggggccggggaugggg

SEQ ID NO: 39536 - RNA, 20 nt, Artificial Sequence
  Synthetic
caggggggccggggaugggg

SEQ ID NO: 39537 - RNA, 21 nt, Artificial Sequence
  Synthetic
gcaggggggccggggaugggg

SEQ ID NO: 39538 - RNA, 22 nt, Artificial Sequence
  Synthetic
cgcaggggggccggggaugggg

SEQ ID NO: 39539 - RNA, 23 nt, Artificial Sequence
  Synthetic
gcgcaggggggccggggaugggg

SEQ ID NO: 39540 - RNA, 24 nt, Artificial Sequence
  Synthetic
cgcgcaggggggccggggaugggg

SEQ ID NO: 39541 - RNA, 18 nt, Artificial Sequence
  Synthetic
agaggggggaaagugggg

SEQ ID NO: 39542 - RNA, 19 nt, Artificial Sequence
  Synthetic
gagaggggggaaagugggg

SEQ ID NO: 39543 - RNA, 20 nt, Artificial Sequence
  Synthetic
agagaggggggaaagugggg

SEQ ID NO: 39544 - RNA, 21 nt, Artificial Sequence
  Synthetic
uagagaggggggaaagugggg

SEQ ID NO: 39545 - RNA, 22 nt, Artificial Sequence
  Synthetic
auagagaggggggaaagugggg

SEQ ID NO: 39546 - RNA, 23 nt, Artificial Sequence
  Synthetic
gauagagaggggggaaagugggg

SEQ ID NO: 39547 - RNA, 24 nt, Artificial Sequence
  Synthetic
ugauagagaggggggaaagugggg

SEQ ID NO: 39548 - RNA, 18 nt, Artificial Sequence
  Synthetic
aggagacaggaagugggg

SEQ ID NO: 39549 - RNA, 19 nt, Artificial Sequence
  Synthetic
gaggagacaggaagugggg

SEQ ID NO: 39550 - RNA, 20 nt, Artificial Sequence
  Synthetic
ggaggagacaggaagugggg

SEQ ID NO: 39551 - RNA, 21 nt, Artificial Sequence
  Synthetic
gggaggagacaggaagugggg

SEQ ID NO: 39552 - RNA, 22 nt, Artificial Sequence
  Synthetic
ggggaggagacaggaagugggg

SEQ ID NO: 39553 - RNA, 23 nt, Artificial Sequence
  Synthetic
cggggaggagacaggaagugggg

SEQ ID NO: 39554 - RNA, 24 nt, Artificial Sequence
  Synthetic
acggggaggagacaggaagugggg

SEQ ID NO: 39555 - RNA, 18 nt, Artificial Sequence
  Synthetic
gugggggugggagugggg

SEQ ID NO: 39556 - RNA, 19 nt, Artificial Sequence
  Synthetic
agugggggugggagugggg

SEQ ID NO: 39557 - RNA, 20 nt, Artificial Sequence
  Synthetic
aagugggggugggagugggg

SEQ ID NO: 39558 - RNA, 21 nt, Artificial Sequence
  Synthetic
gaagugggggugggagugggg

SEQ ID NO: 39559 - RNA, 22 nt, Artificial Sequence
  Synthetic
ggaagugggggugggagugggg

SEQ ID NO: 39560 - RNA, 23 nt, Artificial Sequence
  Synthetic
aggaagugggggugggagugggg

SEQ ID NO: 39561 - RNA, 24 nt, Artificial Sequence
  Synthetic
caggaagugggggugggagugggg

SEQ ID NO: 39562 - RNA, 18 nt, Artificial Sequence
  Synthetic
gggcagggggaggugggg

SEQ ID NO: 39563 - RNA, 19 nt, Artificial Sequence
  Synthetic
ggggcagggggaggugggg

SEQ ID NO: 39564 - RNA, 20 nt, Artificial Sequence
  Synthetic
gggggcagggggaggugggg

SEQ ID NO: 39565 - RNA, 21 nt, Artificial Sequence
  Synthetic
cgggggcagggggaggugggg

SEQ ID NO: 39566 - RNA, 22 nt, Artificial Sequence
  Synthetic
ucgggggcagggggaggugggg

SEQ ID NO: 39567 - RNA, 23 nt, Artificial Sequence
  Synthetic
cucgggggcagggggaggugggg

SEQ ID NO: 39568 - RNA, 24 nt, Artificial Sequence
  Synthetic
ccucgggggcagggggaggugggg

SEQ ID NO: 39569 - RNA, 18 nt, Artificial Sequence
  Synthetic
aggggggccggggauggg

SEQ ID NO: 39570 - RNA, 19 nt, Artificial Sequence
  Synthetic
caggggggccggggauggg

SEQ ID NO: 39571 - RNA, 20 nt, Artificial Sequence
  Synthetic
gcaggggggccggggauggg

SEQ ID NO: 39572 - RNA, 21 nt, Artificial Sequence
  Synthetic
cgcaggggggccggggauggg

SEQ ID NO: 39573 - RNA, 22 nt, Artificial Sequence
  Synthetic
gcgcaggggggccggggauggg

SEQ ID NO: 39574 - RNA, 23 nt, Artificial Sequence
  Synthetic
cgcgcaggggggccggggauggg

SEQ ID NO: 39575 - RNA, 24 nt, Artificial Sequence
  Synthetic
ccgcgcaggggggccggggauggg

SEQ ID NO: 39576 - RNA, 18 nt, Artificial Sequence
  Synthetic
uccgcguccggcgcuggg

SEQ ID NO: 39577 - RNA, 19 nt, Artificial Sequence
  Synthetic
guccgcguccggcgcuggg

SEQ ID NO: 39578 - RNA, 20 nt, Artificial Sequence
  Synthetic
cguccgcguccggcgcuggg

SEQ ID NO: 39579 - RNA, 21 nt, Artificial Sequence
  Synthetic
gcguccgcguccggcgcuggg

SEQ ID NO: 39580 - RNA, 22 nt, Artificial Sequence
  Synthetic
cgcguccgcguccggcgcuggg

SEQ ID NO: 39581 - RNA, 23 nt, Artificial Sequence
  Synthetic
ucgcguccgcguccggcgcuggg

SEQ ID NO: 39582 - RNA, 24 nt, Artificial Sequence
  Synthetic
gucgcguccgcguccggcgcuggg

SEQ ID NO: 39583 - RNA, 18 nt, Artificial Sequence
  Synthetic
gagaggggggaaaguggg

SEQ ID NO: 39584 - RNA, 19 nt, Artificial Sequence
  Synthetic
agagaggggggaaaguggg

SEQ ID NO: 39585 - RNA, 20 nt, Artificial Sequence
  Synthetic
uagagaggggggaaaguggg

SEQ ID NO: 39586 - RNA, 21 nt, Artificial Sequence
  Synthetic
auagagaggggggaaaguggg

SEQ ID NO: 39587 - RNA, 22 nt, Artificial Sequence
  Synthetic
gauagagaggggggaaaguggg

SEQ ID NO: 39588 - RNA, 23 nt, Artificial Sequence
  Synthetic
ugauagagaggggggaaaguggg

SEQ ID NO: 39589 - RNA, 24 nt, Artificial Sequence
  Synthetic
uugauagagaggggggaaaguggg

SEQ ID NO: 39590 - RNA, 18 nt, Artificial Sequence
  Synthetic
agugggggugggaguggg

SEQ ID NO: 39591 - RNA, 19 nt, Artificial Sequence
  Synthetic
aagugggggugggaguggg

SEQ ID NO: 39592 - RNA, 20 nt, Artificial Sequence
  Synthetic
gaagugggggugggaguggg

SEQ ID NO: 39593 - RNA, 21 nt, Artificial Sequence
  Synthetic
ggaagugggggugggaguggg

SEQ ID NO: 39594 - RNA, 22 nt, Artificial Sequence
  Synthetic
aggaagugggggugggaguggg

SEQ ID NO: 39595 - RNA, 23 nt, Artificial Sequence
  Synthetic
caggaagugggggugggaguggg

SEQ ID NO: 39596 - RNA, 24 nt, Artificial Sequence
  Synthetic
acaggaagugggggugggaguggg

SEQ ID NO: 39597 - RNA, 18 nt, Artificial Sequence
  Synthetic
ggggcagggggagguggg

SEQ ID NO: 39598 - RNA, 19 nt, Artificial Sequence
  Synthetic
gggggcagggggagguggg

SEQ ID NO: 39599 - RNA, 20 nt, Artificial Sequence
  Synthetic
cgggggcagggggagguggg

SEQ ID NO: 39600 - RNA, 21 nt, Artificial Sequence
  Synthetic
ucgggggcagggggagguggg

SEQ ID NO: 39601 - RNA, 22 nt, Artificial Sequence
  Synthetic
cucgggggcagggggagguggg

SEQ ID NO: 39602 - RNA, 23 nt, Artificial Sequence
  Synthetic
ccucgggggcagggggagguggg

SEQ ID NO: 39603 - RNA, 24 nt, Artificial Sequence
  Synthetic
gccucgggggcagggggagguggg

SEQ ID NO: 39604 - RNA, 18 nt, Artificial Sequence
  Synthetic
cccccggggacggguggg

SEQ ID NO: 39605 - RNA, 19 nt, Artificial Sequence
  Synthetic
gcccccggggacggguggg

SEQ ID NO: 39606 - RNA, 20 nt, Artificial Sequence
  Synthetic
ugcccccggggacggguggg

SEQ ID NO: 39607 - RNA, 21 nt, Artificial Sequence
  Synthetic
cugcccccggggacggguggg

SEQ ID NO: 39608 - RNA, 22 nt, Artificial Sequence
  Synthetic
ucugcccccggggacggguggg

SEQ ID NO: 39609 - RNA, 23 nt, Artificial Sequence
  Synthetic
cucugcccccggggacggguggg

SEQ ID NO: 39610 - RNA, 24 nt, Artificial Sequence
  Synthetic
ccucugcccccggggacggguggg

SEQ ID NO: 39611 - RNA, 18 nt, Artificial Sequence
  Synthetic
gacccugggggugguggg

SEQ ID NO: 39612 - RNA, 19 nt, Artificial Sequence
  Synthetic
agacccugggggugguggg

SEQ ID NO: 39613 - RNA, 20 nt, Artificial Sequence
  Synthetic
cagacccugggggugguggg

SEQ ID NO: 39614 - RNA, 21 nt, Artificial Sequence
  Synthetic
ccagacccugggggugguggg

SEQ ID NO: 39615 - RNA, 22 nt, Artificial Sequence
  Synthetic
gccagacccugggggugguggg

SEQ ID NO: 39616 - RNA, 23 nt, Artificial Sequence
  Synthetic
ggccagacccugggggugguggg

SEQ ID NO: 39617 - RNA, 24 nt, Artificial Sequence
  Synthetic
cggccagacccugggggugguggg

SEQ ID NO: 39618 - RNA, 18 nt, Artificial Sequence
  Synthetic
caggggggccggggaugg

SEQ ID NO: 39619 - RNA, 19 nt, Artificial Sequence
  Synthetic
gcaggggggccggggaugg

SEQ ID NO: 39620 - RNA, 20 nt, Artificial Sequence
  Synthetic
cgcaggggggccggggaugg

SEQ ID NO: 39621 - RNA, 21 nt, Artificial Sequence
  Synthetic
gcgcaggggggccggggaugg

SEQ ID NO: 39622 - RNA, 22 nt, Artificial Sequence
  Synthetic
cgcgcaggggggccggggaugg

SEQ ID NO: 39623 - RNA, 23 nt, Artificial Sequence
  Synthetic
ccgcgcaggggggccggggaugg

SEQ ID NO: 39624 - RNA, 24 nt, Artificial Sequence
  Synthetic
cccgcgcaggggggccggggaugg

SEQ ID NO: 39625 - RNA, 18 nt, Artificial Sequence
  Synthetic
cgccccuccucacccugg

SEQ ID NO: 39626 - RNA, 19 nt, Artificial Sequence
  Synthetic
ccgccccuccucacccugg

SEQ ID NO: 39627 - RNA, 20 nt, Artificial Sequence
  Synthetic
cccgccccuccucacccugg

SEQ ID NO: 39628 - RNA, 21 nt, Artificial Sequence
  Synthetic
gcccgccccuccucacccugg

SEQ ID NO: 39629 - RNA, 22 nt, Artificial Sequence
  Synthetic
cgcccgccccuccucacccugg

SEQ ID NO: 39630 - RNA, 23 nt, Artificial Sequence
  Synthetic
acgcccgccccuccucacccugg

SEQ ID NO: 39631 - RNA, 24 nt, Artificial Sequence
  Synthetic
cacgcccgccccuccucacccugg

SEQ ID NO: 39632 - RNA, 18 nt, Artificial Sequence
  Synthetic
cucugcgggcggggcugg

SEQ ID NO: 39633 - RNA, 19 nt, Artificial Sequence
  Synthetic
ccucugcgggcggggcugg

SEQ ID NO: 39634 - RNA, 20 nt, Artificial Sequence
  Synthetic
uccucugcgggcggggcugg

SEQ ID NO: 39635 - RNA, 21 nt, Artificial Sequence
  Synthetic
uuccucugcgggcggggcugg

SEQ ID NO: 39636 - RNA, 22 nt, Artificial Sequence
  Synthetic
cuuccucugcgggcggggcugg

SEQ ID NO: 39637 - RNA, 23 nt, Artificial Sequence
  Synthetic
ucuuccucugcgggcggggcugg

SEQ ID NO: 39638 - RNA, 24 nt, Artificial Sequence
  Synthetic
cucuuccucugcgggcggggcugg

SEQ ID NO: 39639 - RNA, 18 nt, Artificial Sequence
  Synthetic
ccuccucacccuggcugg

SEQ ID NO: 39640 - RNA, 19 nt, Artificial Sequence
  Synthetic
cccuccucacccuggcugg

SEQ ID NO: 39641 - RNA, 20 nt, Artificial Sequence
  Synthetic
ccccuccucacccuggcugg

SEQ ID NO: 39642 - RNA, 21 nt, Artificial Sequence
  Synthetic
gccccuccucacccuggcugg

SEQ ID NO: 39643 - RNA, 22 nt, Artificial Sequence
  Synthetic
cgccccuccucacccuggcugg

SEQ ID NO: 39644 - RNA, 23 nt, Artificial Sequence
  Synthetic
ccgccccuccucacccuggcugg

SEQ ID NO: 39645 - RNA, 24 nt, Artificial Sequence
  Synthetic
cccgccccuccucacccuggcugg

SEQ ID NO: 39646 - RNA, 18 nt, Artificial Sequence
  Synthetic
gguggugggcaggagugg

SEQ ID NO: 39647 - RNA, 19 nt, Artificial Sequence
  Synthetic
ggguggugggcaggagugg

SEQ ID NO: 39648 - RNA, 20 nt, Artificial Sequence
  Synthetic
gggguggugggcaggagugg

SEQ ID NO: 39649 - RNA, 21 nt, Artificial Sequence
  Synthetic
ggggguggugggcaggagugg

SEQ ID NO: 39650 - RNA, 22 nt, Artificial Sequence
  Synthetic
uggggguggugggcaggagugg

SEQ ID NO: 39651 - RNA, 23 nt, Artificial Sequence
  Synthetic
cuggggguggugggcaggagugg

SEQ ID NO: 39652 - RNA, 24 nt, Artificial Sequence
  Synthetic
ccuggggguggugggcaggagugg

SEQ ID NO: 39653 - RNA, 18 nt, Artificial Sequence
  Synthetic
aagugggggugggagugg

SEQ ID NO: 39654 - RNA, 19 nt, Artificial Sequence
  Synthetic
gaagugggggugggagugg

SEQ ID NO: 39655 - RNA, 20 nt, Artificial Sequence
  Synthetic
ggaagugggggugggagugg

SEQ ID NO: 39656 - RNA, 21 nt, Artificial Sequence
  Synthetic
aggaagugggggugggagugg

SEQ ID NO: 39657 - RNA, 22 nt, Artificial Sequence
  Synthetic
caggaagugggggugggagugg

SEQ ID NO: 39658 - RNA, 23 nt, Artificial Sequence
  Synthetic
acaggaagugggggugggagugg

SEQ ID NO: 39659 - RNA, 24 nt, Artificial Sequence
  Synthetic
gacaggaagugggggugggagugg

SEQ ID NO: 39660 - RNA, 18 nt, Artificial Sequence
  Synthetic
gggggcagggggaggugg

SEQ ID NO: 39661 - RNA, 19 nt, Artificial Sequence
  Synthetic
cgggggcagggggaggugg

SEQ ID NO: 39662 - RNA, 20 nt, Artificial Sequence
  Synthetic
ucgggggcagggggaggugg

SEQ ID NO: 39663 - RNA, 21 nt, Artificial Sequence
  Synthetic
cucgggggcagggggaggugg

SEQ ID NO: 39664 - RNA, 22 nt, Artificial Sequence
  Synthetic
ccucgggggcagggggaggugg

SEQ ID NO: 39665 - RNA, 23 nt, Artificial Sequence
  Synthetic
gccucgggggcagggggaggugg

SEQ ID NO: 39666 - RNA, 24 nt, Artificial Sequence
  Synthetic
cgccucgggggcagggggaggugg

SEQ ID NO: 39667 - RNA, 18 nt, Artificial Sequence
  Synthetic
gcccccggggacgggugg

SEQ ID NO: 39668 - RNA, 19 nt, Artificial Sequence
  Synthetic
ugcccccggggacgggugg

SEQ ID NO: 39669 - RNA, 20 nt, Artificial Sequence
  Synthetic
cugcccccggggacgggugg

SEQ ID NO: 39670 - RNA, 21 nt, Artificial Sequence
  Synthetic
ucugcccccggggacgggugg

SEQ ID NO: 39671 - RNA, 22 nt, Artificial Sequence
  Synthetic
cucugcccccggggacgggugg

SEQ ID NO: 39672 - RNA, 23 nt, Artificial Sequence
  Synthetic
ccucugcccccggggacgggugg

SEQ ID NO: 39673 - RNA, 24 nt, Artificial Sequence
  Synthetic
cccucugcccccggggacgggugg

SEQ ID NO: 39674 - RNA, 18 nt, Artificial Sequence
  Synthetic
cccugucuuggugggugg

SEQ ID NO: 39675 - RNA, 19 nt, Artificial Sequence
  Synthetic
ucccugucuuggugggugg

SEQ ID NO: 39676 - RNA, 20 nt, Artificial Sequence
  Synthetic
cucccugucuuggugggugg

SEQ ID NO: 39677 - RNA, 21 nt, Artificial Sequence
  Synthetic
gcucccugucuuggugggugg

SEQ ID NO: 39678 - RNA, 22 nt, Artificial Sequence
  Synthetic
ggcucccugucuuggugggugg

SEQ ID NO: 39679 - RNA, 23 nt, Artificial Sequence
  Synthetic
uggcucccugucuuggugggugg

SEQ ID NO: 39680 - RNA, 24 nt, Artificial Sequence
  Synthetic
cuggcucccugucuuggugggugg

SEQ ID NO: 39681 - RNA, 18 nt, Artificial Sequence
  Synthetic
ggcucccugucuuggugg

SEQ ID NO: 39682 - RNA, 19 nt, Artificial Sequence
  Synthetic
uggcucccugucuuggugg

SEQ ID NO: 39683 - RNA, 20 nt, Artificial Sequence
  Synthetic
cuggcucccugucuuggugg

SEQ ID NO: 39684 - RNA, 21 nt, Artificial Sequence
  Synthetic
ucuggcucccugucuuggugg

SEQ ID NO: 39685 - RNA, 22 nt, Artificial Sequence
  Synthetic
uucuggcucccugucuuggugg

SEQ ID NO: 39686 - RNA, 23 nt, Artificial Sequence
  Synthetic
guucuggcucccugucuuggugg

SEQ ID NO: 39687 - RNA, 24 nt, Artificial Sequence
  Synthetic
cguucuggcucccugucuuggugg

SEQ ID NO: 39688 - RNA, 18 nt, Artificial Sequence
  Synthetic
gcaggggggccggggaug

SEQ ID NO: 39689 - RNA, 19 nt, Artificial Sequence
  Synthetic
cgcaggggggccggggaug

SEQ ID NO: 39690 - RNA, 20 nt, Artificial Sequence
  Synthetic
gcgcaggggggccggggaug

SEQ ID NO: 39691 - RNA, 21 nt, Artificial Sequence
  Synthetic
cgcgcaggggggccggggaug

SEQ ID NO: 39692 - RNA, 22 nt, Artificial Sequence
  Synthetic
ccgcgcaggggggccggggaug

SEQ ID NO: 39693 - RNA, 23 nt, Artificial Sequence
  Synthetic
cccgcgcaggggggccggggaug

SEQ ID NO: 39694 - RNA, 24 nt, Artificial Sequence
  Synthetic
ccccgcgcaggggggccggggaug

SEQ ID NO: 39695 - RNA, 18 nt, Artificial Sequence
  Synthetic
uuugaccagggcacccug

SEQ ID NO: 39696 - RNA, 19 nt, Artificial Sequence
  Synthetic
cuuugaccagggcacccug

SEQ ID NO: 39697 - RNA, 20 nt, Artificial Sequence
  Synthetic
ucuuugaccagggcacccug

SEQ ID NO: 39698 - RNA, 21 nt, Artificial Sequence
  Synthetic
cucuuugaccagggcacccug

SEQ ID NO: 39699 - RNA, 22 nt, Artificial Sequence
  Synthetic
gcucuuugaccagggcacccug

SEQ ID NO: 39700 - RNA, 23 nt, Artificial Sequence
  Synthetic
ugcucuuugaccagggcacccug

SEQ ID NO: 39701 - RNA, 24 nt, Artificial Sequence
  Synthetic
augcucuuugaccagggcacccug

SEQ ID NO: 39702 - RNA, 18 nt, Artificial Sequence
  Synthetic
cguccgcguccggcgcug

SEQ ID NO: 39703 - RNA, 19 nt, Artificial Sequence
  Synthetic
gcguccgcguccggcgcug

SEQ ID NO: 39704 - RNA, 20 nt, Artificial Sequence
  Synthetic
cgcguccgcguccggcgcug

SEQ ID NO: 39705 - RNA, 21 nt, Artificial Sequence
  Synthetic
ucgcguccgcguccggcgcug

SEQ ID NO: 39706 - RNA, 22 nt, Artificial Sequence
  Synthetic
gucgcguccgcguccggcgcug

SEQ ID NO: 39707 - RNA, 23 nt, Artificial Sequence
  Synthetic
cgucgcguccgcguccggcgcug

SEQ ID NO: 39708 - RNA, 24 nt, Artificial Sequence
  Synthetic
gcgucgcguccgcguccggcgcug

SEQ ID NO: 39709 - RNA, 18 nt, Artificial Sequence
  Synthetic
ccucugcgggcggggcug

SEQ ID NO: 39710 - RNA, 19 nt, Artificial Sequence
  Synthetic
uccucugcgggcggggcug

SEQ ID NO: 39711 - RNA, 20 nt, Artificial Sequence
  Synthetic
uuccucugcgggcggggcug

SEQ ID NO: 39712 - RNA, 21 nt, Artificial Sequence
  Synthetic
cuuccucugcgggcggggcug

SEQ ID NO: 39713 - RNA, 22 nt, Artificial Sequence
  Synthetic
ucuuccucugcgggcggggcug

SEQ ID NO: 39714 - RNA, 23 nt, Artificial Sequence
  Synthetic
cucuuccucugcgggcggggcug

SEQ ID NO: 39715 - RNA, 24 nt, Artificial Sequence
  Synthetic
ccucuuccucugcgggcggggcug

SEQ ID NO: 39716 - RNA, 18 nt, Artificial Sequence
  Synthetic
cccuccuuacccuggcug

SEQ ID NO: 39717 - RNA, 19 nt, Artificial Sequence
  Synthetic
ccccuccuuacccuggcug

SEQ ID NO: 39718 - RNA, 20 nt, Artificial Sequence
  Synthetic
gccccuccuuacccuggcug

SEQ ID NO: 39719 - RNA, 21 nt, Artificial Sequence
  Synthetic
cgccccuccuuacccuggcug

SEQ ID NO: 39720 - RNA, 22 nt, Artificial Sequence
  Synthetic
ccgccccuccuuacccuggcug

SEQ ID NO: 39721 - RNA, 23 nt, Artificial Sequence
  Synthetic
cccgccccuccuuacccuggcug

SEQ ID NO: 39722 - RNA, 24 nt, Artificial Sequence
  Synthetic
gcccgccccuccuuacccuggcug

SEQ ID NO: 39723 - RNA, 18 nt, Artificial Sequence
  Synthetic
gaagugggggugggagug

SEQ ID NO: 39724 - RNA, 19 nt, Artificial Sequence
  Synthetic
ggaagugggggugggagug

SEQ ID NO: 39725 - RNA, 20 nt, Artificial Sequence
  Synthetic
aggaagugggggugggagug

SEQ ID NO: 39726 - RNA, 21 nt, Artificial Sequence
  Synthetic
caggaagugggggugggagug

SEQ ID NO: 39727 - RNA, 22 nt, Artificial Sequence
  Synthetic
acaggaagugggggugggagug

SEQ ID NO: 39728 - RNA, 23 nt, Artificial Sequence
  Synthetic
gacaggaagugggggugggagug

SEQ ID NO: 39729 - RNA, 24 nt, Artificial Sequence
  Synthetic
agacaggaagugggggugggagug

SEQ ID NO: 39730 - RNA, 18 nt, Artificial Sequence
  Synthetic
gaccagacggggaacgug

SEQ ID NO: 39731 - RNA, 19 nt, Artificial Sequence
  Synthetic
ggaccagacggggaacgug

SEQ ID NO: 39732 - RNA, 20 nt, Artificial Sequence
  Synthetic
uggaccagacggggaacgug

SEQ ID NO: 39733 - RNA, 21 nt, Artificial Sequence
  Synthetic
guggaccagacggggaacgug

SEQ ID NO: 39734 - RNA, 22 nt, Artificial Sequence
  Synthetic
cguggaccagacggggaacgug

SEQ ID NO: 39735 - RNA, 23 nt, Artificial Sequence
  Synthetic
ucguggaccagacggggaacgug

SEQ ID NO: 39736 - RNA, 24 nt, Artificial Sequence
  Synthetic
cucguggaccagacggggaacgug

SEQ ID NO: 39737 - RNA, 18 nt, Artificial Sequence
  Synthetic
gaggggggcccgaucgug

SEQ ID NO: 39738 - RNA, 19 nt, Artificial Sequence
  Synthetic
ggaggggggcccgaucgug

SEQ ID NO: 39739 - RNA, 20 nt, Artificial Sequence
  Synthetic
gggaggggggcccgaucgug

SEQ ID NO: 39740 - RNA, 21 nt, Artificial Sequence
  Synthetic
agggaggggggcccgaucgug

SEQ ID NO: 39741 - RNA, 22 nt, Artificial Sequence
  Synthetic
cagggaggggggcccgaucgug

SEQ ID NO: 39742 - RNA, 23 nt, Artificial Sequence
  Synthetic
acagggaggggggcccgaucgug

SEQ ID NO: 39743 - RNA, 24 nt, Artificial Sequence
  Synthetic
gacagggaggggggcccgaucgug

SEQ ID NO: 39744 - RNA, 18 nt, Artificial Sequence
  Synthetic
cgggggcagggggaggug

SEQ ID NO: 39745 - RNA, 19 nt, Artificial Sequence
  Synthetic
ucgggggcagggggaggug

SEQ ID NO: 39746 - RNA, 20 nt, Artificial Sequence
  Synthetic
cucgggggcagggggaggug

SEQ ID NO: 39747 - RNA, 21 nt, Artificial Sequence
  Synthetic
ccucgggggcagggggaggug

SEQ ID NO: 39748 - RNA, 22 nt, Artificial Sequence
  Synthetic
gccucgggggcagggggaggug

SEQ ID NO: 39749 - RNA, 23 nt, Artificial Sequence
  Synthetic
cgccucgggggcagggggaggug

SEQ ID NO: 39750 - RNA, 24 nt, Artificial Sequence
  Synthetic
gcgccucgggggcagggggaggug

SEQ ID NO: 39751 - RNA, 18 nt, Artificial Sequence
  Synthetic
ggccagacccugggggug

SEQ ID NO: 39752 - RNA, 19 nt, Artificial Sequence
  Synthetic
cggccagacccugggggug

SEQ ID NO: 39753 - RNA, 20 nt, Artificial Sequence
  Synthetic
ccggccagacccugggggug

SEQ ID NO: 39754 - RNA, 21 nt, Artificial Sequence
  Synthetic
gccggccagacccugggggug

SEQ ID NO: 39755 - RNA, 22 nt, Artificial Sequence
  Synthetic
ggccggccagacccugggggug

SEQ ID NO: 39756 - RNA, 23 nt, Artificial Sequence
  Synthetic
uggccggccagacccugggggug

SEQ ID NO: 39757 - RNA, 24 nt, Artificial Sequence
  Synthetic
cuggccggccagacccugggggug

SEQ ID NO: 39758 - RNA, 18 nt, Artificial Sequence
  Synthetic
ggccuuguugaaaacuug

SEQ ID NO: 39759 - RNA, 19 nt, Artificial Sequence
  Synthetic
uggccuuguugaaaacuug

SEQ ID NO: 39760 - RNA, 20 nt, Artificial Sequence
  Synthetic
cuggccuuguugaaaacuug

SEQ ID NO: 39761 - RNA, 21 nt, Artificial Sequence
  Synthetic
ucuggccuuguugaaaacuug

SEQ ID NO: 39762 - RNA, 22 nt, Artificial Sequence
  Synthetic
uucuggccuuguugaaaacuug

SEQ ID NO: 39763 - RNA, 23 nt, Artificial Sequence
  Synthetic
uuucuggccuuguugaaaacuug

SEQ ID NO: 39764 - RNA, 24 nt, Artificial Sequence
  Synthetic
cuuucuggccuuguugaaaacuug

SEQ ID NO: 39765 - RNA, 18 nt, Artificial Sequence
  Synthetic
auggacuuucuggccuug

SEQ ID NO: 39766 - RNA, 19 nt, Artificial Sequence
  Synthetic
uauggacuuucuggccuug

SEQ ID NO: 39767 - RNA, 20 nt, Artificial Sequence
  Synthetic
uuauggacuuucuggccuug

SEQ ID NO: 39768 - RNA, 21 nt, Artificial Sequence
  Synthetic
guuauggacuuucuggccuug

SEQ ID NO: 39769 - RNA, 22 nt, Artificial Sequence
  Synthetic
uguuauggacuuucuggccuug

SEQ ID NO: 39770 - RNA, 23 nt, Artificial Sequence
  Synthetic
uuguuauggacuuucuggccuug

SEQ ID NO: 39771 - RNA, 24 nt, Artificial Sequence
  Synthetic
uuuguuauggacuuucuggccuug

SEQ ID NO: 39772 - RNA, 18 nt, Artificial Sequence
  Synthetic
acgacacgacgcguuuug

SEQ ID NO: 39773 - RNA, 19 nt, Artificial Sequence
  Synthetic
cacgacacgacgcguuuug

SEQ ID NO: 39774 - RNA, 20 nt, Artificial Sequence
  Synthetic
acacgacacgacgcguuuug

SEQ ID NO: 39775 - RNA, 21 nt, Artificial Sequence
  Synthetic
aacacgacacgacgcguuuug

SEQ ID NO: 39776 - RNA, 22 nt, Artificial Sequence
  Synthetic
caacacgacacgacgcguuuug

SEQ ID NO: 39777 - RNA, 23 nt, Artificial Sequence
  Synthetic
acaacacgacacgacgcguuuug

SEQ ID NO: 39778 - RNA, 24 nt, Artificial Sequence
  Synthetic
cacaacacgacacgacgcguuuug

SEQ ID NO: 39779 - RNA, 18 nt, Artificial Sequence
  Synthetic
cauggagacgggccacau

SEQ ID NO: 39780 - RNA, 19 nt, Artificial Sequence
  Synthetic
acauggagacgggccacau

SEQ ID NO: 39781 - RNA, 20 nt, Artificial Sequence
  Synthetic
gacauggagacgggccacau

SEQ ID NO: 39782 - RNA, 21 nt, Artificial Sequence
  Synthetic
ggacauggagacgggccacau

SEQ ID NO: 39783 - RNA, 22 nt, Artificial Sequence
  Synthetic
uggacauggagacgggccacau

SEQ ID NO: 39784 - RNA, 23 nt, Artificial Sequence
  Synthetic
cuggacauggagacgggccacau

SEQ ID NO: 39785 - RNA, 24 nt, Artificial Sequence
  Synthetic
ccuggacauggagacgggccacau

SEQ ID NO: 39786 - RNA, 18 nt, Artificial Sequence
  Synthetic
cugcggggagacucccau

SEQ ID NO: 39787 - RNA, 19 nt, Artificial Sequence
  Synthetic
gcugcggggagacucccau

SEQ ID NO: 39788 - RNA, 20 nt, Artificial Sequence
  Synthetic
ggcugcggggagacucccau

SEQ ID NO: 39789 - RNA, 21 nt, Artificial Sequence
  Synthetic
uggcugcggggagacucccau

SEQ ID NO: 39790 - RNA, 22 nt, Artificial Sequence
  Synthetic
cuggcugcggggagacucccau

SEQ ID NO: 39791 - RNA, 23 nt, Artificial Sequence
  Synthetic
ccuggcugcggggagacucccau

SEQ ID NO: 39792 - RNA, 24 nt, Artificial Sequence
  Synthetic
cccuggcugcggggagacucccau

SEQ ID NO: 39793 - RNA, 18 nt, Artificial Sequence
  Synthetic
cgcaggggggccggggau

SEQ ID NO: 39794 - RNA, 19 nt, Artificial Sequence
  Synthetic
gcgcaggggggccggggau

SEQ ID NO: 39795 - RNA, 20 nt, Artificial Sequence
  Synthetic
cgcgcaggggggccggggau

SEQ ID NO: 39796 - RNA, 21 nt, Artificial Sequence
  Synthetic
ccgcgcaggggggccggggau

SEQ ID NO: 39797 - RNA, 22 nt, Artificial Sequence
  Synthetic
cccgcgcaggggggccggggau

SEQ ID NO: 39798 - RNA, 23 nt, Artificial Sequence
  Synthetic
ccccgcgcaggggggccggggau

SEQ ID NO: 39799 - RNA, 24 nt, Artificial Sequence
  Synthetic
cccccgcgcaggggggccggggau

SEQ ID NO: 39800 - RNA, 18 nt, Artificial Sequence
  Synthetic
ccaccggccgaggcgccu

SEQ ID NO: 39801 - RNA, 19 nt, Artificial Sequence
  Synthetic
accaccggccgaggcgccu

SEQ ID NO: 39802 - RNA, 20 nt, Artificial Sequence
  Synthetic
gaccaccggccgaggcgccu

SEQ ID NO: 39803 - RNA, 21 nt, Artificial Sequence
  Synthetic
ggaccaccggccgaggcgccu

SEQ ID NO: 39804 - RNA, 22 nt, Artificial Sequence
  Synthetic
cggaccaccggccgaggcgccu

SEQ ID NO: 39805 - RNA, 23 nt, Artificial Sequence
  Synthetic
ccggaccaccggccgaggcgccu

SEQ ID NO: 39806 - RNA, 24 nt, Artificial Sequence
  Synthetic
accggaccaccggccgaggcgccu

SEQ ID NO: 39807 - RNA, 18 nt, Artificial Sequence
  Synthetic
gcguccgcguccggcgcu

SEQ ID NO: 39808 - RNA, 19 nt, Artificial Sequence
  Synthetic
cgcguccgcguccggcgcu

SEQ ID NO: 39809 - RNA, 20 nt, Artificial Sequence
  Synthetic
ucgcguccgcguccggcgcu

SEQ ID NO: 39810 - RNA, 21 nt, Artificial Sequence
  Synthetic
gucgcguccgcguccggcgcu

SEQ ID NO: 39811 - RNA, 22 nt, Artificial Sequence
  Synthetic
cgucgcguccgcguccggcgcu

SEQ ID NO: 39812 - RNA, 23 nt, Artificial Sequence
  Synthetic
gcgucgcguccgcguccggcgcu

SEQ ID NO: 39813 - RNA, 24 nt, Artificial Sequence
  Synthetic
agcgucgcguccgcguccggcgcu

SEQ ID NO: 39814 - RNA, 18 nt, Artificial Sequence
  Synthetic
ccccuccucacccuggcu

SEQ ID NO: 39815 - RNA, 19 nt, Artificial Sequence
  Synthetic
gccccuccucacccuggcu

SEQ ID NO: 39816 - RNA, 20 nt, Artificial Sequence
  Synthetic
cgccccuccucacccuggcu

SEQ ID NO: 39817 - RNA, 21 nt, Artificial Sequence
  Synthetic
ccgccccuccucacccuggcu

SEQ ID NO: 39818 - RNA, 22 nt, Artificial Sequence
  Synthetic
cccgccccuccucacccuggcu

SEQ ID NO: 39819 - RNA, 23 nt, Artificial Sequence
  Synthetic
gcccgccccuccucacccuggcu

SEQ ID NO: 39820 - RNA, 24 nt, Artificial Sequence
  Synthetic
cgcccgccccuccucacccuggcu

SEQ ID NO: 39821 - RNA, 18 nt, Artificial Sequence
  Synthetic
ccccuccuuacccuggcu

SEQ ID NO: 39822 - RNA, 19 nt, Artificial Sequence
  Synthetic
gccccuccuuacccuggcu

SEQ ID NO: 39823 - RNA, 20 nt, Artificial Sequence
  Synthetic
cgccccuccuuacccuggcu

SEQ ID NO: 39824 - RNA, 21 nt, Artificial Sequence
  Synthetic
ccgccccuccuuacccuggcu

SEQ ID NO: 39825 - RNA, 22 nt, Artificial Sequence
  Synthetic
cccgccccuccuuacccuggcu

SEQ ID NO: 39826 - RNA, 23 nt, Artificial Sequence
  Synthetic
gcccgccccuccuuacccuggcu

SEQ ID NO: 39827 - RNA, 24 nt, Artificial Sequence
  Synthetic
cgcccgccccuccuuacccuggcu

SEQ ID NO: 39828 - RNA, 18 nt, Artificial Sequence
  Synthetic
gugggagggcgccuggcu

SEQ ID NO: 39829 - RNA, 19 nt, Artificial Sequence
  Synthetic
agugggagggcgccuggcu

SEQ ID NO: 39830 - RNA, 20 nt, Artificial Sequence
  Synthetic
gagugggagggcgccuggcu

SEQ ID NO: 39831 - RNA, 21 nt, Artificial Sequence
  Synthetic
ggagugggagggcgccuggcu

SEQ ID NO: 39832 - RNA, 22 nt, Artificial Sequence
  Synthetic
aggagugggagggcgccuggcu

SEQ ID NO: 39833 - RNA, 23 nt, Artificial Sequence
  Synthetic
caggagugggagggcgccuggcu

SEQ ID NO: 39834 - RNA, 24 nt, Artificial Sequence
  Synthetic
gcaggagugggagggcgccuggcu

SEQ ID NO: 39835 - RNA, 18 nt, Artificial Sequence
  Synthetic
gaacguggcggaccugcu

SEQ ID NO: 39836 - RNA, 19 nt, Artificial Sequence
  Synthetic
ggaacguggcggaccugcu

SEQ ID NO: 39837 - RNA, 20 nt, Artificial Sequence
  Synthetic
gggaacguggcggaccugcu

SEQ ID NO: 39838 - RNA, 21 nt, Artificial Sequence
  Synthetic
ggggaacguggcggaccugcu

SEQ ID NO: 39839 - RNA, 22 nt, Artificial Sequence
  Synthetic
cggggaacguggcggaccugcu

SEQ ID NO: 39840 - RNA, 23 nt, Artificial Sequence
  Synthetic
acggggaacguggcggaccugcu

SEQ ID NO: 39841 - RNA, 24 nt, Artificial Sequence
  Synthetic
gacggggaacguggcggaccugcu

SEQ ID NO: 39842 - RNA, 18 nt, Artificial Sequence
  Synthetic
uccuccgccucuuccucu

SEQ ID NO: 39843 - RNA, 19 nt, Artificial Sequence
  Synthetic
cuccuccgccucuuccucu

SEQ ID NO: 39844 - RNA, 20 nt, Artificial Sequence
  Synthetic
ccuccuccgccucuuccucu

SEQ ID NO: 39845 - RNA, 21 nt, Artificial Sequence
  Synthetic
uccuccuccgccucuuccucu

SEQ ID NO: 39846 - RNA, 22 nt, Artificial Sequence
  Synthetic
cuccuccuccgccucuuccucu

SEQ ID NO: 39847 - RNA, 23 nt, Artificial Sequence
  Synthetic
ccuccuccuccgccucuuccucu

SEQ ID NO: 39848 - RNA, 24 nt, Artificial Sequence
  Synthetic
uccuccuccuccgccucuuccucu

SEQ ID NO: 39849 - RNA, 18 nt, Artificial Sequence
  Synthetic
ucgcgccacccguggucu

SEQ ID NO: 39850 - RNA, 19 nt, Artificial Sequence
  Synthetic
gucgcgccacccguggucu

SEQ ID NO: 39851 - RNA, 20 nt, Artificial Sequence
  Synthetic
ggucgcgccacccguggucu

SEQ ID NO: 39852 - RNA, 21 nt, Artificial Sequence
  Synthetic
cggucgcgccacccguggucu

SEQ ID NO: 39853 - RNA, 22 nt, Artificial Sequence
  Synthetic
ccggucgcgccacccguggucu

SEQ ID NO: 39854 - RNA, 23 nt, Artificial Sequence
  Synthetic
uccggucgcgccacccguggucu

SEQ ID NO: 39855 - RNA, 24 nt, Artificial Sequence
  Synthetic
cuccggucgcgccacccguggucu

SEQ ID NO: 39856 - RNA, 18 nt, Artificial Sequence
  Synthetic
gggguggugggcaggagu

SEQ ID NO: 39857 - RNA, 19 nt, Artificial Sequence
  Synthetic
ggggguggugggcaggagu

SEQ ID NO: 39858 - RNA, 20 nt, Artificial Sequence
  Synthetic
uggggguggugggcaggagu

SEQ ID NO: 39859 - RNA, 21 nt, Artificial Sequence
  Synthetic
cuggggguggugggcaggagu

SEQ ID NO: 39860 - RNA, 22 nt, Artificial Sequence
  Synthetic
ccuggggguggugggcaggagu

SEQ ID NO: 39861 - RNA, 23 nt, Artificial Sequence
  Synthetic
cccuggggguggugggcaggagu

SEQ ID NO: 39862 - RNA, 24 nt, Artificial Sequence
  Synthetic
acccuggggguggugggcaggagu

SEQ ID NO: 39863 - RNA, 18 nt, Artificial Sequence
  Synthetic
ccgcgggccacggggagu

SEQ ID NO: 39864 - RNA, 19 nt, Artificial Sequence
  Synthetic
cccgcgggccacggggagu

SEQ ID NO: 39865 - RNA, 20 nt, Artificial Sequence
  Synthetic
ccccgcgggccacggggagu

SEQ ID NO: 39866 - RNA, 21 nt, Artificial Sequence
  Synthetic
cccccgcgggccacggggagu

SEQ ID NO: 39867 - RNA, 22 nt, Artificial Sequence
  Synthetic
gcccccgcgggccacggggagu

SEQ ID NO: 39868 - RNA, 23 nt, Artificial Sequence
  Synthetic
cgcccccgcgggccacggggagu

SEQ ID NO: 39869 - RNA, 24 nt, Artificial Sequence
  Synthetic
acgcccccgcgggccacggggagu

SEQ ID NO: 39870 - RNA, 18 nt, Artificial Sequence
  Synthetic
ggaagugggggugggagu

SEQ ID NO: 39871 - RNA, 19 nt, Artificial Sequence
  Synthetic
aggaagugggggugggagu

SEQ ID NO: 39872 - RNA, 20 nt, Artificial Sequence
  Synthetic
caggaagugggggugggagu

SEQ ID NO: 39873 - RNA, 21 nt, Artificial Sequence
  Synthetic
acaggaagugggggugggagu

SEQ ID NO: 39874 - RNA, 22 nt, Artificial Sequence
  Synthetic
gacaggaagugggggugggagu

SEQ ID NO: 39875 - RNA, 23 nt, Artificial Sequence
  Synthetic
agacaggaagugggggugggagu

SEQ ID NO: 39876 - RNA, 24 nt, Artificial Sequence
  Synthetic
gagacaggaagugggggugggagu

SEQ ID NO: 39877 - RNA, 18 nt, Artificial Sequence
  Synthetic
ucgggggcagggggaggu

SEQ ID NO: 39878 - RNA, 19 nt, Artificial Sequence
  Synthetic
cucgggggcagggggaggu

SEQ ID NO: 39879 - RNA, 20 nt, Artificial Sequence
  Synthetic
ccucgggggcagggggaggu

SEQ ID NO: 39880 - RNA, 21 nt, Artificial Sequence
  Synthetic
gccucgggggcagggggaggu

SEQ ID NO: 39881 - RNA, 22 nt, Artificial Sequence
  Synthetic
cgccucgggggcagggggaggu

SEQ ID NO: 39882 - RNA, 23 nt, Artificial Sequence
  Synthetic
gcgccucgggggcagggggaggu

SEQ ID NO: 39883 - RNA, 24 nt, Artificial Sequence
  Synthetic
ggcgccucgggggcagggggaggu

SEQ ID NO: 39884 - RNA, 18 nt, Artificial Sequence
  Synthetic
cugcccccggggacgggu

SEQ ID NO: 39885 - RNA, 19 nt, Artificial Sequence
  Synthetic
ucugcccccggggacgggu

SEQ ID NO: 39886 - RNA, 20 nt, Artificial Sequence
  Synthetic
cucugcccccggggacgggu

SEQ ID NO: 39887 - RNA, 21 nt, Artificial Sequence
  Synthetic
ccucugcccccggggacgggu

SEQ ID NO: 39888 - RNA, 22 nt, Artificial Sequence
  Synthetic
cccucugcccccggggacgggu

SEQ ID NO: 39889 - RNA, 23 nt, Artificial Sequence
  Synthetic
gcccucugcccccggggacgggu

SEQ ID NO: 39890 - RNA, 24 nt, Artificial Sequence
  Synthetic
cgcccucugcccccggggacgggu

SEQ ID NO: 39891 - RNA, 18 nt, Artificial Sequence
  Synthetic
ucugcgggcggggcuggu

SEQ ID NO: 39892 - RNA, 19 nt, Artificial Sequence
  Synthetic
cucugcgggcggggcuggu

SEQ ID NO: 39893 - RNA, 20 nt, Artificial Sequence
  Synthetic
ccucugcgggcggggcuggu

SEQ ID NO: 39894 - RNA, 21 nt, Artificial Sequence
  Synthetic
uccucugcgggcggggcuggu

SEQ ID NO: 39895 - RNA, 22 nt, Artificial Sequence
  Synthetic
uuccucugcgggcggggcuggu

SEQ ID NO: 39896 - RNA, 23 nt, Artificial Sequence
  Synthetic
cuuccucugcgggcggggcuggu

SEQ ID NO: 39897 - RNA, 24 nt, Artificial Sequence
  Synthetic
ucuuccucugcgggcggggcuggu

SEQ ID NO: 39898 - RNA, 18 nt, Artificial Sequence
  Synthetic
uggccuuguugaaaacuu

SEQ ID NO: 39899 - RNA, 19 nt, Artificial Sequence
  Synthetic
cuggccuuguugaaaacuu

SEQ ID NO: 39900 - RNA, 20 nt, Artificial Sequence
  Synthetic
ucuggccuuguugaaaacuu

SEQ ID NO: 39901 - RNA, 21 nt, Artificial Sequence
  Synthetic
uucuggccuuguugaaaacuu

SEQ ID NO: 39902 - RNA, 22 nt, Artificial Sequence
  Synthetic
uuucuggccuuguugaaaacuu

SEQ ID NO: 39903 - RNA, 23 nt, Artificial Sequence
  Synthetic
cuuucuggccuuguugaaaacuu

SEQ ID NO: 39904 - RNA, 24 nt, Artificial Sequence
  Synthetic
acuuucuggccuuguugaaaacuu

SEQ ID NO: 39905 - RNA, 18 nt, Artificial Sequence
  Synthetic
acacaccagcauuuuguu

SEQ ID NO: 39906 - RNA, 19 nt, Artificial Sequence
  Synthetic
cacacaccagcauuuuguu

SEQ ID NO: 39907 - RNA, 20 nt, Artificial Sequence
  Synthetic
acacacaccagcauuuuguu

SEQ ID NO: 39908 - RNA, 21 nt, Artificial Sequence
  Synthetic
aacacacaccagcauuuuguu

SEQ ID NO: 39909 - RNA, 22 nt, Artificial Sequence
  Synthetic
caacacacaccagcauuuuguu

SEQ ID NO: 39910 - RNA, 23 nt, Artificial Sequence
  Synthetic
gcaacacacaccagcauuuuguu

SEQ ID NO: 39911 - RNA, 24 nt, Artificial Sequence
  Synthetic
agcaacacacaccagcauuuuguu

SEQ ID NO: 39912 - RNA, 18 nt, Artificial Sequence
  Synthetic
cacgacacgacgcguuuu

SEQ ID NO: 39913 - RNA, 19 nt, Artificial Sequence
  Synthetic
acacgacacgacgcguuuu

SEQ ID NO: 39914 - RNA, 20 nt, Artificial Sequence
  Synthetic
aacacgacacgacgcguuuu

SEQ ID NO: 39915 - RNA, 21 nt, Artificial Sequence
  Synthetic
caacacgacacgacgcguuuu

SEQ ID NO: 39916 - RNA, 22 nt, Artificial Sequence
  Synthetic
acaacacgacacgacgcguuuu

SEQ ID NO: 39917 - RNA, 23 nt, Artificial Sequence
  Synthetic
cacaacacgacacgacgcguuuu

SEQ ID NO: 39918 - RNA, 24 nt, Artificial Sequence
  Synthetic
acacaacacgacacgacgcguuuu

SEQ ID NO: 39919 - RNA, 18 nt, Artificial Sequence
  Synthetic
cgcccacccaccaagaca

SEQ ID NO: 39920 - RNA, 19 nt, Artificial Sequence
  Synthetic
ccgcccacccaccaagaca

SEQ ID NO: 39921 - RNA, 20 nt, Artificial Sequence
  Synthetic
cccgcccacccaccaagaca

SEQ ID NO: 39922 - RNA, 21 nt, Artificial Sequence
  Synthetic
gcccgcccacccaccaagaca

SEQ ID NO: 39923 - RNA, 22 nt, Artificial Sequence
  Synthetic
agcccgcccacccaccaagaca

SEQ ID NO: 39924 - RNA, 23 nt, Artificial Sequence
  Synthetic
cagcccgcccacccaccaagaca

SEQ ID NO: 39925 - RNA, 24 nt, Artificial Sequence
  Synthetic
ccagcccgcccacccaccaagaca

SEQ ID NO: 39926 - RNA, 18 nt, Artificial Sequence
  Synthetic
caaagagcauguugccca

SEQ ID NO: 39927 - RNA, 19 nt, Artificial Sequence
  Synthetic
ucaaagagcauguugccca

SEQ ID NO: 39928 - RNA, 20 nt, Artificial Sequence
  Synthetic
gucaaagagcauguugccca

SEQ ID NO: 39929 - RNA, 21 nt, Artificial Sequence
  Synthetic
ggucaaagagcauguugccca

SEQ ID NO: 39930 - RNA, 22 nt, Artificial Sequence
  Synthetic
uggucaaagagcauguugccca

SEQ ID NO: 39931 - RNA, 23 nt, Artificial Sequence
  Synthetic
cuggucaaagagcauguugccca

SEQ ID NO: 39932 - RNA, 24 nt, Artificial Sequence
  Synthetic
ccuggucaaagagcauguugccca

SEQ ID NO: 39933 - RNA, 18 nt, Artificial Sequence
  Synthetic
ccaccagccccgcccgca

SEQ ID NO: 39934 - RNA, 19 nt, Artificial Sequence
  Synthetic
cccaccagccccgcccgca

SEQ ID NO: 39935 - RNA, 20 nt, Artificial Sequence
  Synthetic
ucccaccagccccgcccgca

SEQ ID NO: 39936 - RNA, 21 nt, Artificial Sequence
  Synthetic
cucccaccagccccgcccgca

SEQ ID NO: 39937 - RNA, 22 nt, Artificial Sequence
  Synthetic
gcucccaccagccccgcccgca

SEQ ID NO: 39938 - RNA, 23 nt, Artificial Sequence
  Synthetic
cgcucccaccagccccgcccgca

SEQ ID NO: 39939 - RNA, 24 nt, Artificial Sequence
  Synthetic
acgcucccaccagccccgcccgca

SEQ ID NO: 39940 - RNA, 18 nt, Artificial Sequence
  Synthetic
cacccguccccgggggca

SEQ ID NO: 39941 - RNA, 19 nt, Artificial Sequence
  Synthetic
ccacccguccccgggggca

SEQ ID NO: 39942 - RNA, 20 nt, Artificial Sequence
  Synthetic
cccacccguccccgggggca

SEQ ID NO: 39943 - RNA, 21 nt, Artificial Sequence
  Synthetic
ucccacccguccccgggggca

SEQ ID NO: 39944 - RNA, 22 nt, Artificial Sequence
  Synthetic
cucccacccguccccgggggca

SEQ ID NO: 39945 - RNA, 23 nt, Artificial Sequence
  Synthetic
ccucccacccguccccgggggca

SEQ ID NO: 39946 - RNA, 24 nt, Artificial Sequence
  Synthetic
uccucccacccguccccgggggca

SEQ ID NO: 39947 - RNA, 18 nt, Artificial Sequence
  Synthetic
accagggugcccugguca

SEQ ID NO: 39948 - RNA, 19 nt, Artificial Sequence
  Synthetic
caccagggugcccugguca

SEQ ID NO: 39949 - RNA, 20 nt, Artificial Sequence
  Synthetic
ccaccagggugcccugguca

SEQ ID NO: 39950 - RNA, 21 nt, Artificial Sequence
  Synthetic
cccaccagggugcccugguca

SEQ ID NO: 39951 - RNA, 22 nt, Artificial Sequence
  Synthetic
gcccaccagggugcccugguca

SEQ ID NO: 39952 - RNA, 23 nt, Artificial Sequence
  Synthetic
cgcccaccagggugcccugguca

SEQ ID NO: 39953 - RNA, 24 nt, Artificial Sequence
  Synthetic
gcgcccaccagggugcccugguca

SEQ ID NO: 39954 - RNA, 18 nt, Artificial Sequence
  Synthetic
cccgcccacccaccaaga

SEQ ID NO: 39955 - RNA, 19 nt, Artificial Sequence
  Synthetic
gcccgcccacccaccaaga

SEQ ID NO: 39956 - RNA, 20 nt, Artificial Sequence
  Synthetic
agcccgcccacccaccaaga

SEQ ID NO: 39957 - RNA, 21 nt, Artificial Sequence
  Synthetic
cagcccgcccacccaccaaga

SEQ ID NO: 39958 - RNA, 22 nt, Artificial Sequence
  Synthetic
ccagcccgcccacccaccaaga

SEQ ID NO: 39959 - RNA, 23 nt, Artificial Sequence
  Synthetic
gccagcccgcccacccaccaaga

SEQ ID NO: 39960 - RNA, 24 nt, Artificial Sequence
  Synthetic
agccagcccgcccacccaccaaga

SEQ ID NO: 39961 - RNA, 18 nt, Artificial Sequence
  Synthetic
ccaagacagggagccaga

SEQ ID NO: 39962 - RNA, 19 nt, Artificial Sequence
  Synthetic
accaagacagggagccaga

SEQ ID NO: 39963 - RNA, 20 nt, Artificial Sequence
  Synthetic
caccaagacagggagccaga

SEQ ID NO: 39964 - RNA, 21 nt, Artificial Sequence
  Synthetic
ccaccaagacagggagccaga

SEQ ID NO: 39965 - RNA, 22 nt, Artificial Sequence
  Synthetic
cccaccaagacagggagccaga

SEQ ID NO: 39966 - RNA, 23 nt, Artificial Sequence
  Synthetic
acccaccaagacagggagccaga

SEQ ID NO: 39967 - RNA, 24 nt, Artificial Sequence
  Synthetic
cacccaccaagacagggagccaga

SEQ ID NO: 39968 - RNA, 18 nt, Artificial Sequence
  Synthetic
cgugcgugcucugcacga

SEQ ID NO: 39969 - RNA, 19 nt, Artificial Sequence
  Synthetic
acgugcgugcucugcacga

SEQ ID NO: 39970 - RNA, 20 nt, Artificial Sequence
  Synthetic
gacgugcgugcucugcacga

SEQ ID NO: 39971 - RNA, 21 nt, Artificial Sequence
  Synthetic
agacgugcgugcucugcacga

SEQ ID NO: 39972 - RNA, 22 nt, Artificial Sequence
  Synthetic
cagacgugcgugcucugcacga

SEQ ID NO: 39973 - RNA, 23 nt, Artificial Sequence
  Synthetic
ccagacgugcgugcucugcacga

SEQ ID NO: 39974 - RNA, 24 nt, Artificial Sequence
  Synthetic
gccagacgugcgugcucugcacga

SEQ ID NO: 39975 - RNA, 18 nt, Artificial Sequence
  Synthetic
cgagcccccucgccccga

SEQ ID NO: 39976 - RNA, 19 nt, Artificial Sequence
  Synthetic
gcgagcccccucgccccga

SEQ ID NO: 39977 - RNA, 20 nt, Artificial Sequence
  Synthetic
cgcgagcccccucgccccga

SEQ ID NO: 39978 - RNA, 21 nt, Artificial Sequence
  Synthetic
gcgcgagcccccucgccccga

SEQ ID NO: 39979 - RNA, 22 nt, Artificial Sequence
  Synthetic
cgcgcgagcccccucgccccga

SEQ ID NO: 39980 - RNA, 23 nt, Artificial Sequence
  Synthetic
acgcgcgagcccccucgccccga

SEQ ID NO: 39981 - RNA, 24 nt, Artificial Sequence
  Synthetic
aacgcgcgagcccccucgccccga

SEQ ID NO: 39982 - RNA, 18 nt, Artificial Sequence
  Synthetic
cagcagcgcgggggccga

SEQ ID NO: 39983 - RNA, 19 nt, Artificial Sequence
  Synthetic
gcagcagcgcgggggccga

SEQ ID NO: 39984 - RNA, 20 nt, Artificial Sequence
  Synthetic
cgcagcagcgcgggggccga

SEQ ID NO: 39985 - RNA, 21 nt, Artificial Sequence
  Synthetic
gcgcagcagcgcgggggccga

SEQ ID NO: 39986 - RNA, 22 nt, Artificial Sequence
  Synthetic
ggcgcagcagcgcgggggccga

SEQ ID NO: 39987 - RNA, 23 nt, Artificial Sequence
  Synthetic
cggcgcagcagcgcgggggccga

SEQ ID NO: 39988 - RNA, 24 nt, Artificial Sequence
  Synthetic
gcggcgcagcagcgcgggggccga

SEQ ID NO: 39989 - RNA, 18 nt, Artificial Sequence
  Synthetic
agaccacggguggcgcga

SEQ ID NO: 39990 - RNA, 19 nt, Artificial Sequence
  Synthetic
gagaccacggguggcgcga

SEQ ID NO: 39991 - RNA, 20 nt, Artificial Sequence
  Synthetic
cgagaccacggguggcgcga

SEQ ID NO: 39992 - RNA, 21 nt, Artificial Sequence
  Synthetic
ccgagaccacggguggcgcga

SEQ ID NO: 39993 - RNA, 22 nt, Artificial Sequence
  Synthetic
cccgagaccacggguggcgcga

SEQ ID NO: 39994 - RNA, 23 nt, Artificial Sequence
  Synthetic
ucccgagaccacggguggcgcga

SEQ ID NO: 39995 - RNA, 24 nt, Artificial Sequence
  Synthetic
cucccgagaccacggguggcgcga

SEQ ID NO: 39996 - RNA, 18 nt, Artificial Sequence
  Synthetic
cgggggccggggccgcua

SEQ ID NO: 39997 - RNA, 19 nt, Artificial Sequence
  Synthetic
ccgggggccggggccgcua

SEQ ID NO: 39998 - RNA, 20 nt, Artificial Sequence
  Synthetic
gccgggggccggggccgcua

SEQ ID NO: 39999 - RNA, 21 nt, Artificial Sequence
  Synthetic
ggccgggggccggggccgcua

SEQ ID NO: 40000 - RNA, 22 nt, Artificial Sequence
  Synthetic
gggccgggggccggggccgcua

SEQ ID NO: 40001 - RNA, 23 nt, Artificial Sequence
  Synthetic
cgggccgggggccggggccgcua

SEQ ID NO: 40002 - RNA, 24 nt, Artificial Sequence
  Synthetic
acgggccgggggccggggccgcua

SEQ ID NO: 40003 - RNA, 18 nt, Artificial Sequence
  Synthetic
cuccccgcagccagggua

SEQ ID NO: 40004 - RNA, 19 nt, Artificial Sequence
  Synthetic
ucuccccgcagccagggua

SEQ ID NO: 40005 - RNA, 20 nt, Artificial Sequence
  Synthetic
gucuccccgcagccagggua

SEQ ID NO: 40006 - RNA, 21 nt, Artificial Sequence
  Synthetic
agucuccccgcagccagggua

SEQ ID NO: 40007 - RNA, 22 nt, Artificial Sequence
  Synthetic
gagucuccccgcagccagggua

SEQ ID NO: 40008 - RNA, 23 nt, Artificial Sequence
  Synthetic
ggagucuccccgcagccagggua

SEQ ID NO: 40009 - RNA, 24 nt, Artificial Sequence
  Synthetic
gggagucuccccgcagccagggua

SEQ ID NO: 40010 - RNA, 18 nt, Artificial Sequence
  Synthetic
gccccccucccugucaac

SEQ ID NO: 40011 - RNA, 19 nt, Artificial Sequence
  Synthetic
ggccccccucccugucaac

SEQ ID NO: 40012 - RNA, 20 nt, Artificial Sequence
  Synthetic
gggccccccucccugucaac

SEQ ID NO: 40013 - RNA, 21 nt, Artificial Sequence
  Synthetic
cgggccccccucccugucaac

SEQ ID NO: 40014 - RNA, 22 nt, Artificial Sequence
  Synthetic
ucgggccccccucccugucaac

SEQ ID NO: 40015 - RNA, 23 nt, Artificial Sequence
  Synthetic
aucgggccccccucccugucaac

SEQ ID NO: 40016 - RNA, 24 nt, Artificial Sequence
  Synthetic
gaucgggccccccucccugucaac

SEQ ID NO: 40017 - RNA, 18 nt, Artificial Sequence
  Synthetic
agggugcggcggcuccac

SEQ ID NO: 40018 - RNA, 19 nt, Artificial Sequence
  Synthetic
cagggugcggcggcuccac

SEQ ID NO: 40019 - RNA, 20 nt, Artificial Sequence
  Synthetic
gcagggugcggcggcuccac

SEQ ID NO: 40020 - RNA, 21 nt, Artificial Sequence
  Synthetic
agcagggugcggcggcuccac

SEQ ID NO: 40021 - RNA, 22 nt, Artificial Sequence
  Synthetic
gagcagggugcggcggcuccac

SEQ ID NO: 40022 - RNA, 23 nt, Artificial Sequence
  Synthetic
ggagcagggugcggcggcuccac

SEQ ID NO: 40023 - RNA, 24 nt, Artificial Sequence
  Synthetic
gggagcagggugcggcggcuccac

SEQ ID NO: 40024 - RNA, 18 nt, Artificial Sequence
  Synthetic
guuccccgucugguccac

SEQ ID NO: 40025 - RNA, 19 nt, Artificial Sequence
  Synthetic
cguuccccgucugguccac

SEQ ID NO: 40026 - RNA, 20 nt, Artificial Sequence
  Synthetic
acguuccccgucugguccac

SEQ ID NO: 40027 - RNA, 21 nt, Artificial Sequence
  Synthetic
cacguuccccgucugguccac

SEQ ID NO: 40028 - RNA, 22 nt, Artificial Sequence
  Synthetic
ccacguuccccgucugguccac

SEQ ID NO: 40029 - RNA, 23 nt, Artificial Sequence
  Synthetic
gccacguuccccgucugguccac

SEQ ID NO: 40030 - RNA, 24 nt, Artificial Sequence
  Synthetic
cgccacguuccccgucugguccac

SEQ ID NO: 40031 - RNA, 18 nt, Artificial Sequence
  Synthetic
ccgcccacccaccaagac

SEQ ID NO: 40032 - RNA, 19 nt, Artificial Sequence
  Synthetic
cccgcccacccaccaagac

SEQ ID NO: 40033 - RNA, 20 nt, Artificial Sequence
  Synthetic
gcccgcccacccaccaagac

SEQ ID NO: 40034 - RNA, 21 nt, Artificial Sequence
  Synthetic
agcccgcccacccaccaagac

SEQ ID NO: 40035 - RNA, 22 nt, Artificial Sequence
  Synthetic
cagcccgcccacccaccaagac

SEQ ID NO: 40036 - RNA, 23 nt, Artificial Sequence
  Synthetic
ccagcccgcccacccaccaagac

SEQ ID NO: 40037 - RNA, 24 nt, Artificial Sequence
  Synthetic
gccagcccgcccacccaccaagac

SEQ ID NO: 40038 - RNA, 18 nt, Artificial Sequence
  Synthetic
aggcuguuccacuccgac

SEQ ID NO: 40039 - RNA, 19 nt, Artificial Sequence
  Synthetic
gaggcuguuccacuccgac

SEQ ID NO: 40040 - RNA, 20 nt, Artificial Sequence
  Synthetic
agaggcuguuccacuccgac

SEQ ID NO: 40041 - RNA, 21 nt, Artificial Sequence
  Synthetic
cagaggcuguuccacuccgac

SEQ ID NO: 40042 - RNA, 22 nt, Artificial Sequence
  Synthetic
ccagaggcuguuccacuccgac

SEQ ID NO: 40043 - RNA, 23 nt, Artificial Sequence
  Synthetic
uccagaggcuguuccacuccgac

SEQ ID NO: 40044 - RNA, 24 nt, Artificial Sequence
  Synthetic
auccagaggcuguuccacuccgac

SEQ ID NO: 40045 - RNA, 18 nt, Artificial Sequence
  Synthetic
gaccacggguggcgcgac

SEQ ID NO: 40046 - RNA, 19 nt, Artificial Sequence
  Synthetic
agaccacggguggcgcgac

SEQ ID NO: 40047 - RNA, 20 nt, Artificial Sequence
  Synthetic
gagaccacggguggcgcgac

SEQ ID NO: 40048 - RNA, 21 nt, Artificial Sequence
  Synthetic
cgagaccacggguggcgcgac

SEQ ID NO: 40049 - RNA, 22 nt, Artificial Sequence
  Synthetic
ccgagaccacggguggcgcgac

SEQ ID NO: 40050 - RNA, 23 nt, Artificial Sequence
  Synthetic
cccgagaccacggguggcgcgac

SEQ ID NO: 40051 - RNA, 24 nt, Artificial Sequence
  Synthetic
ucccgagaccacggguggcgcgac

SEQ ID NO: 40052 - RNA, 18 nt, Artificial Sequence
  Synthetic
cucuccccagcgccggac

SEQ ID NO: 40053 - RNA, 19 nt, Artificial Sequence
  Synthetic
ucucuccccagcgccggac

SEQ ID NO: 40054 - RNA, 20 nt, Artificial Sequence
  Synthetic
gucucuccccagcgccggac

SEQ ID NO: 40055 - RNA, 21 nt, Artificial Sequence
  Synthetic
cgucucuccccagcgccggac

SEQ ID NO: 40056 - RNA, 22 nt, Artificial Sequence
  Synthetic
ucgucucuccccagcgccggac

SEQ ID NO: 40057 - RNA, 23 nt, Artificial Sequence
  Synthetic
cucgucucuccccagcgccggac

SEQ ID NO: 40058 - RNA, 24 nt, Artificial Sequence
  Synthetic
ucucgucucuccccagcgccggac

SEQ ID NO: 40059 - RNA, 18 nt, Artificial Sequence
  Synthetic
uuccucccacccgucccc

SEQ ID NO: 40060 - RNA, 19 nt, Artificial Sequence
  Synthetic
cuuccucccacccgucccc

SEQ ID NO: 40061 - RNA, 20 nt, Artificial Sequence
  Synthetic
ccuuccucccacccgucccc

SEQ ID NO: 40062 - RNA, 21 nt, Artificial Sequence
  Synthetic
uccuuccucccacccgucccc

SEQ ID NO: 40063 - RNA, 22 nt, Artificial Sequence
  Synthetic
cuccuuccucccacccgucccc

SEQ ID NO: 40064 - RNA, 23 nt, Artificial Sequence
  Synthetic
ccuccuuccucccacccgucccc

SEQ ID NO: 40065 - RNA, 24 nt, Artificial Sequence
  Synthetic
uccuccuuccucccacccgucccc

SEQ ID NO: 40066 - RNA, 18 nt, Artificial Sequence
  Synthetic
cccuacuccccguggccc

SEQ ID NO: 40067 - RNA, 19 nt, Artificial Sequence
  Synthetic
ccccuacuccccguggccc

SEQ ID NO: 40068 - RNA, 20 nt, Artificial Sequence
  Synthetic
cccccuacuccccguggccc

SEQ ID NO: 40069 - RNA, 21 nt, Artificial Sequence
  Synthetic
ucccccuacuccccguggccc

SEQ ID NO: 40070 - RNA, 22 nt, Artificial Sequence
  Synthetic
cucccccuacuccccguggccc

SEQ ID NO: 40071 - RNA, 23 nt, Artificial Sequence
  Synthetic
gcucccccuacuccccguggccc

SEQ ID NO: 40072 - RNA, 24 nt, Artificial Sequence
  Synthetic
agcucccccuacuccccguggccc

SEQ ID NO: 40073 - RNA, 18 nt, Artificial Sequence
  Synthetic
ccccaccucccccugccc

SEQ ID NO: 40074 - RNA, 19 nt, Artificial Sequence
  Synthetic
cccccaccucccccugccc

SEQ ID NO: 40075 - RNA, 20 nt, Artificial Sequence
  Synthetic
ccccccaccucccccugccc

SEQ ID NO: 40076 - RNA, 21 nt, Artificial Sequence
  Synthetic
cccccccaccucccccugccc

SEQ ID NO: 40077 - RNA, 22 nt, Artificial Sequence
  Synthetic
ccccccccaccucccccugccc

SEQ ID NO: 40078 - RNA, 23 nt, Artificial Sequence
  Synthetic
cccccccccaccucccccugccc

SEQ ID NO: 40079 - RNA, 24 nt, Artificial Sequence
  Synthetic
ccccccccccaccucccccugccc

SEQ ID NO: 40080 - RNA, 18 nt, Artificial Sequence
  Synthetic
cuuccucccacccguccc

SEQ ID NO: 40081 - RNA, 19 nt, Artificial Sequence
  Synthetic
ccuuccucccacccguccc

SEQ ID NO: 40082 - RNA, 20 nt, Artificial Sequence
  Synthetic
uccuuccucccacccguccc

SEQ ID NO: 40083 - RNA, 21 nt, Artificial Sequence
  Synthetic
cuccuuccucccacccguccc

SEQ ID NO: 40084 - RNA, 22 nt, Artificial Sequence
  Synthetic
ccuccuuccucccacccguccc

SEQ ID NO: 40085 - RNA, 23 nt, Artificial Sequence
  Synthetic
uccuccuuccucccacccguccc

SEQ ID NO: 40086 - RNA, 24 nt, Artificial Sequence
  Synthetic
cuccuccuuccucccacccguccc

SEQ ID NO: 40087 - RNA, 18 nt, Artificial Sequence
  Synthetic
gauaaagaccaacaggcc

SEQ ID NO: 40088 - RNA, 19 nt, Artificial Sequence
  Synthetic
ugauaaagaccaacaggcc

SEQ ID NO: 40089 - RNA, 20 nt, Artificial Sequence
  Synthetic
augauaaagaccaacaggcc

SEQ ID NO: 40090 - RNA, 21 nt, Artificial Sequence
  Synthetic
uaugauaaagaccaacaggcc

SEQ ID NO: 40091 - RNA, 22 nt, Artificial Sequence
  Synthetic
cuaugauaaagaccaacaggcc

SEQ ID NO: 40092 - RNA, 23 nt, Artificial Sequence
  Synthetic
ucuaugauaaagaccaacaggcc

SEQ ID NO: 40093 - RNA, 24 nt, Artificial Sequence
  Synthetic
uucuaugauaaagaccaacaggcc

SEQ ID NO: 40094 - RNA, 18 nt, Artificial Sequence
  Synthetic
guggcgcgaccggaggcc

SEQ ID NO: 40095 - RNA, 19 nt, Artificial Sequence
  Synthetic
gguggcgcgaccggaggcc

SEQ ID NO: 40096 - RNA, 20 nt, Artificial Sequence
  Synthetic
ggguggcgcgaccggaggcc

SEQ ID NO: 40097 - RNA, 21 nt, Artificial Sequence
  Synthetic
cggguggcgcgaccggaggcc

SEQ ID NO: 40098 - RNA, 22 nt, Artificial Sequence
  Synthetic
acggguggcgcgaccggaggcc

SEQ ID NO: 40099 - RNA, 23 nt, Artificial Sequence
  Synthetic
cacggguggcgcgaccggaggcc

SEQ ID NO: 40100 - RNA, 24 nt, Artificial Sequence
  Synthetic
ccacggguggcgcgaccggaggcc

SEQ ID NO: 40101 - RNA, 18 nt, Artificial Sequence
  Synthetic
ggcgccgggucgcgggcc

SEQ ID NO: 40102 - RNA, 19 nt, Artificial Sequence
  Synthetic
gggcgccgggucgcgggcc

SEQ ID NO: 40103 - RNA, 20 nt, Artificial Sequence
  Synthetic
cgggcgccgggucgcgggcc

SEQ ID NO: 40104 - RNA, 21 nt, Artificial Sequence
  Synthetic
ccgggcgccgggucgcgggcc

SEQ ID NO: 40105 - RNA, 22 nt, Artificial Sequence
  Synthetic
gccgggcgccgggucgcgggcc

SEQ ID NO: 40106 - RNA, 23 nt, Artificial Sequence
  Synthetic
ggccgggcgccgggucgcgggcc

SEQ ID NO: 40107 - RNA, 24 nt, Artificial Sequence
  Synthetic
aggccgggcgccgggucgcgggcc

SEQ ID NO: 40108 - RNA, 18 nt, Artificial Sequence
  Synthetic
cgcagcagcgcgggggcc

SEQ ID NO: 40109 - RNA, 19 nt, Artificial Sequence
  Synthetic
gcgcagcagcgcgggggcc

SEQ ID NO: 40110 - RNA, 20 nt, Artificial Sequence
  Synthetic
ggcgcagcagcgcgggggcc

SEQ ID NO: 40111 - RNA, 21 nt, Artificial Sequence
  Synthetic
cggcgcagcagcgcgggggcc

SEQ ID NO: 40112 - RNA, 22 nt, Artificial Sequence
  Synthetic
gcggcgcagcagcgcgggggcc

SEQ ID NO: 40113 - RNA, 23 nt, Artificial Sequence
  Synthetic
cgcggcgcagcagcgcgggggcc

SEQ ID NO: 40114 - RNA, 24 nt, Artificial Sequence
  Synthetic
ccgcggcgcagcagcgcgggggcc

SEQ ID NO: 40115 - RNA, 18 nt, Artificial Sequence
  Synthetic
ccccccccuccucccucc

SEQ ID NO: 40116 - RNA, 19 nt, Artificial Sequence
  Synthetic
cccccccccuccucccucc

SEQ ID NO: 40117 - RNA, 20 nt, Artificial Sequence
  Synthetic
acccccccccuccucccucc

SEQ ID NO: 40118 - RNA, 21 nt, Artificial Sequence
  Synthetic
gacccccccccuccucccucc

SEQ ID NO: 40119 - RNA, 22 nt, Artificial Sequence
  Synthetic
ugacccccccccuccucccucc

SEQ ID NO: 40120 - RNA, 23 nt, Artificial Sequence
  Synthetic
cugacccccccccuccucccucc

SEQ ID NO: 40121 - RNA, 24 nt, Artificial Sequence
  Synthetic
gcugacccccccccuccucccucc

SEQ ID NO: 40122 - RNA, 18 nt, Artificial Sequence
  Synthetic
ccuuccucccacccgucc

SEQ ID NO: 40123 - RNA, 19 nt, Artificial Sequence
  Synthetic
uccuuccucccacccgucc

SEQ ID NO: 40124 - RNA, 20 nt, Artificial Sequence
  Synthetic
cuccuuccucccacccgucc

SEQ ID NO: 40125 - RNA, 21 nt, Artificial Sequence
  Synthetic
ccuccuuccucccacccgucc

SEQ ID NO: 40126 - RNA, 22 nt, Artificial Sequence
  Synthetic
uccuccuuccucccacccgucc

SEQ ID NO: 40127 - RNA, 23 nt, Artificial Sequence
  Synthetic
cuccuccuuccucccacccgucc

SEQ ID NO: 40128 - RNA, 24 nt, Artificial Sequence
  Synthetic
ccuccuccuuccucccacccgucc

SEQ ID NO: 40129 - RNA, 18 nt, Artificial Sequence
  Synthetic
acguuccccgucuggucc

SEQ ID NO: 40130 - RNA, 19 nt, Artificial Sequence
  Synthetic
cacguuccccgucuggucc

SEQ ID NO: 40131 - RNA, 20 nt, Artificial Sequence
  Synthetic
ccacguuccccgucuggucc

SEQ ID NO: 40132 - RNA, 21 nt, Artificial Sequence
  Synthetic
gccacguuccccgucuggucc

SEQ ID NO: 40133 - RNA, 22 nt, Artificial Sequence
  Synthetic
cgccacguuccccgucuggucc

SEQ ID NO: 40134 - RNA, 23 nt, Artificial Sequence
  Synthetic
ccgccacguuccccgucuggucc

SEQ ID NO: 40135 - RNA, 24 nt, Artificial Sequence
  Synthetic
uccgccacguuccccgucuggucc

SEQ ID NO: 40136 - RNA, 18 nt, Artificial Sequence
  Synthetic
cccccgcggcgcagcagc

SEQ ID NO: 40137 - RNA, 19 nt, Artificial Sequence
  Synthetic
gcccccgcggcgcagcagc

SEQ ID NO: 40138 - RNA, 20 nt, Artificial Sequence
  Synthetic
ggcccccgcggcgcagcagc

SEQ ID NO: 40139 - RNA, 21 nt, Artificial Sequence
  Synthetic
cggcccccgcggcgcagcagc

SEQ ID NO: 40140 - RNA, 22 nt, Artificial Sequence
  Synthetic
ucggcccccgcggcgcagcagc

SEQ ID NO: 40141 - RNA, 23 nt, Artificial Sequence
  Synthetic
cucggcccccgcggcgcagcagc

SEQ ID NO: 40142 - RNA, 24 nt, Artificial Sequence
  Synthetic
ccucggcccccgcggcgcagcagc

SEQ ID NO: 40143 - RNA, 18 nt, Artificial Sequence
  Synthetic
cccaccaagacagggagc

SEQ ID NO: 40144 - RNA, 19 nt, Artificial Sequence
  Synthetic
acccaccaagacagggagc

SEQ ID NO: 40145 - RNA, 20 nt, Artificial Sequence
  Synthetic
cacccaccaagacagggagc

SEQ ID NO: 40146 - RNA, 21 nt, Artificial Sequence
  Synthetic
ccacccaccaagacagggagc

SEQ ID NO: 40147 - RNA, 22 nt, Artificial Sequence
  Synthetic
cccacccaccaagacagggagc

SEQ ID NO: 40148 - RNA, 23 nt, Artificial Sequence
  Synthetic
gcccacccaccaagacagggagc

SEQ ID NO: 40149 - RNA, 24 nt, Artificial Sequence
  Synthetic
cgcccacccaccaagacagggagc

SEQ ID NO: 40150 - RNA, 18 nt, Artificial Sequence
  Synthetic
gugugguguugcgaacgc

SEQ ID NO: 40151 - RNA, 19 nt, Artificial Sequence
  Synthetic
ggugugguguugcgaacgc

SEQ ID NO: 40152 - RNA, 20 nt, Artificial Sequence
  Synthetic
uggugugguguugcgaacgc

SEQ ID NO: 40153 - RNA, 21 nt, Artificial Sequence
  Synthetic
guggugugguguugcgaacgc

SEQ ID NO: 40154 - RNA, 22 nt, Artificial Sequence
  Synthetic
uguggugugguguugcgaacgc

SEQ ID NO: 40155 - RNA, 23 nt, Artificial Sequence
  Synthetic
guguggugugguguugcgaacgc

SEQ ID NO: 40156 - RNA, 24 nt, Artificial Sequence
  Synthetic
gguguggugugguguugcgaacgc

SEQ ID NO: 40157 - RNA, 18 nt, Artificial Sequence
  Synthetic
ggugcggcggcuccacgc

SEQ ID NO: 40158 - RNA, 19 nt, Artificial Sequence
  Synthetic
gggugcggcggcuccacgc

SEQ ID NO: 40159 - RNA, 20 nt, Artificial Sequence
  Synthetic
agggugcggcggcuccacgc

SEQ ID NO: 40160 - RNA, 21 nt, Artificial Sequence
  Synthetic
cagggugcggcggcuccacgc

SEQ ID NO: 40161 - RNA, 22 nt, Artificial Sequence
  Synthetic
gcagggugcggcggcuccacgc

SEQ ID NO: 40162 - RNA, 23 nt, Artificial Sequence
  Synthetic
agcagggugcggcggcuccacgc

SEQ ID NO: 40163 - RNA, 24 nt, Artificial Sequence
  Synthetic
gagcagggugcggcggcuccacgc

SEQ ID NO: 40164 - RNA, 18 nt, Artificial Sequence
  Synthetic
gcgccagggccacgacgc

SEQ ID NO: 40165 - RNA, 19 nt, Artificial Sequence
  Synthetic
ggcgccagggccacgacgc

SEQ ID NO: 40166 - RNA, 20 nt, Artificial Sequence
  Synthetic
aggcgccagggccacgacgc

SEQ ID NO: 40167 - RNA, 21 nt, Artificial Sequence
  Synthetic
aaggcgccagggccacgacgc

SEQ ID NO: 40168 - RNA, 22 nt, Artificial Sequence
  Synthetic
uaaggcgccagggccacgacgc

SEQ ID NO: 40169 - RNA, 23 nt, Artificial Sequence
  Synthetic
guaaggcgccagggccacgacgc

SEQ ID NO: 40170 - RNA, 24 nt, Artificial Sequence
  Synthetic
cguaaggcgccagggccacgacgc

SEQ ID NO: 40171 - RNA, 18 nt, Artificial Sequence
  Synthetic
gcuguuccacuccgacgc

SEQ ID NO: 40172 - RNA, 19 nt, Artificial Sequence
  Synthetic
ggcuguuccacuccgacgc

SEQ ID NO: 40173 - RNA, 20 nt, Artificial Sequence
  Synthetic
aggcuguuccacuccgacgc

SEQ ID NO: 40174 - RNA, 21 nt, Artificial Sequence
  Synthetic
gaggcuguuccacuccgacgc

SEQ ID NO: 40175 - RNA, 22 nt, Artificial Sequence
  Synthetic
agaggcuguuccacuccgacgc

SEQ ID NO: 40176 - RNA, 23 nt, Artificial Sequence
  Synthetic
cagaggcuguuccacuccgacgc

SEQ ID NO: 40177 - RNA, 24 nt, Artificial Sequence
  Synthetic
ccagaggcuguuccacuccgacgc

SEQ ID NO: 40178 - RNA, 18 nt, Artificial Sequence
  Synthetic
cuacuccccguggcccgc

SEQ ID NO: 40179 - RNA, 19 nt, Artificial Sequence
  Synthetic
ccuacuccccguggcccgc

SEQ ID NO: 40180 - RNA, 20 nt, Artificial Sequence
  Synthetic
cccuacuccccguggcccgc

SEQ ID NO: 40181 - RNA, 21 nt, Artificial Sequence
  Synthetic
ccccuacuccccguggcccgc

SEQ ID NO: 40182 - RNA, 22 nt, Artificial Sequence
  Synthetic
cccccuacuccccguggcccgc

SEQ ID NO: 40183 - RNA, 23 nt, Artificial Sequence
  Synthetic
ucccccuacuccccguggcccgc

SEQ ID NO: 40184 - RNA, 24 nt, Artificial Sequence
  Synthetic
cucccccuacuccccguggcccgc

SEQ ID NO: 40185 - RNA, 18 nt, Artificial Sequence
  Synthetic
gccgggggccggggccgc

SEQ ID NO: 40186 - RNA, 19 nt, Artificial Sequence
  Synthetic
ggccgggggccggggccgc

SEQ ID NO: 40187 - RNA, 20 nt, Artificial Sequence
  Synthetic
gggccgggggccggggccgc

SEQ ID NO: 40188 - RNA, 21 nt, Artificial Sequence
  Synthetic
cgggccgggggccggggccgc

SEQ ID NO: 40189 - RNA, 22 nt, Artificial Sequence
  Synthetic
acgggccgggggccggggccgc

SEQ ID NO: 40190 - RNA, 23 nt, Artificial Sequence
  Synthetic
aacgggccgggggccggggccgc

SEQ ID NO: 40191 - RNA, 24 nt, Artificial Sequence
  Synthetic
aaacgggccgggggccggggccgc

SEQ ID NO: 40192 - RNA, 18 nt, Artificial Sequence
  Synthetic
cccgcggcgcagcagcgc

SEQ ID NO: 40193 - RNA, 19 nt, Artificial Sequence
  Synthetic
ccccgcggcgcagcagcgc

SEQ ID NO: 40194 - RNA, 20 nt, Artificial Sequence
  Synthetic
cccccgcggcgcagcagcgc

SEQ ID NO: 40195 - RNA, 21 nt, Artificial Sequence
  Synthetic
gcccccgcggcgcagcagcgc

SEQ ID NO: 40196 - RNA, 22 nt, Artificial Sequence
  Synthetic
ggcccccgcggcgcagcagcgc

SEQ ID NO: 40197 - RNA, 23 nt, Artificial Sequence
  Synthetic
cggcccccgcggcgcagcagcgc

SEQ ID NO: 40198 - RNA, 24 nt, Artificial Sequence
  Synthetic
ucggcccccgcggcgcagcagcgc

SEQ ID NO: 40199 - RNA, 18 nt, Artificial Sequence
  Synthetic
gcgaugggcagguagcgc

SEQ ID NO: 40200 - RNA, 19 nt, Artificial Sequence
  Synthetic
cgcgaugggcagguagcgc

SEQ ID NO: 40201 - RNA, 20 nt, Artificial Sequence
  Synthetic
ccgcgaugggcagguagcgc

SEQ ID NO: 40202 - RNA, 21 nt, Artificial Sequence
  Synthetic
cccgcgaugggcagguagcgc

SEQ ID NO: 40203 - RNA, 22 nt, Artificial Sequence
  Synthetic
ccccgcgaugggcagguagcgc

SEQ ID NO: 40204 - RNA, 23 nt, Artificial Sequence
  Synthetic
cccccgcgaugggcagguagcgc

SEQ ID NO: 40205 - RNA, 24 nt, Artificial Sequence
  Synthetic
acccccgcgaugggcagguagcgc

SEQ ID NO: 40206 - RNA, 18 nt, Artificial Sequence
  Synthetic
cuuguucacguaaggcgc

SEQ ID NO: 40207 - RNA, 19 nt, Artificial Sequence
  Synthetic
ucuuguucacguaaggcgc

SEQ ID NO: 40208 - RNA, 20 nt, Artificial Sequence
  Synthetic
gucuuguucacguaaggcgc

SEQ ID NO: 40209 - RNA, 21 nt, Artificial Sequence
  Synthetic
cgucuuguucacguaaggcgc

SEQ ID NO: 40210 - RNA, 22 nt, Artificial Sequence
  Synthetic
ccgucuuguucacguaaggcgc

SEQ ID NO: 40211 - RNA, 23 nt, Artificial Sequence
  Synthetic
accgucuuguucacguaaggcgc

SEQ ID NO: 40212 - RNA, 24 nt, Artificial Sequence
  Synthetic
gaccgucuuguucacguaaggcgc

SEQ ID NO: 40213 - RNA, 18 nt, Artificial Sequence
  Synthetic
ugcgggcggggugggcgc

SEQ ID NO: 40214 - RNA, 19 nt, Artificial Sequence
  Synthetic
gugcgggcggggugggcgc

SEQ ID NO: 40215 - RNA, 20 nt, Artificial Sequence
  Synthetic
ugugcgggcggggugggcgc

SEQ ID NO: 40216 - RNA, 21 nt, Artificial Sequence
  Synthetic
gugugcgggcggggugggcgc

SEQ ID NO: 40217 - RNA, 22 nt, Artificial Sequence
  Synthetic
ggugugcgggcggggugggcgc

SEQ ID NO: 40218 - RNA, 23 nt, Artificial Sequence
  Synthetic
aggugugcgggcggggugggcgc

SEQ ID NO: 40219 - RNA, 24 nt, Artificial Sequence
  Synthetic
caggugugcgggcggggugggcgc

SEQ ID NO: 40220 - RNA, 18 nt, Artificial Sequence
  Synthetic
uccccggccccccugcgc

SEQ ID NO: 40221 - RNA, 19 nt, Artificial Sequence
  Synthetic
auccccggccccccugcgc

SEQ ID NO: 40222 - RNA, 20 nt, Artificial Sequence
  Synthetic
cauccccggccccccugcgc

SEQ ID NO: 40223 - RNA, 21 nt, Artificial Sequence
  Synthetic
ccauccccggccccccugcgc

SEQ ID NO: 40224 - RNA, 22 nt, Artificial Sequence
  Synthetic
cccauccccggccccccugcgc

SEQ ID NO: 40225 - RNA, 23 nt, Artificial Sequence
  Synthetic
ccccauccccggccccccugcgc

SEQ ID NO: 40226 - RNA, 24 nt, Artificial Sequence
  Synthetic
cccccauccccggccccccugcgc

SEQ ID NO: 40227 - RNA, 18 nt, Artificial Sequence
  Synthetic
ucaaguuuucaacaaggc

SEQ ID NO: 40228 - RNA, 19 nt, Artificial Sequence
  Synthetic
cucaaguuuucaacaaggc

SEQ ID NO: 40229 - RNA, 20 nt, Artificial Sequence
  Synthetic
ccucaaguuuucaacaaggc

SEQ ID NO: 40230 - RNA, 21 nt, Artificial Sequence
  Synthetic
uccucaaguuuucaacaaggc

SEQ ID NO: 40231 - RNA, 22 nt, Artificial Sequence
  Synthetic
uuccucaaguuuucaacaaggc

SEQ ID NO: 40232 - RNA, 23 nt, Artificial Sequence
  Synthetic
uuuccucaaguuuucaacaaggc

SEQ ID NO: 40233 - RNA, 24 nt, Artificial Sequence
  Synthetic
uuuuccucaaguuuucaacaaggc

SEQ ID NO: 40234 - RNA, 18 nt, Artificial Sequence
  Synthetic
ggggcgucgccggccggc

SEQ ID NO: 40235 - RNA, 19 nt, Artificial Sequence
  Synthetic
gggggcgucgccggccggc

SEQ ID NO: 40236 - RNA, 20 nt, Artificial Sequence
  Synthetic
cgggggcgucgccggccggc

SEQ ID NO: 40237 - RNA, 21 nt, Artificial Sequence
  Synthetic
gcgggggcgucgccggccggc

SEQ ID NO: 40238 - RNA, 22 nt, Artificial Sequence
  Synthetic
cgcgggggcgucgccggccggc

SEQ ID NO: 40239 - RNA, 23 nt, Artificial Sequence
  Synthetic
ccgcgggggcgucgccggccggc

SEQ ID NO: 40240 - RNA, 24 nt, Artificial Sequence
  Synthetic
cccgcgggggcgucgccggccggc

SEQ ID NO: 40241 - RNA, 18 nt, Artificial Sequence
  Synthetic
gggucgcgggccccgggc

SEQ ID NO: 40242 - RNA, 19 nt, Artificial Sequence
  Synthetic
cgggucgcgggccccgggc

SEQ ID NO: 40243 - RNA, 20 nt, Artificial Sequence
  Synthetic
ccgggucgcgggccccgggc

SEQ ID NO: 40244 - RNA, 21 nt, Artificial Sequence
  Synthetic
gccgggucgcgggccccgggc

SEQ ID NO: 40245 - RNA, 22 nt, Artificial Sequence
  Synthetic
cgccgggucgcgggccccgggc

SEQ ID NO: 40246 - RNA, 23 nt, Artificial Sequence
  Synthetic
gcgccgggucgcgggccccgggc

SEQ ID NO: 40247 - RNA, 24 nt, Artificial Sequence
  Synthetic
ggcgccgggucgcgggccccgggc

SEQ ID NO: 40248 - RNA, 18 nt, Artificial Sequence
  Synthetic
aggaaacgggccgggggc

SEQ ID NO: 40249 - RNA, 19 nt, Artificial Sequence
  Synthetic
aaggaaacgggccgggggc

SEQ ID NO: 40250 - RNA, 20 nt, Artificial Sequence
  Synthetic
gaaggaaacgggccgggggc

SEQ ID NO: 40251 - RNA, 18 nt, Artificial Sequence
  Synthetic
gccggggcgggggugggc

SEQ ID NO: 40252 - RNA, 19 nt, Artificial Sequence
  Synthetic
cgccggggcgggggugggc

SEQ ID NO: 40253 - RNA, 20 nt, Artificial Sequence
  Synthetic
gcgccggggcgggggugggc

SEQ ID NO: 40254 - RNA, 21 nt, Artificial Sequence
  Synthetic
ggcgccggggcgggggugggc

SEQ ID NO: 40255 - RNA, 22 nt, Artificial Sequence
  Synthetic
gggcgccggggcgggggugggc

SEQ ID NO: 40256 - RNA, 23 nt, Artificial Sequence
  Synthetic
ugggcgccggggcgggggugggc

SEQ ID NO: 40257 - RNA, 24 nt, Artificial Sequence
  Synthetic
gugggcgccggggcgggggugggc

SEQ ID NO: 40258 - RNA, 18 nt, Artificial Sequence
  Synthetic
cauccccggccccccugc

SEQ ID NO: 40259 - RNA, 19 nt, Artificial Sequence
  Synthetic
ccauccccggccccccugc

SEQ ID NO: 40260 - RNA, 20 nt, Artificial Sequence
  Synthetic
cccauccccggccccccugc

SEQ ID NO: 40261 - RNA, 21 nt, Artificial Sequence
  Synthetic
ccccauccccggccccccugc

SEQ ID NO: 40262 - RNA, 22 nt, Artificial Sequence
  Synthetic
cccccauccccggccccccugc

SEQ ID NO: 40263 - RNA, 23 nt, Artificial Sequence
  Synthetic
ccccccauccccggccccccugc

SEQ ID NO: 40264 - RNA, 24 nt, Artificial Sequence
  Synthetic
cccccccauccccggccccccugc

SEQ ID NO: 40265 - RNA, 18 nt, Artificial Sequence
  Synthetic
acgcaguugcgcgcgugc

SEQ ID NO: 40266 - RNA, 19 nt, Artificial Sequence
  Synthetic
cacgcaguugcgcgcgugc

SEQ ID NO: 40267 - RNA, 20 nt, Artificial Sequence
  Synthetic
ucacgcaguugcgcgcgugc

SEQ ID NO: 40268 - RNA, 21 nt, Artificial Sequence
  Synthetic
cucacgcaguugcgcgcgugc

SEQ ID NO: 40269 - RNA, 22 nt, Artificial Sequence
  Synthetic
ccucacgcaguugcgcgcgugc

SEQ ID NO: 40270 - RNA, 23 nt, Artificial Sequence
  Synthetic
gccucacgcaguugcgcgcgugc

SEQ ID NO: 40271 - RNA, 24 nt, Artificial Sequence
  Synthetic
ggccucacgcaguugcgcgcgugc

SEQ ID NO: 40272 - RNA, 18 nt, Artificial Sequence
  Synthetic
uugcccaccggggucauc

SEQ ID NO: 40273 - RNA, 19 nt, Artificial Sequence
  Synthetic
guugcccaccggggucauc

SEQ ID NO: 40274 - RNA, 20 nt, Artificial Sequence
  Synthetic
uguugcccaccggggucauc

SEQ ID NO: 40275 - RNA, 21 nt, Artificial Sequence
  Synthetic
auguugcccaccggggucauc

SEQ ID NO: 40276 - RNA, 22 nt, Artificial Sequence
  Synthetic
cauguugcccaccggggucauc

SEQ ID NO: 40277 - RNA, 23 nt, Artificial Sequence
  Synthetic
gcauguugcccaccggggucauc

SEQ ID NO: 40278 - RNA, 24 nt, Artificial Sequence
  Synthetic
agcauguugcccaccggggucauc

SEQ ID NO: 40279 - RNA, 18 nt, Artificial Sequence
  Synthetic
cgcgggcgcgcccugcuc

SEQ ID NO: 40280 - RNA, 19 nt, Artificial Sequence
  Synthetic
gcgcgggcgcgcccugcuc

SEQ ID NO: 40281 - RNA, 20 nt, Artificial Sequence
  Synthetic
ggcgcgggcgcgcccugcuc

SEQ ID NO: 40282 - RNA, 21 nt, Artificial Sequence
  Synthetic
cggcgcgggcgcgcccugcuc

SEQ ID NO: 40283 - RNA, 22 nt, Artificial Sequence
  Synthetic
ccggcgcgggcgcgcccugcuc

SEQ ID NO: 40284 - RNA, 23 nt, Artificial Sequence
  Synthetic
gccggcgcgggcgcgcccugcuc

SEQ ID NO: 40285 - RNA, 24 nt, Artificial Sequence
  Synthetic
ggccggcgcgggcgcgcccugcuc

SEQ ID NO: 40286 - RNA, 18 nt, Artificial Sequence
  Synthetic
gcaguugcgcgcgugcuc

SEQ ID NO: 40287 - RNA, 19 nt, Artificial Sequence
  Synthetic
cgcaguugcgcgcgugcuc

SEQ ID NO: 40288 - RNA, 20 nt, Artificial Sequence
  Synthetic
acgcaguugcgcgcgugcuc

SEQ ID NO: 40289 - RNA, 21 nt, Artificial Sequence
  Synthetic
cacgcaguugcgcgcgugcuc

SEQ ID NO: 40290 - RNA, 22 nt, Artificial Sequence
  Synthetic
ucacgcaguugcgcgcgugcuc

SEQ ID NO: 40291 - RNA, 23 nt, Artificial Sequence
  Synthetic
cucacgcaguugcgcgcgugcuc

SEQ ID NO: 40292 - RNA, 24 nt, Artificial Sequence
  Synthetic
ccucacgcaguugcgcgcgugcuc

SEQ ID NO: 40293 - RNA, 18 nt, Artificial Sequence
  Synthetic
ggggggcgucggguaguc

SEQ ID NO: 40294 - RNA, 19 nt, Artificial Sequence
  Synthetic
cggggggcgucggguaguc

SEQ ID NO: 40295 - RNA, 20 nt, Artificial Sequence
  Synthetic
gcggggggcgucggguaguc

SEQ ID NO: 40296 - RNA, 21 nt, Artificial Sequence
  Synthetic
cgcggggggcgucggguaguc

SEQ ID NO: 40297 - RNA, 22 nt, Artificial Sequence
  Synthetic
acgcggggggcgucggguaguc

SEQ ID NO: 40298 - RNA, 23 nt, Artificial Sequence
  Synthetic
gacgcggggggcgucggguaguc

SEQ ID NO: 40299 - RNA, 24 nt, Artificial Sequence
  Synthetic
cgacgcggggggcgucggguaguc

SEQ ID NO: 40300 - RNA, 18 nt, Artificial Sequence
  Synthetic
gaggccgggcgccggguc

SEQ ID NO: 40301 - RNA, 19 nt, Artificial Sequence
  Synthetic
ugaggccgggcgccggguc

SEQ ID NO: 40302 - RNA, 20 nt, Artificial Sequence
  Synthetic
gugaggccgggcgccggguc

SEQ ID NO: 40303 - RNA, 21 nt, Artificial Sequence
  Synthetic
cgugaggccgggcgccggguc

SEQ ID NO: 40304 - RNA, 22 nt, Artificial Sequence
  Synthetic
gcgugaggccgggcgccggguc

SEQ ID NO: 40305 - RNA, 23 nt, Artificial Sequence
  Synthetic
cgcgugaggccgggcgccggguc

SEQ ID NO: 40306 - RNA, 24 nt, Artificial Sequence
  Synthetic
gcgcgugaggccgggcgccggguc

SEQ ID NO: 40307 - RNA, 18 nt, Artificial Sequence
  Synthetic
guggcccgucuccauguc

SEQ ID NO: 40308 - RNA, 19 nt, Artificial Sequence
  Synthetic
uguggcccgucuccauguc

SEQ ID NO: 40309 - RNA, 20 nt, Artificial Sequence
  Synthetic
auguggcccgucuccauguc

SEQ ID NO: 40310 - RNA, 21 nt, Artificial Sequence
  Synthetic
uauguggcccgucuccauguc

SEQ ID NO: 40311 - RNA, 22 nt, Artificial Sequence
  Synthetic
cuauguggcccgucuccauguc

SEQ ID NO: 40312 - RNA, 23 nt, Artificial Sequence
  Synthetic
ccuauguggcccgucuccauguc

SEQ ID NO: 40313 - RNA, 24 nt, Artificial Sequence
  Synthetic
cccuauguggcccgucuccauguc

SEQ ID NO: 40314 - RNA, 18 nt, Artificial Sequence
  Synthetic
ccccgcagccaggguaag

SEQ ID NO: 40315 - RNA, 19 nt, Artificial Sequence
  Synthetic
uccccgcagccaggguaag

SEQ ID NO: 40316 - RNA, 20 nt, Artificial Sequence
  Synthetic
cuccccgcagccaggguaag

SEQ ID NO: 40317 - RNA, 21 nt, Artificial Sequence
  Synthetic
ucuccccgcagccaggguaag

SEQ ID NO: 40318 - RNA, 22 nt, Artificial Sequence
  Synthetic
gucuccccgcagccaggguaag

SEQ ID NO: 40319 - RNA, 23 nt, Artificial Sequence
  Synthetic
agucuccccgcagccaggguaag

SEQ ID NO: 40320 - RNA, 24 nt, Artificial Sequence
  Synthetic
gagucuccccgcagccaggguaag

SEQ ID NO: 40321 - RNA, 18 nt, Artificial Sequence
  Synthetic
caccagccccgcccgcag

SEQ ID NO: 40322 - RNA, 19 nt, Artificial Sequence
  Synthetic
ccaccagccccgcccgcag

SEQ ID NO: 40323 - RNA, 20 nt, Artificial Sequence
  Synthetic
cccaccagccccgcccgcag

SEQ ID NO: 40324 - RNA, 21 nt, Artificial Sequence
  Synthetic
ucccaccagccccgcccgcag

SEQ ID NO: 40325 - RNA, 22 nt, Artificial Sequence
  Synthetic
cucccaccagccccgcccgcag

SEQ ID NO: 40326 - RNA, 23 nt, Artificial Sequence
  Synthetic
gcucccaccagccccgcccgcag

SEQ ID NO: 40327 - RNA, 24 nt, Artificial Sequence
  Synthetic
cgcucccaccagccccgcccgcag

SEQ ID NO: 40328 - RNA, 18 nt, Artificial Sequence
  Synthetic
ccgcccgcagaggaagag

SEQ ID NO: 40329 - RNA, 19 nt, Artificial Sequence
  Synthetic
cccgcccgcagaggaagag

SEQ ID NO: 40330 - RNA, 20 nt, Artificial Sequence
  Synthetic
ccccgcccgcagaggaagag

SEQ ID NO: 40331 - RNA, 21 nt, Artificial Sequence
  Synthetic
gccccgcccgcagaggaagag

SEQ ID NO: 40332 - RNA, 22 nt, Artificial Sequence
  Synthetic
agccccgcccgcagaggaagag

SEQ ID NO: 40333 - RNA, 23 nt, Artificial Sequence
  Synthetic
cagccccgcccgcagaggaagag

SEQ ID NO: 40334 - RNA, 24 nt, Artificial Sequence
  Synthetic
ccagccccgcccgcagaggaagag

SEQ ID NO: 40335 - RNA, 18 nt, Artificial Sequence
  Synthetic
gaggcggaggaggaggag

SEQ ID NO: 40336 - RNA, 19 nt, Artificial Sequence
  Synthetic
agaggcggaggaggaggag

SEQ ID NO: 40337 - RNA, 20 nt, Artificial Sequence
  Synthetic
aagaggcggaggaggaggag

SEQ ID NO: 40338 - RNA, 21 nt, Artificial Sequence
  Synthetic
gaagaggcggaggaggaggag

SEQ ID NO: 40339 - RNA, 22 nt, Artificial Sequence
  Synthetic
ggaagaggcggaggaggaggag

SEQ ID NO: 40340 - RNA, 23 nt, Artificial Sequence
  Synthetic
aggaagaggcggaggaggaggag

SEQ ID NO: 40341 - RNA, 24 nt, Artificial Sequence
  Synthetic
gaggaagaggcggaggaggaggag

SEQ ID NO: 40342 - RNA, 19 nt, Artificial Sequence
  Synthetic
ggaggcggaggaggaggag

SEQ ID NO: 40343 - RNA, 20 nt, Artificial Sequence
  Synthetic
aggaggcggaggaggaggag

SEQ ID NO: 40344 - RNA, 21 nt, Artificial Sequence
  Synthetic
gaggaggcggaggaggaggag

SEQ ID NO: 40345 - RNA, 22 nt, Artificial Sequence
  Synthetic
ggaggaggcggaggaggaggag

SEQ ID NO: 40346 - RNA, 23 nt, Artificial Sequence
  Synthetic
aggaggaggcggaggaggaggag

SEQ ID NO: 40347 - RNA, 24 nt, Artificial Sequence
  Synthetic
gaggaggaggcggaggaggaggag

SEQ ID NO: 40348 - RNA, 18 nt, Artificial Sequence
  Synthetic
gaggaagaggcggaggag

SEQ ID NO: 40349 - RNA, 19 nt, Artificial Sequence
  Synthetic
agaggaagaggcggaggag

SEQ ID NO: 40350 - RNA, 20 nt, Artificial Sequence
  Synthetic
cagaggaagaggcggaggag

SEQ ID NO: 40351 - RNA, 21 nt, Artificial Sequence
  Synthetic
gcagaggaagaggcggaggag

SEQ ID NO: 40352 - RNA, 22 nt, Artificial Sequence
  Synthetic
cgcagaggaagaggcggaggag

SEQ ID NO: 40353 - RNA, 23 nt, Artificial Sequence
  Synthetic
ccgcagaggaagaggcggaggag

SEQ ID NO: 40354 - RNA, 24 nt, Artificial Sequence
  Synthetic
cccgcagaggaagaggcggaggag

SEQ ID NO: 40355 - RNA, 18 nt, Artificial Sequence
  Synthetic
gaggaggaggcggaggag

SEQ ID NO: 40356 - RNA, 19 nt, Artificial Sequence
  Synthetic
ggaggaggaggcggaggag

SEQ ID NO: 40357 - RNA, 20 nt, Artificial Sequence
  Synthetic
aggaggaggaggcggaggag

SEQ ID NO: 40358 - RNA, 21 nt, Artificial Sequence
  Synthetic
gaggaggaggaggcggaggag

SEQ ID NO: 40359 - RNA, 22 nt, Artificial Sequence
  Synthetic
ggaggaggaggaggcggaggag

SEQ ID NO: 40360 - RNA, 23 nt, Artificial Sequence
  Synthetic
cggaggaggaggaggcggaggag

SEQ ID NO: 40361 - RNA, 24 nt, Artificial Sequence
  Synthetic
gcggaggaggaggaggcggaggag

SEQ ID NO: 40362 - RNA, 18 nt, Artificial Sequence
  Synthetic
gcagaggaagaggcggag

SEQ ID NO: 40363 - RNA, 19 nt, Artificial Sequence
  Synthetic
cgcagaggaagaggcggag

SEQ ID NO: 40364 - RNA, 20 nt, Artificial Sequence
  Synthetic
ccgcagaggaagaggcggag

SEQ ID NO: 40365 - RNA, 21 nt, Artificial Sequence
  Synthetic
cccgcagaggaagaggcggag

SEQ ID NO: 40366 - RNA, 22 nt, Artificial Sequence
  Synthetic
gcccgcagaggaagaggcggag

SEQ ID NO: 40367 - RNA, 23 nt, Artificial Sequence
  Synthetic
cgcccgcagaggaagaggcggag

SEQ ID NO: 40368 - RNA, 24 nt, Artificial Sequence
  Synthetic
ccgcccgcagaggaagaggcggag

SEQ ID NO: 40369 - RNA, 18 nt, Artificial Sequence
  Synthetic
gaggaggaggaggcggag

SEQ ID NO: 40370 - RNA, 19 nt, Artificial Sequence
  Synthetic
ggaggaggaggaggcggag

SEQ ID NO: 40371 - RNA, 20 nt, Artificial Sequence
  Synthetic
cggaggaggaggaggcggag

SEQ ID NO: 40372 - RNA, 21 nt, Artificial Sequence
  Synthetic
gcggaggaggaggaggcggag

SEQ ID NO: 40373 - RNA, 22 nt, Artificial Sequence
  Synthetic
ggcggaggaggaggaggcggag

SEQ ID NO: 40374 - RNA, 23 nt, Artificial Sequence
  Synthetic
aggcggaggaggaggaggcggag

SEQ ID NO: 40375 - RNA, 24 nt, Artificial Sequence
  Synthetic
gaggcggaggaggaggaggcggag

SEQ ID NO: 40376 - RNA, 18 nt, Artificial Sequence
  Synthetic
ucucccagccagggugag

SEQ ID NO: 40377 - RNA, 19 nt, Artificial Sequence
  Synthetic
uucucccagccagggugag

SEQ ID NO: 40378 - RNA, 20 nt, Artificial Sequence
  Synthetic
uuucucccagccagggugag

SEQ ID NO: 40379 - RNA, 21 nt, Artificial Sequence
  Synthetic
cuuucucccagccagggugag

SEQ ID NO: 40380 - RNA, 22 nt, Artificial Sequence
  Synthetic
ccuuucucccagccagggugag

SEQ ID NO: 40381 - RNA, 23 nt, Artificial Sequence
  Synthetic
uccuuucucccagccagggugag

SEQ ID NO: 40382 - RNA, 24 nt, Artificial Sequence
  Synthetic
cuccuuucucccagccagggugag

SEQ ID NO: 40383 - RNA, 18 nt, Artificial Sequence
  Synthetic
gcggggggcgucggguag

SEQ ID NO: 40384 - RNA, 19 nt, Artificial Sequence
  Synthetic
cgcggggggcgucggguag

SEQ ID NO: 40385 - RNA, 20 nt, Artificial Sequence
  Synthetic
acgcggggggcgucggguag

SEQ ID NO: 40386 - RNA, 21 nt, Artificial Sequence
  Synthetic
gacgcggggggcgucggguag

SEQ ID NO: 40387 - RNA, 22 nt, Artificial Sequence
  Synthetic
cgacgcggggggcgucggguag

SEQ ID NO: 40388 - RNA, 23 nt, Artificial Sequence
  Synthetic
ccgacgcggggggcgucggguag

SEQ ID NO: 40389 - RNA, 24 nt, Artificial Sequence
  Synthetic
uccgacgcggggggcgucggguag

SEQ ID NO: 40390 - RNA, 18 nt, Artificial Sequence
  Synthetic
gggugcggcggcuccacg

SEQ ID NO: 40391 - RNA, 19 nt, Artificial Sequence
  Synthetic
agggugcggcggcuccacg

SEQ ID NO: 40392 - RNA, 20 nt, Artificial Sequence
  Synthetic
cagggugcggcggcuccacg

SEQ ID NO: 40393 - RNA, 21 nt, Artificial Sequence
  Synthetic
gcagggugcggcggcuccacg

SEQ ID NO: 40394 - RNA, 22 nt, Artificial Sequence
  Synthetic
agcagggugcggcggcuccacg

SEQ ID NO: 40395 - RNA, 23 nt, Artificial Sequence
  Synthetic
gagcagggugcggcggcuccacg

SEQ ID NO: 40396 - RNA, 24 nt, Artificial Sequence
  Synthetic
ggagcagggugcggcggcuccacg

SEQ ID NO: 40397 - RNA, 18 nt, Artificial Sequence
  Synthetic
ggcuguuccacuccgacg

SEQ ID NO: 40398 - RNA, 19 nt, Artificial Sequence
  Synthetic
aggcuguuccacuccgacg

SEQ ID NO: 40399 - RNA, 20 nt, Artificial Sequence
  Synthetic
gaggcuguuccacuccgacg

SEQ ID NO: 40400 - RNA, 21 nt, Artificial Sequence
  Synthetic
agaggcuguuccacuccgacg

SEQ ID NO: 40401 - RNA, 22 nt, Artificial Sequence
  Synthetic
cagaggcuguuccacuccgacg

SEQ ID NO: 40402 - RNA, 23 nt, Artificial Sequence
  Synthetic
ccagaggcuguuccacuccgacg

SEQ ID NO: 40403 - RNA, 24 nt, Artificial Sequence
  Synthetic
uccagaggcuguuccacuccgacg

SEQ ID NO: 40404 - RNA, 18 nt, Artificial Sequence
  Synthetic
gcgagcccccucgccccg

SEQ ID NO: 40405 - RNA, 19 nt, Artificial Sequence
  Synthetic
cgcgagcccccucgccccg

SEQ ID NO: 40406 - RNA, 20 nt, Artificial Sequence
  Synthetic
gcgcgagcccccucgccccg

SEQ ID NO: 40407 - RNA, 21 nt, Artificial Sequence
  Synthetic
cgcgcgagcccccucgccccg

SEQ ID NO: 40408 - RNA, 22 nt, Artificial Sequence
  Synthetic
acgcgcgagcccccucgccccg

SEQ ID NO: 40409 - RNA, 23 nt, Artificial Sequence
  Synthetic
aacgcgcgagcccccucgccccg

SEQ ID NO: 40410 - RNA, 24 nt, Artificial Sequence
  Synthetic
gaacgcgcgagcccccucgccccg

SEQ ID NO: 40411 - RNA, 18 nt, Artificial Sequence
  Synthetic
ucccaccagccccgcccg

SEQ ID NO: 40412 - RNA, 19 nt, Artificial Sequence
  Synthetic
cucccaccagccccgcccg

SEQ ID NO: 40413 - RNA, 20 nt, Artificial Sequence
  Synthetic
gcucccaccagccccgcccg

SEQ ID NO: 40414 - RNA, 21 nt, Artificial Sequence
  Synthetic
cgcucccaccagccccgcccg

SEQ ID NO: 40415 - RNA, 22 nt, Artificial Sequence
  Synthetic
acgcucccaccagccccgcccg

SEQ ID NO: 40416 - RNA, 23 nt, Artificial Sequence
  Synthetic
gacgcucccaccagccccgcccg

SEQ ID NO: 40417 - RNA, 24 nt, Artificial Sequence
  Synthetic
cgacgcucccaccagccccgcccg

SEQ ID NO: 40418 - RNA, 18 nt, Artificial Sequence
  Synthetic
ccuacuccccguggcccg

SEQ ID NO: 40419 - RNA, 19 nt, Artificial Sequence
  Synthetic
cccuacuccccguggcccg

SEQ ID NO: 40420 - RNA, 20 nt, Artificial Sequence
  Synthetic
ccccuacuccccguggcccg

SEQ ID NO: 40421 - RNA, 21 nt, Artificial Sequence
  Synthetic
cccccuacuccccguggcccg

SEQ ID NO: 40422 - RNA, 22 nt, Artificial Sequence
  Synthetic
ucccccuacuccccguggcccg

SEQ ID NO: 40423 - RNA, 23 nt, Artificial Sequence
  Synthetic
cucccccuacuccccguggcccg

SEQ ID NO: 40424 - RNA, 24 nt, Artificial Sequence
  Synthetic
gcucccccuacuccccguggcccg

SEQ ID NO: 40425 - RNA, 18 nt, Artificial Sequence
  Synthetic
uggcgcgaccggaggccg

SEQ ID NO: 40426 - RNA, 19 nt, Artificial Sequence
  Synthetic
guggcgcgaccggaggccg

SEQ ID NO: 40427 - RNA, 20 nt, Artificial Sequence
  Synthetic
gguggcgcgaccggaggccg

SEQ ID NO: 40428 - RNA, 21 nt, Artificial Sequence
  Synthetic
ggguggcgcgaccggaggccg

SEQ ID NO: 40429 - RNA, 22 nt, Artificial Sequence
  Synthetic
cggguggcgcgaccggaggccg

SEQ ID NO: 40430 - RNA, 23 nt, Artificial Sequence
  Synthetic
acggguggcgcgaccggaggccg

SEQ ID NO: 40431 - RNA, 24 nt, Artificial Sequence
  Synthetic
cacggguggcgcgaccggaggccg

SEQ ID NO: 40432 - RNA, 18 nt, Artificial Sequence
  Synthetic
gcagcagcgcgggggccg

SEQ ID NO: 40433 - RNA, 19 nt, Artificial Sequence
  Synthetic
cgcagcagcgcgggggccg

SEQ ID NO: 40434 - RNA, 20 nt, Artificial Sequence
  Synthetic
gcgcagcagcgcgggggccg

SEQ ID NO: 40435 - RNA, 21 nt, Artificial Sequence
  Synthetic
ggcgcagcagcgcgggggccg

SEQ ID NO: 40436 - RNA, 22 nt, Artificial Sequence
  Synthetic
cggcgcagcagcgcgggggccg

SEQ ID NO: 40437 - RNA, 23 nt, Artificial Sequence
  Synthetic
gcggcgcagcagcgcgggggccg

SEQ ID NO: 40438 - RNA, 24 nt, Artificial Sequence
  Synthetic
cgcggcgcagcagcgcgggggccg

SEQ ID NO: 40439 - RNA, 18 nt, Artificial Sequence
  Synthetic
gccucggccggugguccg

SEQ ID NO: 40440 - RNA, 19 nt, Artificial Sequence
  Synthetic
cgccucggccggugguccg

SEQ ID NO: 40441 - RNA, 20 nt, Artificial Sequence
  Synthetic
gcgccucggccggugguccg

SEQ ID NO: 40442 - RNA, 21 nt, Artificial Sequence
  Synthetic
ggcgccucggccggugguccg

SEQ ID NO: 40443 - RNA, 22 nt, Artificial Sequence
  Synthetic
aggcgccucggccggugguccg

SEQ ID NO: 40444 - RNA, 23 nt, Artificial Sequence
  Synthetic
gaggcgccucggccggugguccg

SEQ ID NO: 40445 - RNA, 24 nt, Artificial Sequence
  Synthetic
cgaggcgccucggccggugguccg

SEQ ID NO: 40446 - RNA, 18 nt, Artificial Sequence
  Synthetic
ucucgucucuccccagcg

SEQ ID NO: 40447 - RNA, 19 nt, Artificial Sequence
  Synthetic
uucucgucucuccccagcg

SEQ ID NO: 40448 - RNA, 20 nt, Artificial Sequence
  Synthetic
uuucucgucucuccccagcg

SEQ ID NO: 40449 - RNA, 21 nt, Artificial Sequence
  Synthetic
guuucucgucucuccccagcg

SEQ ID NO: 40450 - RNA, 22 nt, Artificial Sequence
  Synthetic
gguuucucgucucuccccagcg

SEQ ID NO: 40451 - RNA, 23 nt, Artificial Sequence
  Synthetic
agguuucucgucucuccccagcg

SEQ ID NO: 40452 - RNA, 24 nt, Artificial Sequence
  Synthetic
gagguuucucgucucuccccagcg

SEQ ID NO: 40453 - RNA, 18 nt, Artificial Sequence
  Synthetic
ccccgcggcgcagcagcg

SEQ ID NO: 40454 - RNA, 19 nt, Artificial Sequence
  Synthetic
cccccgcggcgcagcagcg

SEQ ID NO: 40455 - RNA, 20 nt, Artificial Sequence
  Synthetic
gcccccgcggcgcagcagcg

SEQ ID NO: 40456 - RNA, 21 nt, Artificial Sequence
  Synthetic
ggcccccgcggcgcagcagcg

SEQ ID NO: 40457 - RNA, 22 nt, Artificial Sequence
  Synthetic
cggcccccgcggcgcagcagcg

SEQ ID NO: 40458 - RNA, 23 nt, Artificial Sequence
  Synthetic
ucggcccccgcggcgcagcagcg

SEQ ID NO: 40459 - RNA, 24 nt, Artificial Sequence
  Synthetic
cucggcccccgcggcgcagcagcg

SEQ ID NO: 40460 - RNA, 18 nt, Artificial Sequence
  Synthetic
cuguuccacuccgacgcg

SEQ ID NO: 40461 - RNA, 19 nt, Artificial Sequence
  Synthetic
gcuguuccacuccgacgcg

SEQ ID NO: 40462 - RNA, 20 nt, Artificial Sequence
  Synthetic
ggcuguuccacuccgacgcg

SEQ ID NO: 40463 - RNA, 21 nt, Artificial Sequence
  Synthetic
aggcuguuccacuccgacgcg

SEQ ID NO: 40464 - RNA, 22 nt, Artificial Sequence
  Synthetic
gaggcuguuccacuccgacgcg

SEQ ID NO: 40465 - RNA, 23 nt, Artificial Sequence
  Synthetic
agaggcuguuccacuccgacgcg

SEQ ID NO: 40466 - RNA, 24 nt, Artificial Sequence
  Synthetic
cagaggcuguuccacuccgacgcg

SEQ ID NO: 40467 - RNA, 18 nt, Artificial Sequence
  Synthetic
acgcucgagacccccgcg

SEQ ID NO: 40468 - RNA, 19 nt, Artificial Sequence
  Synthetic
gacgcucgagacccccgcg

SEQ ID NO: 40469 - RNA, 20 nt, Artificial Sequence
  Synthetic
cgacgcucgagacccccgcg

SEQ ID NO: 40470 - RNA, 21 nt, Artificial Sequence
  Synthetic
acgacgcucgagacccccgcg

SEQ ID NO: 40471 - RNA, 22 nt, Artificial Sequence
  Synthetic
cacgacgcucgagacccccgcg

SEQ ID NO: 40472 - RNA, 23 nt, Artificial Sequence
  Synthetic
ccacgacgcucgagacccccgcg

SEQ ID NO: 40473 - RNA, 24 nt, Artificial Sequence
  Synthetic
gccacgacgcucgagacccccgcg

SEQ ID NO: 40474 - RNA, 18 nt, Artificial Sequence
  Synthetic
ccccggccccccugcgcg

SEQ ID NO: 40475 - RNA, 19 nt, Artificial Sequence
  Synthetic
uccccggccccccugcgcg

SEQ ID NO: 40476 - RNA, 20 nt, Artificial Sequence
  Synthetic
auccccggccccccugcgcg

SEQ ID NO: 40477 - RNA, 21 nt, Artificial Sequence
  Synthetic
cauccccggccccccugcgcg

SEQ ID NO: 40478 - RNA, 22 nt, Artificial Sequence
  Synthetic
ccauccccggccccccugcgcg

SEQ ID NO: 40479 - RNA, 23 nt, Artificial Sequence
  Synthetic
cccauccccggccccccugcgcg

SEQ ID NO: 40480 - RNA, 24 nt, Artificial Sequence
  Synthetic
ccccauccccggccccccugcgcg

SEQ ID NO: 40481 - RNA, 18 nt, Artificial Sequence
  Synthetic
cccgcagaggaagaggcg

SEQ ID NO: 40482 - RNA, 19 nt, Artificial Sequence
  Synthetic
gcccgcagaggaagaggcg

SEQ ID NO: 40483 - RNA, 20 nt, Artificial Sequence
  Synthetic
cgcccgcagaggaagaggcg

SEQ ID NO: 40484 - RNA, 21 nt, Artificial Sequence
  Synthetic
ccgcccgcagaggaagaggcg

SEQ ID NO: 40485 - RNA, 22 nt, Artificial Sequence
  Synthetic
cccgcccgcagaggaagaggcg

SEQ ID NO: 40486 - RNA, 23 nt, Artificial Sequence
  Synthetic
ccccgcccgcagaggaagaggcg

SEQ ID NO: 40487 - RNA, 24 nt, Artificial Sequence
  Synthetic
gccccgcccgcagaggaagaggcg

SEQ ID NO: 40488 - RNA, 18 nt, Artificial Sequence
  Synthetic
gcggaggaggaggaggcg

SEQ ID NO: 40489 - RNA, 19 nt, Artificial Sequence
  Synthetic
ggcggaggaggaggaggcg

SEQ ID NO: 40490 - RNA, 20 nt, Artificial Sequence
  Synthetic
aggcggaggaggaggaggcg

SEQ ID NO: 40491 - RNA, 21 nt, Artificial Sequence
  Synthetic
gaggcggaggaggaggaggcg

SEQ ID NO: 40492 - RNA, 22 nt, Artificial Sequence
  Synthetic
agaggcggaggaggaggaggcg

SEQ ID NO: 40493 - RNA, 23 nt, Artificial Sequence
  Synthetic
aagaggcggaggaggaggaggcg

SEQ ID NO: 40494 - RNA, 24 nt, Artificial Sequence
  Synthetic
gaagaggcggaggaggaggaggcg

SEQ ID NO: 40495 - RNA, 22 nt, Artificial Sequence
  Synthetic
ggaggcggaggaggaggaggcg

SEQ ID NO: 40496 - RNA, 23 nt, Artificial Sequence
  Synthetic
aggaggcggaggaggaggaggcg

SEQ ID NO: 40497 - RNA, 24 nt, Artificial Sequence
  Synthetic
gaggaggcggaggaggaggaggcg

SEQ ID NO: 40498 - RNA, 18 nt, Artificial Sequence
  Synthetic
gugcgggcggggugggcg

SEQ ID NO: 40499 - RNA, 19 nt, Artificial Sequence
  Synthetic
ugugcgggcggggugggcg

SEQ ID NO: 40500 - RNA, 20 nt, Artificial Sequence
  Synthetic
gugugcgggcggggugggcg

SEQ ID NO: 40501 - RNA, 21 nt, Artificial Sequence
  Synthetic
ggugugcgggcggggugggcg

SEQ ID NO: 40502 - RNA, 22 nt, Artificial Sequence
  Synthetic
aggugugcgggcggggugggcg

SEQ ID NO: 40503 - RNA, 23 nt, Artificial Sequence
  Synthetic
caggugugcgggcggggugggcg

SEQ ID NO: 40504 - RNA, 24 nt, Artificial Sequence
  Synthetic
gcaggugugcgggcggggugggcg

SEQ ID NO: 40505 - RNA, 18 nt, Artificial Sequence
  Synthetic
auccccggccccccugcg

SEQ ID NO: 40506 - RNA, 19 nt, Artificial Sequence
  Synthetic
cauccccggccccccugcg

SEQ ID NO: 40507 - RNA, 20 nt, Artificial Sequence
  Synthetic
ccauccccggccccccugcg

SEQ ID NO: 40508 - RNA, 21 nt, Artificial Sequence
  Synthetic
cccauccccggccccccugcg

SEQ ID NO: 40509 - RNA, 22 nt, Artificial Sequence
  Synthetic
ccccauccccggccccccugcg

SEQ ID NO: 40510 - RNA, 23 nt, Artificial Sequence
  Synthetic
cccccauccccggccccccugcg

SEQ ID NO: 40511 - RNA, 24 nt, Artificial Sequence
  Synthetic
ccccccauccccggccccccugcg

SEQ ID NO: 40512 - RNA, 18 nt, Artificial Sequence
  Synthetic
caguugcgcgcgugcucg

SEQ ID NO: 40513 - RNA, 19 nt, Artificial Sequence
  Synthetic
gcaguugcgcgcgugcucg

SEQ ID NO: 40514 - RNA, 20 nt, Artificial Sequence
  Synthetic
cgcaguugcgcgcgugcucg

SEQ ID NO: 40515 - RNA, 21 nt, Artificial Sequence
  Synthetic
acgcaguugcgcgcgugcucg

SEQ ID NO: 40516 - RNA, 22 nt, Artificial Sequence
  Synthetic
cacgcaguugcgcgcgugcucg

SEQ ID NO: 40517 - RNA, 23 nt, Artificial Sequence
  Synthetic
ucacgcaguugcgcgcgugcucg

SEQ ID NO: 40518 - RNA, 24 nt, Artificial Sequence
  Synthetic
cucacgcaguugcgcgcgugcucg

SEQ ID NO: 40519 - RNA, 18 nt, Artificial Sequence
  Synthetic
gggggcgucggguagucg

SEQ ID NO: 40520 - RNA, 19 nt, Artificial Sequence
  Synthetic
ggggggcgucggguagucg

SEQ ID NO: 40521 - RNA, 20 nt, Artificial Sequence
  Synthetic
cggggggcgucggguagucg

SEQ ID NO: 40522 - RNA, 21 nt, Artificial Sequence
  Synthetic
gcggggggcgucggguagucg

SEQ ID NO: 40523 - RNA, 22 nt, Artificial Sequence
  Synthetic
cgcggggggcgucggguagucg

SEQ ID NO: 40524 - RNA, 23 nt, Artificial Sequence
  Synthetic
acgcggggggcgucggguagucg

SEQ ID NO: 40525 - RNA, 24 nt, Artificial Sequence
  Synthetic
gacgcggggggcgucggguagucg

SEQ ID NO: 40526 - RNA, 18 nt, Artificial Sequence
  Synthetic
cccgcagccaggguaagg

SEQ ID NO: 40527 - RNA, 19 nt, Artificial Sequence
  Synthetic
ccccgcagccaggguaagg

SEQ ID NO: 40528 - RNA, 20 nt, Artificial Sequence
  Synthetic
uccccgcagccaggguaagg

SEQ ID NO: 40529 - RNA, 21 nt, Artificial Sequence
  Synthetic
cuccccgcagccaggguaagg

SEQ ID NO: 40530 - RNA, 22 nt, Artificial Sequence
  Synthetic
ucuccccgcagccaggguaagg

SEQ ID NO: 40531 - RNA, 23 nt, Artificial Sequence
  Synthetic
gucuccccgcagccaggguaagg

SEQ ID NO: 40532 - RNA, 24 nt, Artificial Sequence
  Synthetic
agucuccccgcagccaggguaagg

SEQ ID NO: 40533 - RNA, 18 nt, Artificial Sequence
  Synthetic
uccuuucucccagccagg

SEQ ID NO: 40534 - RNA, 19 nt, Artificial Sequence
  Synthetic
cuccuuucucccagccagg

SEQ ID NO: 40535 - RNA, 20 nt, Artificial Sequence
  Synthetic
ccuccuuucucccagccagg

SEQ ID NO: 40536 - RNA, 21 nt, Artificial Sequence
  Synthetic
uccuccuuucucccagccagg

SEQ ID NO: 40537 - RNA, 22 nt, Artificial Sequence
  Synthetic
cuccuccuuucucccagccagg

SEQ ID NO: 40538 - RNA, 23 nt, Artificial Sequence
  Synthetic
ccuccuccuuucucccagccagg

SEQ ID NO: 40539 - RNA, 24 nt, Artificial Sequence
  Synthetic
uccuccuccuuucucccagccagg

SEQ ID NO: 40540 - RNA, 18 nt, Artificial Sequence
  Synthetic
cccgucuccauguccagg

SEQ ID NO: 40541 - RNA, 19 nt, Artificial Sequence
  Synthetic
gcccgucuccauguccagg

SEQ ID NO: 40542 - RNA, 20 nt, Artificial Sequence
  Synthetic
ggcccgucuccauguccagg

SEQ ID NO: 40543 - RNA, 21 nt, Artificial Sequence
  Synthetic
uggcccgucuccauguccagg

SEQ ID NO: 40544 - RNA, 22 nt, Artificial Sequence
  Synthetic
guggcccgucuccauguccagg

SEQ ID NO: 40545 - RNA, 23 nt, Artificial Sequence
  Synthetic
uguggcccgucuccauguccagg

SEQ ID NO: 40546 - RNA, 24 nt, Artificial Sequence
  Synthetic
auguggcccgucuccauguccagg

SEQ ID NO: 40547 - RNA, 18 nt, Artificial Sequence
  Synthetic
cgcccgcagaggaagagg

SEQ ID NO: 40548 - RNA, 19 nt, Artificial Sequence
  Synthetic
ccgcccgcagaggaagagg

SEQ ID NO: 40549 - RNA, 20 nt, Artificial Sequence
  Synthetic
cccgcccgcagaggaagagg

SEQ ID NO: 40550 - RNA, 21 nt, Artificial Sequence
  Synthetic
ccccgcccgcagaggaagagg

SEQ ID NO: 40551 - RNA, 22 nt, Artificial Sequence
  Synthetic
gccccgcccgcagaggaagagg

SEQ ID NO: 40552 - RNA, 23 nt, Artificial Sequence
  Synthetic
agccccgcccgcagaggaagagg

SEQ ID NO: 40553 - RNA, 24 nt, Artificial Sequence
  Synthetic
cagccccgcccgcagaggaagagg

SEQ ID NO: 40554 - RNA, 18 nt, Artificial Sequence
  Synthetic
cagccccgcccgcagagg

SEQ ID NO: 40555 - RNA, 19 nt, Artificial Sequence
  Synthetic
ccagccccgcccgcagagg

SEQ ID NO: 40556 - RNA, 20 nt, Artificial Sequence
  Synthetic
accagccccgcccgcagagg

SEQ ID NO: 40557 - RNA, 21 nt, Artificial Sequence
  Synthetic
caccagccccgcccgcagagg

SEQ ID NO: 40558 - RNA, 22 nt, Artificial Sequence
  Synthetic
ccaccagccccgcccgcagagg

SEQ ID NO: 40559 - RNA, 23 nt, Artificial Sequence
  Synthetic
cccaccagccccgcccgcagagg

SEQ ID NO: 40560 - RNA, 24 nt, Artificial Sequence
  Synthetic
ucccaccagccccgcccgcagagg

SEQ ID NO: 40561 - RNA, 18 nt, Artificial Sequence
  Synthetic
cagggagccagaacgagg

SEQ ID NO: 40562 - RNA, 19 nt, Artificial Sequence
  Synthetic
acagggagccagaacgagg

SEQ ID NO: 40563 - RNA, 20 nt, Artificial Sequence
  Synthetic
gacagggagccagaacgagg

SEQ ID NO: 40564 - RNA, 21 nt, Artificial Sequence
  Synthetic
agacagggagccagaacgagg

SEQ ID NO: 40565 - RNA, 22 nt, Artificial Sequence
  Synthetic
aagacagggagccagaacgagg

SEQ ID NO: 40566 - RNA, 23 nt, Artificial Sequence
  Synthetic
caagacagggagccagaacgagg

SEQ ID NO: 40567 - RNA, 24 nt, Artificial Sequence
  Synthetic
ccaagacagggagccagaacgagg

SEQ ID NO: 40568 - RNA, 18 nt, Artificial Sequence
  Synthetic
aggcggaggaggaggagg

SEQ ID NO: 40569 - RNA, 19 nt, Artificial Sequence
  Synthetic
gaggcggaggaggaggagg

SEQ ID NO: 40570 - RNA, 20 nt, Artificial Sequence
  Synthetic
agaggcggaggaggaggagg

SEQ ID NO: 40571 - RNA, 21 nt, Artificial Sequence
  Synthetic
aagaggcggaggaggaggagg

SEQ ID NO: 40572 - RNA, 22 nt, Artificial Sequence
  Synthetic
gaagaggcggaggaggaggagg

SEQ ID NO: 40573 - RNA, 23 nt, Artificial Sequence
  Synthetic
ggaagaggcggaggaggaggagg

SEQ ID NO: 40574 - RNA, 24 nt, Artificial Sequence
  Synthetic
aggaagaggcggaggaggaggagg

SEQ ID NO: 40575 - RNA, 20 nt, Artificial Sequence
  Synthetic
ggaggcggaggaggaggagg

SEQ ID NO: 40576 - RNA, 21 nt, Artificial Sequence
  Synthetic
aggaggcggaggaggaggagg

SEQ ID NO: 40577 - RNA, 22 nt, Artificial Sequence
  Synthetic
gaggaggcggaggaggaggagg

SEQ ID NO: 40578 - RNA, 23 nt, Artificial Sequence
  Synthetic
ggaggaggcggaggaggaggagg

SEQ ID NO: 40579 - RNA, 24 nt, Artificial Sequence
  Synthetic
aggaggaggcggaggaggaggagg

SEQ ID NO: 40580 - RNA, 18 nt, Artificial Sequence
  Synthetic
aggaagaggcggaggagg

SEQ ID NO: 40581 - RNA, 19 nt, Artificial Sequence
  Synthetic
gaggaagaggcggaggagg

SEQ ID NO: 40582 - RNA, 20 nt, Artificial Sequence
  Synthetic
agaggaagaggcggaggagg

SEQ ID NO: 40583 - RNA, 21 nt, Artificial Sequence
  Synthetic
cagaggaagaggcggaggagg

SEQ ID NO: 40584 - RNA, 22 nt, Artificial Sequence
  Synthetic
gcagaggaagaggcggaggagg

SEQ ID NO: 40585 - RNA, 23 nt, Artificial Sequence
  Synthetic
cgcagaggaagaggcggaggagg

SEQ ID NO: 40586 - RNA, 24 nt, Artificial Sequence
  Synthetic
ccgcagaggaagaggcggaggagg

SEQ ID NO: 40587 - RNA, 18 nt, Artificial Sequence
  Synthetic
aggaggaggcggaggagg

SEQ ID NO: 40588 - RNA, 19 nt, Artificial Sequence
  Synthetic
gaggaggaggcggaggagg

SEQ ID NO: 40589 - RNA, 20 nt, Artificial Sequence
  Synthetic
ggaggaggaggcggaggagg

SEQ ID NO: 40590 - RNA, 21 nt, Artificial Sequence
  Synthetic
aggaggaggaggcggaggagg

SEQ ID NO: 40591 - RNA, 22 nt, Artificial Sequence
  Synthetic
gaggaggaggaggcggaggagg

SEQ ID NO: 40592 - RNA, 23 nt, Artificial Sequence
  Synthetic
ggaggaggaggaggcggaggagg

SEQ ID NO: 40593 - RNA, 24 nt, Artificial Sequence
  Synthetic
cggaggaggaggaggcggaggagg

SEQ ID NO: 40594 - RNA, 18 nt, Artificial Sequence
  Synthetic
cagaggaagaggcggagg

SEQ ID NO: 40595 - RNA, 19 nt, Artificial Sequence
  Synthetic
gcagaggaagaggcggagg

SEQ ID NO: 40596 - RNA, 20 nt, Artificial Sequence
  Synthetic
cgcagaggaagaggcggagg

SEQ ID NO: 40597 - RNA, 21 nt, Artificial Sequence
  Synthetic
ccgcagaggaagaggcggagg

SEQ ID NO: 40598 - RNA, 22 nt, Artificial Sequence
  Synthetic
cccgcagaggaagaggcggagg

SEQ ID NO: 40599 - RNA, 23 nt, Artificial Sequence
  Synthetic
gcccgcagaggaagaggcggagg

SEQ ID NO: 40600 - RNA, 24 nt, Artificial Sequence
  Synthetic
cgcccgcagaggaagaggcggagg

SEQ ID NO: 40601 - RNA, 18 nt, Artificial Sequence
  Synthetic
aggaggaggaggcggagg

SEQ ID NO: 40602 - RNA, 19 nt, Artificial Sequence
  Synthetic
gaggaggaggaggcggagg

SEQ ID NO: 40603 - RNA, 20 nt, Artificial Sequence
  Synthetic
ggaggaggaggaggcggagg

SEQ ID NO: 40604 - RNA, 21 nt, Artificial Sequence
  Synthetic
cggaggaggaggaggcggagg

SEQ ID NO: 40605 - RNA, 22 nt, Artificial Sequence
  Synthetic
gcggaggaggaggaggcggagg

SEQ ID NO: 40606 - RNA, 23 nt, Artificial Sequence
  Synthetic
ggcggaggaggaggaggcggagg

SEQ ID NO: 40607 - RNA, 24 nt, Artificial Sequence
  Synthetic
aggcggaggaggaggaggcggagg

SEQ ID NO: 40608 - RNA, 18 nt, Artificial Sequence
  Synthetic
ggcagguagcgcgugagg

SEQ ID NO: 40609 - RNA, 19 nt, Artificial Sequence
  Synthetic
gggcagguagcgcgugagg

SEQ ID NO: 40610 - RNA, 20 nt, Artificial Sequence
  Synthetic
ugggcagguagcgcgugagg

SEQ ID NO: 40611 - RNA, 21 nt, Artificial Sequence
  Synthetic
augggcagguagcgcgugagg

SEQ ID NO: 40612 - RNA, 22 nt, Artificial Sequence
  Synthetic
gaugggcagguagcgcgugagg

SEQ ID NO: 40613 - RNA, 23 nt, Artificial Sequence
  Synthetic
cgaugggcagguagcgcgugagg

SEQ ID NO: 40614 - RNA, 24 nt, Artificial Sequence
  Synthetic
gcgaugggcagguagcgcgugagg

SEQ ID NO: 40615 - RNA, 18 nt, Artificial Sequence
  Synthetic
cucccagccagggugagg

SEQ ID NO: 40616 - RNA, 19 nt, Artificial Sequence
  Synthetic
ucucccagccagggugagg

SEQ ID NO: 40617 - RNA, 20 nt, Artificial Sequence
  Synthetic
uucucccagccagggugagg

SEQ ID NO: 40618 - RNA, 21 nt, Artificial Sequence
  Synthetic
uuucucccagccagggugagg

SEQ ID NO: 40619 - RNA, 22 nt, Artificial Sequence
  Synthetic
cuuucucccagccagggugagg

SEQ ID NO: 40620 - RNA, 23 nt, Artificial Sequence
  Synthetic
ccuuucucccagccagggugagg

SEQ ID NO: 40621 - RNA, 24 nt, Artificial Sequence
  Synthetic
uccuuucucccagccagggugagg

SEQ ID NO: 40622 - RNA, 18 nt, Artificial Sequence
  Synthetic
ccucggccggugguccgg

SEQ ID NO: 40623 - RNA, 19 nt, Artificial Sequence
  Synthetic
gccucggccggugguccgg

SEQ ID NO: 40624 - RNA, 20 nt, Artificial Sequence
  Synthetic
cgccucggccggugguccgg

SEQ ID NO: 40625 - RNA, 21 nt, Artificial Sequence
  Synthetic
gcgccucggccggugguccgg

SEQ ID NO: 40626 - RNA, 22 nt, Artificial Sequence
  Synthetic
ggcgccucggccggugguccgg

SEQ ID NO: 40627 - RNA, 23 nt, Artificial Sequence
  Synthetic
aggcgccucggccggugguccgg

SEQ ID NO: 40628 - RNA, 24 nt, Artificial Sequence
  Synthetic
gaggcgccucggccggugguccgg

SEQ ID NO: 40629 - RNA, 18 nt, Artificial Sequence
  Synthetic
cccggccccccugcgcgg

SEQ ID NO: 40630 - RNA, 19 nt, Artificial Sequence
  Synthetic
ccccggccccccugcgcgg

SEQ ID NO: 40631 - RNA, 20 nt, Artificial Sequence
  Synthetic
uccccggccccccugcgcgg

SEQ ID NO: 40632 - RNA, 21 nt, Artificial Sequence
  Synthetic
auccccggccccccugcgcgg

SEQ ID NO: 40633 - RNA, 22 nt, Artificial Sequence
  Synthetic
cauccccggccccccugcgcgg

SEQ ID NO: 40634 - RNA, 23 nt, Artificial Sequence
  Synthetic
ccauccccggccccccugcgcgg

SEQ ID NO: 40635 - RNA, 24 nt, Artificial Sequence
  Synthetic
cccauccccggccccccugcgcgg

SEQ ID NO: 40636 - RNA, 18 nt, Artificial Sequence
  Synthetic
ccgcagaggaagaggcgg

SEQ ID NO: 40637 - RNA, 19 nt, Artificial Sequence
  Synthetic
cccgcagaggaagaggcgg

SEQ ID NO: 40638 - RNA, 20 nt, Artificial Sequence
  Synthetic
gcccgcagaggaagaggcgg

SEQ ID NO: 40639 - RNA, 21 nt, Artificial Sequence
  Synthetic
cgcccgcagaggaagaggcgg

SEQ ID NO: 40640 - RNA, 22 nt, Artificial Sequence
  Synthetic
ccgcccgcagaggaagaggcgg

SEQ ID NO: 40641 - RNA, 23 nt, Artificial Sequence
  Synthetic
cccgcccgcagaggaagaggcgg

SEQ ID NO: 40642 - RNA, 24 nt, Artificial Sequence
  Synthetic
ccccgcccgcagaggaagaggcgg

SEQ ID NO: 40643 - RNA, 18 nt, Artificial Sequence
  Synthetic
cggaggaggaggaggcgg

SEQ ID NO: 40644 - RNA, 19 nt, Artificial Sequence
  Synthetic
gcggaggaggaggaggcgg

SEQ ID NO: 40645 - RNA, 20 nt, Artificial Sequence
  Synthetic
ggcggaggaggaggaggcgg

SEQ ID NO: 40646 - RNA, 21 nt, Artificial Sequence
  Synthetic
aggcggaggaggaggaggcgg

SEQ ID NO: 40647 - RNA, 22 nt, Artificial Sequence
  Synthetic
gaggcggaggaggaggaggcgg

SEQ ID NO: 40648 - RNA, 23 nt, Artificial Sequence
  Synthetic
agaggcggaggaggaggaggcgg

SEQ ID NO: 40649 - RNA, 24 nt, Artificial Sequence
  Synthetic
aagaggcggaggaggaggaggcgg

SEQ ID NO: 40650 - RNA, 23 nt, Artificial Sequence
  Synthetic
ggaggcggaggaggaggaggcgg

SEQ ID NO: 40651 - RNA, 24 nt, Artificial Sequence
  Synthetic
aggaggcggaggaggaggaggcgg

SEQ ID NO: 40652 - RNA, 18 nt, Artificial Sequence
  Synthetic
uggcgggcaggugugcgg

SEQ ID NO: 40653 - RNA, 19 nt, Artificial Sequence
  Synthetic
guggcgggcaggugugcgg

SEQ ID NO: 40654 - RNA, 20 nt, Artificial Sequence
  Synthetic
cguggcgggcaggugugcgg

SEQ ID NO: 40655 - RNA, 21 nt, Artificial Sequence
  Synthetic
gcguggcgggcaggugugcgg

SEQ ID NO: 40656 - RNA, 22 nt, Artificial Sequence
  Synthetic
ggcguggcgggcaggugugcgg

SEQ ID NO: 40657 - RNA, 23 nt, Artificial Sequence
  Synthetic
gggcguggcgggcaggugugcgg

SEQ ID NO: 40658 - RNA, 24 nt, Artificial Sequence
  Synthetic
cgggcguggcgggcaggugugcgg

SEQ ID NO: 40659 - RNA, 18 nt, Artificial Sequence
  Synthetic
cagccaggguaaggaggg

SEQ ID NO: 40660 - RNA, 19 nt, Artificial Sequence
  Synthetic
gcagccaggguaaggaggg

SEQ ID NO: 40661 - RNA, 20 nt, Artificial Sequence
  Synthetic
cgcagccaggguaaggaggg

SEQ ID NO: 40662 - RNA, 21 nt, Artificial Sequence
  Synthetic
ccgcagccaggguaaggaggg

SEQ ID NO: 40663 - RNA, 22 nt, Artificial Sequence
  Synthetic
cccgcagccaggguaaggaggg

SEQ ID NO: 40664 - RNA, 23 nt, Artificial Sequence
  Synthetic
ccccgcagccaggguaaggaggg

SEQ ID NO: 40665 - RNA, 24 nt, Artificial Sequence
  Synthetic
uccccgcagccaggguaaggaggg

SEQ ID NO: 40666 - RNA, 18 nt, Artificial Sequence
  Synthetic
cagccagggugaggaggg

SEQ ID NO: 40667 - RNA, 19 nt, Artificial Sequence
  Synthetic
ccagccagggugaggaggg

SEQ ID NO: 40668 - RNA, 20 nt, Artificial Sequence
  Synthetic
cccagccagggugaggaggg

SEQ ID NO: 40669 - RNA, 21 nt, Artificial Sequence
  Synthetic
ucccagccagggugaggaggg

SEQ ID NO: 40670 - RNA, 22 nt, Artificial Sequence
  Synthetic
cucccagccagggugaggaggg

SEQ ID NO: 40671 - RNA, 23 nt, Artificial Sequence
  Synthetic
ucucccagccagggugaggaggg

SEQ ID NO: 40672 - RNA, 24 nt, Artificial Sequence
  Synthetic
uucucccagccagggugaggaggg

SEQ ID NO: 40673 - RNA, 18 nt, Artificial Sequence
  Synthetic
ggcggggugggcgccggg

SEQ ID NO: 40674 - RNA, 19 nt, Artificial Sequence
  Synthetic
gggcggggugggcgccggg

SEQ ID NO: 40675 - RNA, 20 nt, Artificial Sequence
  Synthetic
cgggcggggugggcgccggg

SEQ ID NO: 40676 - RNA, 21 nt, Artificial Sequence
  Synthetic
gcgggcggggugggcgccggg

SEQ ID NO: 40677 - RNA, 22 nt, Artificial Sequence
  Synthetic
ugcgggcggggugggcgccggg

SEQ ID NO: 40678 - RNA, 23 nt, Artificial Sequence
  Synthetic
gugcgggcggggugggcgccggg

SEQ ID NO: 40679 - RNA, 24 nt, Artificial Sequence
  Synthetic
ugugcgggcggggugggcgccggg

SEQ ID NO: 40680 - RNA, 18 nt, Artificial Sequence
  Synthetic
ggcaggugugcgggcggg

SEQ ID NO: 40681 - RNA, 19 nt, Artificial Sequence
  Synthetic
gggcaggugugcgggcggg

SEQ ID NO: 40682 - RNA, 20 nt, Artificial Sequence
  Synthetic
cgggcaggugugcgggcggg

SEQ ID NO: 40683 - RNA, 21 nt, Artificial Sequence
  Synthetic
gcgggcaggugugcgggcggg

SEQ ID NO: 40684 - RNA, 22 nt, Artificial Sequence
  Synthetic
ggcgggcaggugugcgggcggg

SEQ ID NO: 40685 - RNA, 23 nt, Artificial Sequence
  Synthetic
uggcgggcaggugugcgggcggg

SEQ ID NO: 40686 - RNA, 24 nt, Artificial Sequence
  Synthetic
guggcgggcaggugugcgggcggg

SEQ ID NO: 40687 - RNA, 18 nt, Artificial Sequence
  Synthetic
gcggggugggcgccgggg

SEQ ID NO: 40688 - RNA, 19 nt, Artificial Sequence
  Synthetic
ggcggggugggcgccgggg

SEQ ID NO: 40689 - RNA, 20 nt, Artificial Sequence
  Synthetic
gggcggggugggcgccgggg

SEQ ID NO: 40690 - RNA, 21 nt, Artificial Sequence
  Synthetic
cgggcggggugggcgccgggg

SEQ ID NO: 40691 - RNA, 22 nt, Artificial Sequence
  Synthetic
gcgggcggggugggcgccgggg

SEQ ID NO: 40692 - RNA, 23 nt, Artificial Sequence
  Synthetic
ugcgggcggggugggcgccgggg

SEQ ID NO: 40693 - RNA, 24 nt, Artificial Sequence
  Synthetic
gugcgggcggggugggcgccgggg

SEQ ID NO: 40694 - RNA, 18 nt, Artificial Sequence
  Synthetic
gugggcgccggggcgggg

SEQ ID NO: 40695 - RNA, 19 nt, Artificial Sequence
  Synthetic
ggugggcgccggggcgggg

SEQ ID NO: 40696 - RNA, 20 nt, Artificial Sequence
  Synthetic
gggugggcgccggggcgggg

SEQ ID NO: 40697 - RNA, 21 nt, Artificial Sequence
  Synthetic
ggggugggcgccggggcgggg

SEQ ID NO: 40698 - RNA, 22 nt, Artificial Sequence
  Synthetic
cggggugggcgccggggcgggg

SEQ ID NO: 40699 - RNA, 23 nt, Artificial Sequence
  Synthetic
gcggggugggcgccggggcgggg

SEQ ID NO: 40700 - RNA, 24 nt, Artificial Sequence
  Synthetic
ggcggggugggcgccggggcgggg

SEQ ID NO: 40701 - RNA, 18 nt, Artificial Sequence
  Synthetic
gaccaacaggccucgggg

SEQ ID NO: 40702 - RNA, 19 nt, Artificial Sequence
  Synthetic
agaccaacaggccucgggg

SEQ ID NO: 40703 - RNA, 20 nt, Artificial Sequence
  Synthetic
aagaccaacaggccucgggg

SEQ ID NO: 40704 - RNA, 21 nt, Artificial Sequence
  Synthetic
aaagaccaacaggccucgggg

SEQ ID NO: 40705 - RNA, 22 nt, Artificial Sequence
  Synthetic
uaaagaccaacaggccucgggg

SEQ ID NO: 40706 - RNA, 23 nt, Artificial Sequence
  Synthetic
auaaagaccaacaggccucgggg

SEQ ID NO: 40707 - RNA, 24 nt, Artificial Sequence
  Synthetic
gauaaagaccaacaggccucgggg

SEQ ID NO: 40708 - RNA, 18 nt, Artificial Sequence
  Synthetic
cccacccguccccggggg

SEQ ID NO: 40709 - RNA, 19 nt, Artificial Sequence
  Synthetic
ucccacccguccccggggg

SEQ ID NO: 40710 - RNA, 20 nt, Artificial Sequence
  Synthetic
cucccacccguccccggggg

SEQ ID NO: 40711 - RNA, 21 nt, Artificial Sequence
  Synthetic
ccucccacccguccccggggg

SEQ ID NO: 40712 - RNA, 22 nt, Artificial Sequence
  Synthetic
uccucccacccguccccggggg

SEQ ID NO: 40713 - RNA, 23 nt, Artificial Sequence
  Synthetic
uuccucccacccguccccggggg

SEQ ID NO: 40714 - RNA, 24 nt, Artificial Sequence
  Synthetic
cuuccucccacccguccccggggg

SEQ ID NO: 40715 - RNA, 18 nt, Artificial Sequence
  Synthetic
aaggaaacgggccggggg

SEQ ID NO: 40716 - RNA, 19 nt, Artificial Sequence
  Synthetic
gaaggaaacgggccggggg

SEQ ID NO: 40717 - RNA, 20 nt, Artificial Sequence
  Synthetic
ggaaggaaacgggccggggg

SEQ ID NO: 40718 - RNA, 18 nt, Artificial Sequence
  Synthetic
ggcgcagcagcgcggggg

SEQ ID NO: 40719 - RNA, 19 nt, Artificial Sequence
  Synthetic
cggcgcagcagcgcggggg

SEQ ID NO: 40720 - RNA, 20 nt, Artificial Sequence
  Synthetic
gcggcgcagcagcgcggggg

SEQ ID NO: 40721 - RNA, 21 nt, Artificial Sequence
  Synthetic
cgcggcgcagcagcgcggggg

SEQ ID NO: 40722 - RNA, 22 nt, Artificial Sequence
  Synthetic
ccgcggcgcagcagcgcggggg

SEQ ID NO: 40723 - RNA, 23 nt, Artificial Sequence
  Synthetic
cccgcggcgcagcagcgcggggg

SEQ ID NO: 40724 - RNA, 24 nt, Artificial Sequence
  Synthetic
ccccgcggcgcagcagcgcggggg

SEQ ID NO: 40725 - RNA, 18 nt, Artificial Sequence
  Synthetic
accaacaggccucggggg

SEQ ID NO: 40726 - RNA, 19 nt, Artificial Sequence
  Synthetic
gaccaacaggccucggggg

SEQ ID NO: 40727 - RNA, 20 nt, Artificial Sequence
  Synthetic
agaccaacaggccucggggg

SEQ ID NO: 40728 - RNA, 21 nt, Artificial Sequence
  Synthetic
aagaccaacaggccucggggg

SEQ ID NO: 40729 - RNA, 22 nt, Artificial Sequence
  Synthetic
aaagaccaacaggccucggggg

SEQ ID NO: 40730 - RNA, 23 nt, Artificial Sequence
  Synthetic
uaaagaccaacaggccucggggg

SEQ ID NO: 40731 - RNA, 24 nt, Artificial Sequence
  Synthetic
auaaagaccaacaggccucggggg

SEQ ID NO: 40732 - RNA, 18 nt, Artificial Sequence
  Synthetic
uaaggaggggcgggcgug

SEQ ID NO: 40733 - RNA, 19 nt, Artificial Sequence
  Synthetic
guaaggaggggcgggcgug

SEQ ID NO: 40734 - RNA, 20 nt, Artificial Sequence
  Synthetic
gguaaggaggggcgggcgug

SEQ ID NO: 40735 - RNA, 21 nt, Artificial Sequence
  Synthetic
ggguaaggaggggcgggcgug

SEQ ID NO: 40736 - RNA, 22 nt, Artificial Sequence
  Synthetic
aggguaaggaggggcgggcgug

SEQ ID NO: 40737 - RNA, 23 nt, Artificial Sequence
  Synthetic
caggguaaggaggggcgggcgug

SEQ ID NO: 40738 - RNA, 24 nt, Artificial Sequence
  Synthetic
ccaggguaaggaggggcgggcgug

SEQ ID NO: 40739 - RNA, 18 nt, Artificial Sequence
  Synthetic
ugaggaggggcgggcgug

SEQ ID NO: 40740 - RNA, 19 nt, Artificial Sequence
  Synthetic
gugaggaggggcgggcgug

SEQ ID NO: 40741 - RNA, 20 nt, Artificial Sequence
  Synthetic
ggugaggaggggcgggcgug

SEQ ID NO: 40742 - RNA, 21 nt, Artificial Sequence
  Synthetic
gggugaggaggggcgggcgug

SEQ ID NO: 40743 - RNA, 22 nt, Artificial Sequence
  Synthetic
agggugaggaggggcgggcgug

SEQ ID NO: 40744 - RNA, 23 nt, Artificial Sequence
  Synthetic
cagggugaggaggggcgggcgug

SEQ ID NO: 40745 - RNA, 24 nt, Artificial Sequence
  Synthetic
ccagggugaggaggggcgggcgug

SEQ ID NO: 40746 - RNA, 18 nt, Artificial Sequence
  Synthetic
gugucguguugugucgug

SEQ ID NO: 40747 - RNA, 19 nt, Artificial Sequence
  Synthetic
cgugucguguugugucgug

SEQ ID NO: 40748 - RNA, 20 nt, Artificial Sequence
  Synthetic
ucgugucguguugugucgug

SEQ ID NO: 40749 - RNA, 21 nt, Artificial Sequence
  Synthetic
gucgugucguguugugucgug

SEQ ID NO: 40750 - RNA, 22 nt, Artificial Sequence
  Synthetic
cgucgugucguguugugucgug

SEQ ID NO: 40751 - RNA, 23 nt, Artificial Sequence
  Synthetic
gcgucgugucguguugugucgug

SEQ ID NO: 40752 - RNA, 24 nt, Artificial Sequence
  Synthetic
cgcgucgugucguguugugucgug

SEQ ID NO: 40753 - RNA, 18 nt, Artificial Sequence
  Synthetic
ucggccggugguccggug

SEQ ID NO: 40754 - RNA, 19 nt, Artificial Sequence
  Synthetic
cucggccggugguccggug

SEQ ID NO: 40755 - RNA, 20 nt, Artificial Sequence
  Synthetic
ccucggccggugguccggug

SEQ ID NO: 40756 - RNA, 21 nt, Artificial Sequence
  Synthetic
gccucggccggugguccggug

SEQ ID NO: 40757 - RNA, 22 nt, Artificial Sequence
  Synthetic
cgccucggccggugguccggug

SEQ ID NO: 40758 - RNA, 23 nt, Artificial Sequence
  Synthetic
gcgccucggccggugguccggug

SEQ ID NO: 40759 - RNA, 24 nt, Artificial Sequence
  Synthetic
ggcgccucggccggugguccggug

SEQ ID NO: 40760 - RNA, 18 nt, Artificial Sequence
  Synthetic
uuucucccagccagggug

SEQ ID NO: 40761 - RNA, 19 nt, Artificial Sequence
  Synthetic
cuuucucccagccagggug

SEQ ID NO: 40762 - RNA, 20 nt, Artificial Sequence
  Synthetic
ccuuucucccagccagggug

SEQ ID NO: 40763 - RNA, 21 nt, Artificial Sequence
  Synthetic
uccuuucucccagccagggug

SEQ ID NO: 40764 - RNA, 22 nt, Artificial Sequence
  Synthetic
cuccuuucucccagccagggug

SEQ ID NO: 40765 - RNA, 23 nt, Artificial Sequence
  Synthetic
ccuccuuucucccagccagggug

SEQ ID NO: 40766 - RNA, 24 nt, Artificial Sequence
  Synthetic
uccuccuuucucccagccagggug

SEQ ID NO: 40767 - RNA, 18 nt, Artificial Sequence
  Synthetic
guggugggccguguugug

SEQ ID NO: 40768 - RNA, 19 nt, Artificial Sequence
  Synthetic
cguggugggccguguugug

SEQ ID NO: 40769 - RNA, 20 nt, Artificial Sequence
  Synthetic
ucguggugggccguguugug

SEQ ID NO: 40770 - RNA, 21 nt, Artificial Sequence
  Synthetic
gucguggugggccguguugug

SEQ ID NO: 40771 - RNA, 22 nt, Artificial Sequence
  Synthetic
ugucguggugggccguguugug

SEQ ID NO: 40772 - RNA, 23 nt, Artificial Sequence
  Synthetic
gugucguggugggccguguugug

SEQ ID NO: 40773 - RNA, 24 nt, Artificial Sequence
  Synthetic
ugugucguggugggccguguugug

SEQ ID NO: 40774 - RNA, 18 nt, Artificial Sequence
  Synthetic
auaaagaccaacaggccu

SEQ ID NO: 40775 - RNA, 19 nt, Artificial Sequence
  Synthetic
gauaaagaccaacaggccu

SEQ ID NO: 40776 - RNA, 20 nt, Artificial Sequence
  Synthetic
ugauaaagaccaacaggccu

SEQ ID NO: 40777 - RNA, 21 nt, Artificial Sequence
  Synthetic
augauaaagaccaacaggccu

SEQ ID NO: 40778 - RNA, 22 nt, Artificial Sequence
  Synthetic
uaugauaaagaccaacaggccu

SEQ ID NO: 40779 - RNA, 23 nt, Artificial Sequence
  Synthetic
cuaugauaaagaccaacaggccu

SEQ ID NO: 40780 - RNA, 24 nt, Artificial Sequence
  Synthetic
ucuaugauaaagaccaacaggccu

SEQ ID NO: 40781 - RNA, 18 nt, Artificial Sequence
  Synthetic
gguggggggcggcuuccu

SEQ ID NO: 40782 - RNA, 19 nt, Artificial Sequence
  Synthetic
cgguggggggcggcuuccu

SEQ ID NO: 40783 - RNA, 20 nt, Artificial Sequence
  Synthetic
ccgguggggggcggcuuccu

SEQ ID NO: 40784 - RNA, 21 nt, Artificial Sequence
  Synthetic
uccgguggggggcggcuuccu

SEQ ID NO: 40785 - RNA, 22 nt, Artificial Sequence
  Synthetic
guccgguggggggcggcuuccu

SEQ ID NO: 40786 - RNA, 23 nt, Artificial Sequence
  Synthetic
gguccgguggggggcggcuuccu

SEQ ID NO: 40787 - RNA, 24 nt, Artificial Sequence
  Synthetic
ugguccgguggggggcggcuuccu

SEQ ID NO: 40788 - RNA, 18 nt, Artificial Sequence
  Synthetic
ccgggggccggggccgcu

SEQ ID NO: 40789 - RNA, 19 nt, Artificial Sequence
  Synthetic
gccgggggccggggccgcu

SEQ ID NO: 40790 - RNA, 20 nt, Artificial Sequence
  Synthetic
ggccgggggccggggccgcu

SEQ ID NO: 40791 - RNA, 21 nt, Artificial Sequence
  Synthetic
gggccgggggccggggccgcu

SEQ ID NO: 40792 - RNA, 22 nt, Artificial Sequence
  Synthetic
cgggccgggggccggggccgcu

SEQ ID NO: 40793 - RNA, 23 nt, Artificial Sequence
  Synthetic
acgggccgggggccggggccgcu

SEQ ID NO: 40794 - RNA, 24 nt, Artificial Sequence
  Synthetic
aacgggccgggggccggggccgcu

SEQ ID NO: 40795 - RNA, 18 nt, Artificial Sequence
  Synthetic
ggucgcgggccccgggcu

SEQ ID NO: 40796 - RNA, 19 nt, Artificial Sequence
  Synthetic
gggucgcgggccccgggcu

SEQ ID NO: 40797 - RNA, 20 nt, Artificial Sequence
  Synthetic
cgggucgcgggccccgggcu

SEQ ID NO: 40798 - RNA, 21 nt, Artificial Sequence
  Synthetic
ccgggucgcgggccccgggcu

SEQ ID NO: 40799 - RNA, 22 nt, Artificial Sequence
  Synthetic
gccgggucgcgggccccgggcu

SEQ ID NO: 40800 - RNA, 23 nt, Artificial Sequence
  Synthetic
cgccgggucgcgggccccgggcu

SEQ ID NO: 40801 - RNA, 24 nt, Artificial Sequence
  Synthetic
gcgccgggucgcgggccccgggcu

SEQ ID NO: 40802 - RNA, 18 nt, Artificial Sequence
  Synthetic
cgcaguugcgcgcgugcu

SEQ ID NO: 40803 - RNA, 19 nt, Artificial Sequence
  Synthetic
acgcaguugcgcgcgugcu

SEQ ID NO: 40804 - RNA, 20 nt, Artificial Sequence
  Synthetic
cacgcaguugcgcgcgugcu

SEQ ID NO: 40805 - RNA, 21 nt, Artificial Sequence
  Synthetic
ucacgcaguugcgcgcgugcu

SEQ ID NO: 40806 - RNA, 22 nt, Artificial Sequence
  Synthetic
cucacgcaguugcgcgcgugcu

SEQ ID NO: 40807 - RNA, 23 nt, Artificial Sequence
  Synthetic
ccucacgcaguugcgcgcgugcu

SEQ ID NO: 40808 - RNA, 24 nt, Artificial Sequence
  Synthetic
gccucacgcaguugcgcgcgugcu

SEQ ID NO: 40809 - RNA, 18 nt, Artificial Sequence
  Synthetic
cggggggcgucggguagu

SEQ ID NO: 40810 - RNA, 19 nt, Artificial Sequence
  Synthetic
gcggggggcgucggguagu

SEQ ID NO: 40811 - RNA, 20 nt, Artificial Sequence
  Synthetic
cgcggggggcgucggguagu

SEQ ID NO: 40812 - RNA, 21 nt, Artificial Sequence
  Synthetic
acgcggggggcgucggguagu

SEQ ID NO: 40813 - RNA, 22 nt, Artificial Sequence
  Synthetic
gacgcggggggcgucggguagu

SEQ ID NO: 40814 - RNA, 23 nt, Artificial Sequence
  Synthetic
cgacgcggggggcgucggguagu

SEQ ID NO: 40815 - RNA, 24 nt, Artificial Sequence
  Synthetic
ccgacgcggggggcgucggguagu

SEQ ID NO: 40816 - RNA, 18 nt, Artificial Sequence
  Synthetic
cucggccggugguccggu

SEQ ID NO: 40817 - RNA, 19 nt, Artificial Sequence
  Synthetic
ccucggccggugguccggu

SEQ ID NO: 40818 - RNA, 20 nt, Artificial Sequence
  Synthetic
gccucggccggugguccggu

SEQ ID NO: 40819 - RNA, 21 nt, Artificial Sequence
  Synthetic
cgccucggccggugguccggu

SEQ ID NO: 40820 - RNA, 22 nt, Artificial Sequence
  Synthetic
gcgccucggccggugguccggu

SEQ ID NO: 40821 - RNA, 23 nt, Artificial Sequence
  Synthetic
ggcgccucggccggugguccggu

SEQ ID NO: 40822 - RNA, 24 nt, Artificial Sequence
  Synthetic
aggcgccucggccggugguccggu

SEQ ID NO: 40823 - RNA, 18 nt, Artificial Sequence
  Synthetic
cuuucucccagccagggu

SEQ ID NO: 40824 - RNA, 19 nt, Artificial Sequence
  Synthetic
ccuuucucccagccagggu

SEQ ID NO: 40825 - RNA, 20 nt, Artificial Sequence
  Synthetic
uccuuucucccagccagggu

SEQ ID NO: 40826 - RNA, 21 nt, Artificial Sequence
  Synthetic
cuccuuucucccagccagggu

SEQ ID NO: 40827 - RNA, 22 nt, Artificial Sequence
  Synthetic
ccuccuuucucccagccagggu

SEQ ID NO: 40828 - RNA, 23 nt, Artificial Sequence
  Synthetic
uccuccuuucucccagccagggu

SEQ ID NO: 40829 - RNA, 24 nt, Artificial Sequence
  Synthetic
cuccuccuuucucccagccagggu

SEQ ID NO: 40830 - RNA, 18 nt, Artificial Sequence
  Synthetic
ucuccccgcagccagggu

SEQ ID NO: 40831 - RNA, 19 nt, Artificial Sequence
  Synthetic
gucuccccgcagccagggu

SEQ ID NO: 40832 - RNA, 20 nt, Artificial Sequence
  Synthetic
agucuccccgcagccagggu

SEQ ID NO: 40833 - RNA, 21 nt, Artificial Sequence
  Synthetic
gagucuccccgcagccagggu

SEQ ID NO: 40834 - RNA, 22 nt, Artificial Sequence
  Synthetic
ggagucuccccgcagccagggu

SEQ ID NO: 40835 - RNA, 23 nt, Artificial Sequence
  Synthetic
gggagucuccccgcagccagggu

SEQ ID NO: 40836 - RNA, 24 nt, Artificial Sequence
  Synthetic
ugggagucuccccgcagccagggu

SEQ ID NO: 40837 - RNA, 18 nt, Artificial Sequence
  Synthetic
ccaacaggccucgggggu

SEQ ID NO: 40838 - RNA, 19 nt, Artificial Sequence
  Synthetic
accaacaggccucgggggu

SEQ ID NO: 40839 - RNA, 20 nt, Artificial Sequence
  Synthetic
gaccaacaggccucgggggu

SEQ ID NO: 40840 - RNA, 21 nt, Artificial Sequence
  Synthetic
agaccaacaggccucgggggu

SEQ ID NO: 40841 - RNA, 22 nt, Artificial Sequence
  Synthetic
aagaccaacaggccucgggggu

SEQ ID NO: 40842 - RNA, 23 nt, Artificial Sequence
  Synthetic
aaagaccaacaggccucgggggu

SEQ ID NO: 40843 - RNA, 24 nt, Artificial Sequence
  Synthetic
uaaagaccaacaggccucgggggu

SEQ ID NO: 40844 - RNA, 18 nt, Artificial Sequence
  Synthetic
gcugguguguguugcugu

SEQ ID NO: 40845 - RNA, 19 nt, Artificial Sequence
  Synthetic
ugcugguguguguugcugu

SEQ ID NO: 40846 - RNA, 20 nt, Artificial Sequence
  Synthetic
augcugguguguguugcugu

SEQ ID NO: 40847 - RNA, 21 nt, Artificial Sequence
  Synthetic
aaugcugguguguguugcugu

SEQ ID NO: 40848 - RNA, 22 nt, Artificial Sequence
  Synthetic
aaaugcugguguguguugcugu

SEQ ID NO: 40849 - RNA, 23 nt, Artificial Sequence
  Synthetic
aaaaugcugguguguguugcugu

SEQ ID NO: 40850 - RNA, 24 nt, Artificial Sequence
  Synthetic
caaaaugcugguguguguugcugu

SEQ ID NO: 40851 - RNA, 18 nt, Artificial Sequence
  Synthetic
ggcguggcgggcaggugu

SEQ ID NO: 40852 - RNA, 19 nt, Artificial Sequence
  Synthetic
gggcguggcgggcaggugu

SEQ ID NO: 40853 - RNA, 20 nt, Artificial Sequence
  Synthetic
cgggcguggcgggcaggugu

SEQ ID NO: 40854 - RNA, 21 nt, Artificial Sequence
  Synthetic
gcgggcguggcgggcaggugu

SEQ ID NO: 40855 - RNA, 22 nt, Artificial Sequence
  Synthetic
ggcgggcguggcgggcaggugu

SEQ ID NO: 40856 - RNA, 23 nt, Artificial Sequence
  Synthetic
gggcgggcguggcgggcaggugu

SEQ ID NO: 40857 - RNA, 24 nt, Artificial Sequence
  Synthetic
ggggcgggcguggcgggcaggugu

SEQ ID NO: 40858 - RNA, 18 nt, Artificial Sequence
  Synthetic
cugguguguguugcuguu

SEQ ID NO: 40859 - RNA, 19 nt, Artificial Sequence
  Synthetic
gcugguguguguugcuguu

SEQ ID NO: 40860 - RNA, 20 nt, Artificial Sequence
  Synthetic
ugcugguguguguugcuguu

SEQ ID NO: 40861 - RNA, 21 nt, Artificial Sequence
  Synthetic
augcugguguguguugcuguu

SEQ ID NO: 40862 - RNA, 22 nt, Artificial Sequence
  Synthetic
aaugcugguguguguugcuguu

SEQ ID NO: 40863 - RNA, 23 nt, Artificial Sequence
  Synthetic
aaaugcugguguguguugcuguu

SEQ ID NO: 40864 - RNA, 24 nt, Artificial Sequence
  Synthetic
aaaaugcugguguguguugcuguu

SEQ ID NO: 40865 - RNA, 18 nt, Artificial Sequence
  Synthetic
gugguguggugugguguu

SEQ ID NO: 40866 - RNA, 19 nt, Artificial Sequence
  Synthetic
ugugguguggugugguguu

SEQ ID NO: 40867 - RNA, 20 nt, Artificial Sequence
  Synthetic
gugugguguggugugguguu

SEQ ID NO: 40868 - RNA, 21 nt, Artificial Sequence
  Synthetic
cgugugguguggugugguguu

SEQ ID NO: 40869 - RNA, 22 nt, Artificial Sequence
  Synthetic
ccgugugguguggugugguguu

SEQ ID NO: 40870 - RNA, 23 nt, Artificial Sequence
  Synthetic
gccgugugguguggugugguguu

SEQ ID NO: 40871 - RNA, 24 nt, Artificial Sequence
  Synthetic
ggccgugugguguggugugguguu

SEQ ID NO: 40872 - RNA, 17 nt, Artificial Sequence
  Synthetic
gguuuagggucguacag

SEQ ID NO: 40873 - RNA, 20 nt, Artificial Sequence
  Synthetic
guagguuuagggucguacag

SEQ ID NO: 40874 - RNA, 17 nt, Artificial Sequence
  Synthetic
aguagggggagcuaaca

SEQ ID NO: 40875 - RNA, 17 nt, Artificial Sequence
  Synthetic
aucaaaguucccuggcc

SEQ ID NO: 40876 - RNA, 17 nt, Artificial Sequence
  Synthetic
cagagggcgugcaugcg

SEQ ID NO: 40877 - RNA, 17 nt, Artificial Sequence
  Synthetic
ccggugguccggugggg

SEQ ID NO: 40878 - RNA, 17 nt, Artificial Sequence
  Synthetic
caggccucggggguggg

SEQ ID NO: 40879 - RNA, 17 nt, Artificial Sequence
  Synthetic
uuuacaauaaaguuuug

SEQ ID NO: 40880 - RNA, 20 nt, Artificial Sequence
  Synthetic
gggaguagggggagcuaaca

SEQ ID NO: 40881 - RNA, 20 nt, Artificial Sequence
  Synthetic
ucuaucaaaguucccuggcc

SEQ ID NO: 40882 - RNA, 20 nt, Artificial Sequence
  Synthetic
gggcagagggcgugcaugcg

SEQ ID NO: 40883 - RNA, 20 nt, Artificial Sequence
  Synthetic
cggccggugguccggugggg

SEQ ID NO: 40884 - RNA, 20 nt, Artificial Sequence
  Synthetic
caacaggccucggggguggg

SEQ ID NO: 40885 - RNA, 20 nt, Artificial Sequence
  Synthetic
aauuuuacaauaaaguuuug

SEQ ID NO: 40886 - RNA, 17 nt, Artificial Sequence
  Synthetic
ggccgguuccaguguaa

SEQ ID NO: 40887 - RNA, 17 nt, Artificial Sequence
  Synthetic
gccgcauacgaccccca

SEQ ID NO: 40888 - RNA, 17 nt, Artificial Sequence
  Synthetic
ggucguaugcggcugga

SEQ ID NO: 40889 - RNA, 17 nt, Artificial Sequence
  Synthetic
guuggggcgccauguua

SEQ ID NO: 40890 - RNA, 17 nt, Artificial Sequence
  Synthetic
gacccuuacacuggaac

SEQ ID NO: 40891 - RNA, 17 nt, Artificial Sequence
  Synthetic
gguugguccccggggac

SEQ ID NO: 40892 - RNA, 17 nt, Artificial Sequence
  Synthetic
gcauaacccggaacccc

SEQ ID NO: 40893 - RNA, 17 nt, Artificial Sequence
  Synthetic
gcgcguaaccacucccc

SEQ ID NO: 40894 - RNA, 17 nt, Artificial Sequence
  Synthetic
gcgccggguuggucccc

SEQ ID NO: 40895 - RNA, 17 nt, Artificial Sequence
  Synthetic
gugguuacgcgcggcgc

SEQ ID NO: 40896 - RNA, 17 nt, Artificial Sequence
  Synthetic
ggggucgcaacguaggc

SEQ ID NO: 40897 - RNA, 17 nt, Artificial Sequence
  Synthetic
gccccuguugcgucggc

SEQ ID NO: 40898 - RNA, 17 nt, Artificial Sequence
  Synthetic
gguacucgcuccggggc

SEQ ID NO: 40899 - RNA, 17 nt, Artificial Sequence
  Synthetic
guuccaguguaaggguc

SEQ ID NO: 40900 - RNA, 17 nt, Artificial Sequence
  Synthetic
gggccgggcgccauguc

SEQ ID NO: 40901 - RNA, 17 nt, Artificial Sequence
  Synthetic
gcgggaauugccggaag

SEQ ID NO: 40902 - RNA, 17 nt, Artificial Sequence
  Synthetic
gcgggccaaugcgcgag

SEQ ID NO: 40903 - RNA, 17 nt, Artificial Sequence
  Synthetic
guauauauagugucacg

SEQ ID NO: 40904 - RNA, 17 nt, Artificial Sequence
  Synthetic
ggaggcggggaauaccg

SEQ ID NO: 40905 - RNA, 17 nt, Artificial Sequence
  Synthetic
guucauugagcgacccg

SEQ ID NO: 40906 - RNA, 17 nt, Artificial Sequence
  Synthetic
gcuuccggcaauucccg

SEQ ID NO: 40907 - RNA, 17 nt, Artificial Sequence
  Synthetic
ggcggguacucgcuccg

SEQ ID NO: 40908 - RNA, 17 nt, Artificial Sequence
  Synthetic
gggucgcaacguaggcg

SEQ ID NO: 40909 - RNA, 17 nt, Artificial Sequence
  Synthetic
gggggucgcaacguagg

SEQ ID NO: 40910 - RNA, 17 nt, Artificial Sequence
  Synthetic
gggggcgccauguuagg

SEQ ID NO: 40911 - RNA, 17 nt, Artificial Sequence
  Synthetic
guuacgcgcggcgcggg

SEQ ID NO: 40912 - RNA, 17 nt, Artificial Sequence
  Synthetic
ggguacucgcuccgggg

SEQ ID NO: 40913 - RNA, 17 nt, Artificial Sequence
  Synthetic
gggggcgccauauuggg

SEQ ID NO: 40914 - RNA, 17 nt, Artificial Sequence
  Synthetic
gggucguaugcggcugg

SEQ ID NO: 40915 - RNA, 17 nt, Artificial Sequence
  Synthetic
ggacgcgcggccauugg

SEQ ID NO: 40916 - RNA, 17 nt, Artificial Sequence
  Synthetic
gcguaaccacuccccug

SEQ ID NO: 40917 - RNA, 17 nt, Artificial Sequence
  Synthetic
gaguacccgccggccug

SEQ ID NO: 40918 - RNA, 17 nt, Artificial Sequence
  Synthetic
gcucccguguaugagug

SEQ ID NO: 40919 - RNA, 17 nt, Artificial Sequence
  Synthetic
gggacgcgcggccauug

SEQ ID NO: 40920 - RNA, 17 nt, Artificial Sequence
  Synthetic
gcucaaugaacccgcau

SEQ ID NO: 40921 - RNA, 17 nt, Artificial Sequence
  Synthetic
ggaaccggccgccaugu

SEQ ID NO: 40922 - RNA, 17 nt, Artificial Sequence
  Synthetic
gucuggggcgccauauu

SEQ ID NO: 40923 - RNA, 17 nt, Artificial Sequence
  Synthetic
gaaccggccgccauguu

SEQ ID NO: 40924 - RNA, 20 nt, Artificial Sequence
  Synthetic
ggcagugacgauucccccaa

SEQ ID NO: 40925 - RNA, 20 nt, Artificial Sequence
  Synthetic
ggcggccgguuccaguguaa

SEQ ID NO: 40926 - RNA, 20 nt, Artificial Sequence
  Synthetic
gcaauucccgcggcccuuaa

SEQ ID NO: 40927 - RNA, 20 nt, Artificial Sequence
  Synthetic
ggguuccgcacccccuaaca

SEQ ID NO: 40928 - RNA, 20 nt, Artificial Sequence
  Synthetic
ggguuccacgcccccuaaca

SEQ ID NO: 40929 - RNA, 20 nt, Artificial Sequence
  Synthetic
gggggucguaugcggcugga

SEQ ID NO: 40930 - RNA, 20 nt, Artificial Sequence
  Synthetic
gcgaguacccgccggccuga

SEQ ID NO: 40931 - RNA, 20 nt, Artificial Sequence
  Synthetic
guccccugggguuccgggua

SEQ ID NO: 40932 - RNA, 20 nt, Artificial Sequence
  Synthetic
ggaccgggggcgccauguua

SEQ ID NO: 40933 - RNA, 20 nt, Artificial Sequence
  Synthetic
gucacauggcgacccccaac

SEQ ID NO: 40934 - RNA, 20 nt, Artificial Sequence
  Synthetic
ggggacccccacucauacac

SEQ ID NO: 40935 - RNA, 20 nt, Artificial Sequence
  Synthetic
gacccuauauauacagggac

SEQ ID NO: 40936 - RNA, 20 nt, Artificial Sequence
  Synthetic
gcgcgggaggcggggaauac

SEQ ID NO: 40937 - RNA, 20 nt, Artificial Sequence
  Synthetic
gccgcgcguaaccacucccc

SEQ ID NO: 40938 - RNA, 20 nt, Artificial Sequence
  Synthetic
ggucgcggacggaggguccc

SEQ ID NO: 40939 - RNA, 20 nt, Artificial Sequence
  Synthetic
ggcgccccagacauggcgcc

SEQ ID NO: 40940 - RNA, 20 nt, Artificial Sequence
  Synthetic
ggccggcggguacucgcucc

SEQ ID NO: 40941 - RNA, 20 nt, Artificial Sequence
  Synthetic
ggguucauugagcgacccgc

SEQ ID NO: 40942 - RNA, 20 nt, Artificial Sequence
  Synthetic
gccccggagcgaguacccgc

SEQ ID NO: 40943 - RNA, 20 nt, Artificial Sequence
  Synthetic
gguugcccauuaagggccgc

SEQ ID NO: 40944 - RNA, 20 nt, Artificial Sequence
  Synthetic
ggagugguuacgcgcggcgc

SEQ ID NO: 40945 - RNA, 20 nt, Artificial Sequence
  Synthetic
gucccuguauauauaggguc

SEQ ID NO: 40946 - RNA, 20 nt, Artificial Sequence
  Synthetic
gaggggccgggcgccauguc

SEQ ID NO: 40947 - RNA, 20 nt, Artificial Sequence
  Synthetic
gcauugguccccugggguuc

SEQ ID NO: 40948 - RNA, 20 nt, Artificial Sequence
  Synthetic
gccgcgggaauugccggaag

SEQ ID NO: 40949 - RNA, 20 nt, Artificial Sequence
  Synthetic
gcccggcucccguguaugag

SEQ ID NO: 40950 - RNA, 20 nt, Artificial Sequence
  Synthetic
gaccgggggcgccauguuag

SEQ ID NO: 40951 - RNA, 20 nt, Artificial Sequence
  Synthetic
gggcgccggguugguccccg

SEQ ID NO: 40952 - RNA, 20 nt, Artificial Sequence
  Synthetic
gccccucgcgcauuggcccg

SEQ ID NO: 40953 - RNA, 20 nt, Artificial Sequence
  Synthetic
ggguugcccauuaagggccg

SEQ ID NO: 40954 - RNA, 20 nt, Artificial Sequence
  Synthetic
gcgucucgcuccgagugccg

SEQ ID NO: 40955 - RNA, 20 nt, Artificial Sequence
  Synthetic
gccggcggguacucgcuccg

SEQ ID NO: 40956 - RNA, 20 nt, Artificial Sequence
  Synthetic
gacccgcgggccaaugcgcg

SEQ ID NO: 40957 - RNA, 20 nt, Artificial Sequence
  Synthetic
gggagugguuacgcgcggcg

SEQ ID NO: 40958 - RNA, 20 nt, Artificial Sequence
  Synthetic
guuacgcgcggcgcgggagg

SEQ ID NO: 40959 - RNA, 20 nt, Artificial Sequence
  Synthetic
ggguugggcccccaaaucgg

SEQ ID NO: 40960 - RNA, 20 nt, Artificial Sequence
  Synthetic
gguuccaguguaagggucgg

SEQ ID NO: 40961 - RNA, 20 nt, Artificial Sequence
  Synthetic
gugguuacgcgcggcgcggg

SEQ ID NO: 40962 - RNA, 20 nt, Artificial Sequence
  Synthetic
gccccuguugcgucggcggg

SEQ ID NO: 40963 - RNA, 20 nt, Artificial Sequence
  Synthetic
ggcggguacucgcuccgggg

SEQ ID NO: 40964 - RNA, 20 nt, Artificial Sequence
  Synthetic
gugggggucccccaacaugg

SEQ ID NO: 40965 - RNA, 20 nt, Artificial Sequence
  Synthetic
gcgggaggggcaugcuaaug

SEQ ID NO: 40966 - RNA, 20 nt, Artificial Sequence
  Synthetic
gaacccgcauugguccccug

SEQ ID NO: 40967 - RNA, 20 nt, Artificial Sequence
  Synthetic
gggagccgggcgccauguug

SEQ ID NO: 40968 - RNA, 20 nt, Artificial Sequence
  Synthetic
ggaccggggucgcccuguug

SEQ ID NO: 40969 - RNA, 20 nt, Artificial Sequence
  Synthetic
gcuccggggcggggcuccau

SEQ ID NO: 40970 - RNA, 20 nt, Artificial Sequence
  Synthetic
gucgcucaaugaacccgcau

SEQ ID NO: 40971 - RNA, 20 nt, Artificial Sequence
  Synthetic
gcggugggccugccuccccu

SEQ ID NO: 40972 - RNA, 20 nt, Artificial Sequence
  Synthetic
gucccugggggucgcaacgu

SEQ ID NO: 40973 - RNA, 20 nt, Artificial Sequence
  Synthetic
ggacggggccgccccgcggu

SEQ ID NO: 40974 - RNA, 20 nt, Artificial Sequence
  Synthetic
gcacggcccggcccccgauu

SEQ ID NO: 40975 - RNA, 20 nt, Artificial Sequence
  Synthetic
ggcaugcuaaugggguucuu

SEQ ID NO: 40976 - RNA, 20 nt, Artificial Sequence
  Synthetic
gggaccggggucgcccuguu

SEQ ID NO: 40977 - RNA, 17 nt, Artificial Sequence
  Synthetic
ccgggguugcccauuaa

SEQ ID NO: 40978 - RNA, 17 nt, Artificial Sequence
  Synthetic
auucccgcggcccuuaa

SEQ ID NO: 40979 - RNA, 17 nt, Artificial Sequence
  Synthetic
cauggcgacccccaaca

SEQ ID NO: 40980 - RNA, 17 nt, Artificial Sequence
  Synthetic
ucgggggucccccaaca

SEQ ID NO: 40981 - RNA, 17 nt, Artificial Sequence
  Synthetic
uuccgcacccccuaaca

SEQ ID NO: 40982 - RNA, 17 nt, Artificial Sequence
  Synthetic
cauaacccggaacccca

SEQ ID NO: 40983 - RNA, 17 nt, Artificial Sequence
  Synthetic
cuacguugcgaccccca

SEQ ID NO: 40984 - RNA, 17 nt, Artificial Sequence
  Synthetic
aauggccgcgcguccca

SEQ ID NO: 40985 - RNA, 17 nt, Artificial Sequence
  Synthetic
cgcgggccaaugcgcga

SEQ ID NO: 40986 - RNA, 17 nt, Artificial Sequence
  Synthetic
cuguugcgucggcggga

SEQ ID NO: 40987 - RNA, 17 nt, Artificial Sequence
  Synthetic
aguacccgccggccuga

SEQ ID NO: 40988 - RNA, 17 nt, Artificial Sequence
  Synthetic
cccccagcgcgagguga

SEQ ID NO: 40989 - RNA, 17 nt, Artificial Sequence
  Synthetic
uauggcgccccccaaua

SEQ ID NO: 40990 - RNA, 17 nt, Artificial Sequence
  Synthetic
cggucccuguauauaua

SEQ ID NO: 40991 - RNA, 17 nt, Artificial Sequence
  Synthetic
cggccgguuccagugua

SEQ ID NO: 40992 - RNA, 17 nt, Artificial Sequence
  Synthetic
accgggguugcccauua

SEQ ID NO: 40993 - RNA, 17 nt, Artificial Sequence
  Synthetic
ccgggggcgccauguua

SEQ ID NO: 40994 - RNA, 17 nt, Artificial Sequence
  Synthetic
acauggcgacccccaac

SEQ ID NO: 40995 - RNA, 17 nt, Artificial Sequence
  Synthetic
acccccgacccuuacac

SEQ ID NO: 40996 - RNA, 17 nt, Artificial Sequence
  Synthetic
ccuauauauacagggac

SEQ ID NO: 40997 - RNA, 17 nt, Artificial Sequence
  Synthetic
cgggaggcggggaauac

SEQ ID NO: 40998 - RNA, 17 nt, Artificial Sequence
  Synthetic
cgugacacuauauauac

SEQ ID NO: 40999 - RNA, 17 nt, Artificial Sequence
  Synthetic
cuauauauacagggacc

SEQ ID NO: 41000 - RNA, 17 nt, Artificial Sequence
  Synthetic
accauacccggaacccc

SEQ ID NO: 41001 - RNA, 17 nt, Artificial Sequence
  Synthetic
ccuacguugcgaccccc

SEQ ID NO: 41002 - RNA, 17 nt, Artificial Sequence
  Synthetic
cccuaacauggcgcccc

SEQ ID NO: 41003 - RNA, 17 nt, Artificial Sequence
  Synthetic
aacccgcauuggucccc

SEQ ID NO: 41004 - RNA, 17 nt, Artificial Sequence
  Synthetic
caauggccgcgcguccc

SEQ ID NO: 41005 - RNA, 17 nt, Artificial Sequence
  Synthetic
cgcggacggaggguccc

SEQ ID NO: 41006 - RNA, 17 nt, Artificial Sequence
  Synthetic
uauucuuugggggcgcc

SEQ ID NO: 41007 - RNA, 17 nt, Artificial Sequence
  Synthetic
cgccccaacauggcgcc

SEQ ID NO: 41008 - RNA, 17 nt, Artificial Sequence
  Synthetic
cccccaaaucgggggcc

SEQ ID NO: 41009 - RNA, 17 nt, Artificial Sequence
  Synthetic
cggcggguacucgcucc

SEQ ID NO: 41010 - RNA, 17 nt, Artificial Sequence
  Synthetic
cgggaauugccggaagc

SEQ ID NO: 41011 - RNA, 17 nt, Artificial Sequence
  Synthetic
uucauugagcgacccgc

SEQ ID NO: 41012 - RNA, 17 nt, Artificial Sequence
  Synthetic
ccggagcgaguacccgc

SEQ ID NO: 41013 - RNA, 17 nt, Artificial Sequence
  Synthetic
cucgcgcauuggcccgc

SEQ ID NO: 41014 - RNA, 17 nt, Artificial Sequence
  Synthetic
ugcccauuaagggccgc

SEQ ID NO: 41015 - RNA, 17 nt, Artificial Sequence
  Synthetic
auauucuuugggggcgc

SEQ ID NO: 41016 - RNA, 17 nt, Artificial Sequence
  Synthetic
ugggggucguaugcggc

SEQ ID NO: 41017 - RNA, 17 nt, Artificial Sequence
  Synthetic
agggccgcgggaauugc

SEQ ID NO: 41018 - RNA, 17 nt, Artificial Sequence
  Synthetic
ccggcggguacucgcuc

SEQ ID NO: 41019 - RNA, 17 nt, Artificial Sequence
  Synthetic
ucccgccgacgcaacag

SEQ ID NO: 41020 - RNA, 17 nt, Artificial Sequence
  Synthetic
auaacccggaaccccag

SEQ ID NO: 41021 - RNA, 17 nt, Artificial Sequence
  Synthetic
auggccgcgcgucccag

SEQ ID NO: 41022 - RNA, 17 nt, Artificial Sequence
  Synthetic
cggcucccguguaugag

SEQ ID NO: 41023 - RNA, 17 nt, Artificial Sequence
  Synthetic
cgggggcgccauguuag

SEQ ID NO: 41024 - RNA, 17 nt, Artificial Sequence
  Synthetic
uuggggcgccauguuag

SEQ ID NO: 41025 - RNA, 17 nt, Artificial Sequence
  Synthetic
uauauauacagggaccg

SEQ ID NO: 41026 - RNA, 17 nt, Artificial Sequence
  Synthetic
ccugcgucggugccccg

SEQ ID NO: 41027 - RNA, 17 nt, Artificial Sequence
  Synthetic
cgccggguugguccccg

SEQ ID NO: 41028 - RNA, 17 nt, Artificial Sequence
  Synthetic
ccucgcgcauuggcccg

SEQ ID NO: 41029 - RNA, 17 nt, Artificial Sequence
  Synthetic
uugcccauuaagggccg

SEQ ID NO: 41030 - RNA, 17 nt, Artificial Sequence
  Synthetic
aggggagugguuacgcg

SEQ ID NO: 41031 - RNA, 17 nt, Artificial Sequence
  Synthetic
agugguuacgcgcggcg

SEQ ID NO: 41032 - RNA, 17 nt, Artificial Sequence
  Synthetic
cgccauguuagggggcg

SEQ ID NO: 41033 - RNA, 17 nt, Artificial Sequence
  Synthetic
uggggcgccauguuagg

SEQ ID NO: 41034 - RNA, 17 nt, Artificial Sequence
  Synthetic
auauauacagggaccgg

SEQ ID NO: 41035 - RNA, 17 nt, Artificial Sequence
  Synthetic
acggggccgccccgcgg

SEQ ID NO: 41036 - RNA, 17 nt, Artificial Sequence
  Synthetic
uugggcccccaaaucgg

SEQ ID NO: 41037 - RNA, 17 nt, Artificial Sequence
  Synthetic
ccuguugcgucggcggg

SEQ ID NO: 41038 - RNA, 17 nt, Artificial Sequence
  Synthetic
uggggcgccauauuggg

SEQ ID NO: 41039 - RNA, 17 nt, Artificial Sequence
  Synthetic
cccucaccucgcgcugg

SEQ ID NO: 41040 - RNA, 17 nt, Artificial Sequence
  Synthetic
cuggggcgccauauugg

SEQ ID NO: 41041 - RNA, 17 nt, Artificial Sequence
  Synthetic
cggggucgcccuguugg

SEQ ID NO: 41042 - RNA, 17 nt, Artificial Sequence
  Synthetic
uccaugggggucguaug

SEQ ID NO: 41043 - RNA, 17 nt, Artificial Sequence
  Synthetic
cccgcauugguccccug

SEQ ID NO: 41044 - RNA, 17 nt, Artificial Sequence
  Synthetic
uggggggcgccauauug

SEQ ID NO: 41045 - RNA, 17 nt, Artificial Sequence
  Synthetic
ucuggggcgccauauug

SEQ ID NO: 41046 - RNA, 17 nt, Artificial Sequence
  Synthetic
aaccggccgccauguug

SEQ ID NO: 41047 - RNA, 17 nt, Artificial Sequence
  Synthetic
agccgggcgccauguug

SEQ ID NO: 41048 - RNA, 17 nt, Artificial Sequence
  Synthetic
uucccgcggcccuuaau

SEQ ID NO: 41049 - RNA, 17 nt, Artificial Sequence
  Synthetic
cugggacgcgcggccau

SEQ ID NO: 41050 - RNA, 17 nt, Artificial Sequence
  Synthetic
cacggccccucgcgcau

SEQ ID NO: 41051 - RNA, 17 nt, Artificial Sequence
  Synthetic
auuggggggcgccauau

SEQ ID NO: 41052 - RNA, 17 nt, Artificial Sequence
  Synthetic
ugucuggggcgccauau

SEQ ID NO: 41053 - RNA, 17 nt, Artificial Sequence
  Synthetic
ccggucccuguauauau

SEQ ID NO: 41054 - RNA, 17 nt, Artificial Sequence
  Synthetic
cgcguaaccacuccccu

SEQ ID NO: 41055 - RNA, 17 nt, Artificial Sequence
  Synthetic
ccgacgcaacaggggcu

SEQ ID NO: 41056 - RNA, 17 nt, Artificial Sequence
  Synthetic
ccugggggucgcaacgu

SEQ ID NO: 41057 - RNA, 17 nt, Artificial Sequence
  Synthetic
cggggccgccccgcggu

SEQ ID NO: 41058 - RNA, 17 nt, Artificial Sequence
  Synthetic
cuuugggggcgccgggu

SEQ ID NO: 41059 - RNA, 17 nt, Artificial Sequence
  Synthetic
auuggggggcgccaugu

SEQ ID NO: 41060 - RNA, 17 nt, Artificial Sequence
  Synthetic
ugggacgcgcggccauu

SEQ ID NO: 41061 - RNA, 17 nt, Artificial Sequence
  Synthetic
uuggggggcgccauauu

SEQ ID NO: 41062 - RNA, 17 nt, Artificial Sequence
  Synthetic
cgucacugccgccccuu

SEQ ID NO: 41063 - RNA, 17 nt, Artificial Sequence
  Synthetic
uugggggacaccggguu

SEQ ID NO: 41064 - RNA, 17 nt, Artificial Sequence
  Synthetic
accgggggcgccauguu

SEQ ID NO: 41065 - RNA, 17 nt, Artificial Sequence
  Synthetic
uuggggggcgccauguu

SEQ ID NO: 41066 - RNA, 17 nt, Artificial Sequence
  Synthetic
uguuggggcgccauguu

SEQ ID NO: 41067 - RNA, 17 nt, Artificial Sequence
  Synthetic
accggggucgcccuguu

SEQ ID NO: 41068 - RNA, 20 nt, Artificial Sequence
  Synthetic
cggcgggaggggcaugcuaa

SEQ ID NO: 41069 - RNA, 20 nt, Artificial Sequence
  Synthetic
ucacauggcgacccccaaca

SEQ ID NO: 41070 - RNA, 20 nt, Artificial Sequence
  Synthetic
ugagugggggucccccaaca

SEQ ID NO: 41071 - RNA, 20 nt, Artificial Sequence
  Synthetic
ccuaacauggcgccccaaca

SEQ ID NO: 41072 - RNA, 20 nt, Artificial Sequence
  Synthetic
ccaauauggcgccccagaca

SEQ ID NO: 41073 - RNA, 20 nt, Artificial Sequence
  Synthetic
cccgugacacuauauauaca

SEQ ID NO: 41074 - RNA, 20 nt, Artificial Sequence
  Synthetic
uagcauaacccggaacccca

SEQ ID NO: 41075 - RNA, 20 nt, Artificial Sequence
  Synthetic
uuaccauacccggaacccca

SEQ ID NO: 41076 - RNA, 20 nt, Artificial Sequence
  Synthetic
cgccuacguugcgaccccca

SEQ ID NO: 41077 - RNA, 20 nt, Artificial Sequence
  Synthetic
cccaauggccgcgcguccca

SEQ ID NO: 41078 - RNA, 20 nt, Artificial Sequence
  Synthetic
ucccuguauauauaggguca

SEQ ID NO: 41079 - RNA, 20 nt, Artificial Sequence
  Synthetic
ucccuguauauauaguguca

SEQ ID NO: 41080 - RNA, 20 nt, Artificial Sequence
  Synthetic
cuucuguggugaugcggaga

SEQ ID NO: 41081 - RNA, 20 nt, Artificial Sequence
  Synthetic
acccgcgggccaaugcgcga

SEQ ID NO: 41082 - RNA, 20 nt, Artificial Sequence
  Synthetic
ugcggcuggagggucgcgga

SEQ ID NO: 41083 - RNA, 20 nt, Artificial Sequence
  Synthetic
ccccuguugcgucggcggga

SEQ ID NO: 41084 - RNA, 20 nt, Artificial Sequence
  Synthetic
caacauggcgccccccaaua

SEQ ID NO: 41085 - RNA, 20 nt, Artificial Sequence
  Synthetic
caauauggcgccccccaaua

SEQ ID NO: 41086 - RNA, 20 nt, Artificial Sequence
  Synthetic
ccccggucccuguauauaua

SEQ ID NO: 41087 - RNA, 20 nt, Artificial Sequence
  Synthetic
uggcggccgguuccagugua

SEQ ID NO: 41088 - RNA, 20 nt, Artificial Sequence
  Synthetic
aauaccgggguugcccauua

SEQ ID NO: 41089 - RNA, 20 nt, Artificial Sequence
  Synthetic
ugggguucuuugggggacac

SEQ ID NO: 41090 - RNA, 20 nt, Artificial Sequence
  Synthetic
ccggguugguccccggggac

SEQ ID NO: 41091 - RNA, 20 nt, Artificial Sequence
  Synthetic
ccccgugacacuauauauac

SEQ ID NO: 41092 - RNA, 20 nt, Artificial Sequence
  Synthetic
cccguccccggggaccaacc

SEQ ID NO: 41093 - RNA, 20 nt, Artificial Sequence
  Synthetic
cccgauuugggggcccaacc

SEQ ID NO: 41094 - RNA, 20 nt, Artificial Sequence
  Synthetic
acacuauauauacagggacc

SEQ ID NO: 41095 - RNA, 20 nt, Artificial Sequence
  Synthetic
acccuauauauacagggacc

SEQ ID NO: 41096 - RNA, 20 nt, Artificial Sequence
  Synthetic
cgcgggaggcggggaauacc

SEQ ID NO: 41097 - RNA, 20 nt, Artificial Sequence
  Synthetic
cggcccuuaaugggcaaccc

SEQ ID NO: 41098 - RNA, 20 nt, Artificial Sequence
  Synthetic
auuaccauacccggaacccc

SEQ ID NO: 41099 - RNA, 20 nt, Artificial Sequence
  Synthetic
ccgccuacguugcgaccccc

SEQ ID NO: 41100 - RNA, 20 nt, Artificial Sequence
  Synthetic
ucgggaaggcgggaagcccc

SEQ ID NO: 41101 - RNA, 20 nt, Artificial Sequence
  Synthetic
acccccuaacauggcgcccc

SEQ ID NO: 41102 - RNA, 20 nt, Artificial Sequence
  Synthetic
uuggccugcgucggugcccc

SEQ ID NO: 41103 - RNA, 20 nt, Artificial Sequence
  Synthetic
cuuggccugcgucggugccc

SEQ ID NO: 41104 - RNA, 20 nt, Artificial Sequence
  Synthetic
ccgcggggcggccccguccc

SEQ ID NO: 41105 - RNA, 20 nt, Artificial Sequence
  Synthetic
uggcgccccaacauggcgcc

SEQ ID NO: 41106 - RNA, 20 nt, Artificial Sequence
  Synthetic
uaucauuagcaugcacggcc

SEQ ID NO: 41107 - RNA, 20 nt, Artificial Sequence
  Synthetic
ccgcgggaauugccggaagc

SEQ ID NO: 41108 - RNA, 20 nt, Artificial Sequence
  Synthetic
ccccacucauacacgggagc

SEQ ID NO: 41109 - RNA, 20 nt, Artificial Sequence
  Synthetic
ccccucgcgcauuggcccgc

SEQ ID NO: 41110 - RNA, 20 nt, Artificial Sequence
  Synthetic
augauauucuuugggggcgc

SEQ ID NO: 41111 - RNA, 20 nt, Artificial Sequence
  Synthetic
cugggggucgcaacguaggc

SEQ ID NO: 41112 - RNA, 20 nt, Artificial Sequence
  Synthetic
ccaugggggucguaugcggc

SEQ ID NO: 41113 - RNA, 20 nt, Artificial Sequence
  Synthetic
caagccccuguugcgucggc

SEQ ID NO: 41114 - RNA, 20 nt, Artificial Sequence
  Synthetic
ccggguugggcccccaaauc

SEQ ID NO: 41115 - RNA, 20 nt, Artificial Sequence
  Synthetic
ucgcgcugggggcggcccuc

SEQ ID NO: 41116 - RNA, 20 nt, Artificial Sequence
  Synthetic
aggccggcggguacucgcuc

SEQ ID NO: 41117 - RNA, 20 nt, Artificial Sequence
  Synthetic
cccucccgccgacgcaacag

SEQ ID NO: 41118 - RNA, 20 nt, Artificial Sequence
  Synthetic
agcauaacccggaaccccag

SEQ ID NO: 41119 - RNA, 20 nt, Artificial Sequence
  Synthetic
uaccauacccggaaccccag

SEQ ID NO: 41120 - RNA, 20 nt, Artificial Sequence
  Synthetic
ccaauggccgcgcgucccag

SEQ ID NO: 41121 - RNA, 20 nt, Artificial Sequence
  Synthetic
uucuguggugaugcggagag

SEQ ID NO: 41122 - RNA, 20 nt, Artificial Sequence
  Synthetic
cccgcgggccaaugcgcgag

SEQ ID NO: 41123 - RNA, 20 nt, Artificial Sequence
  Synthetic
cccuguugcgucggcgggag

SEQ ID NO: 41124 - RNA, 20 nt, Artificial Sequence
  Synthetic
auguuggggcgccauguuag

SEQ ID NO: 41125 - RNA, 20 nt, Artificial Sequence
  Synthetic
cggguugguccccggggacg

SEQ ID NO: 41126 - RNA, 20 nt, Artificial Sequence
  Synthetic
cacuauauauacagggaccg

SEQ ID NO: 41127 - RNA, 20 nt, Artificial Sequence
  Synthetic
cccuauauauacagggaccg

SEQ ID NO: 41128 - RNA, 20 nt, Artificial Sequence
  Synthetic
cggguucauugagcgacccg

SEQ ID NO: 41129 - RNA, 20 nt, Artificial Sequence
  Synthetic
cccgcuuccggcaauucccg

SEQ ID NO: 41130 - RNA, 20 nt, Artificial Sequence
  Synthetic
cccaggggagugguuacgcg

SEQ ID NO: 41131 - RNA, 20 nt, Artificial Sequence
  Synthetic
cggguacucgcuccggggcg

SEQ ID NO: 41132 - RNA, 20 nt, Artificial Sequence
  Synthetic
cggguugggcccccaaaucg

SEQ ID NO: 41133 - RNA, 20 nt, Artificial Sequence
  Synthetic
cgguuccaguguaagggucg

SEQ ID NO: 41134 - RNA, 20 nt, Artificial Sequence
  Synthetic
cguaugcggcuggagggucg

SEQ ID NO: 41135 - RNA, 20 nt, Artificial Sequence
  Synthetic
ccugggggucgcaacguagg

SEQ ID NO: 41136 - RNA, 20 nt, Artificial Sequence
  Synthetic
accgggggcgccauguuagg

SEQ ID NO: 41137 - RNA, 20 nt, Artificial Sequence
  Synthetic
uguuggggcgccauguuagg

SEQ ID NO: 41138 - RNA, 20 nt, Artificial Sequence
  Synthetic
acuauauauacagggaccgg

SEQ ID NO: 41139 - RNA, 20 nt, Artificial Sequence
  Synthetic
auggccgcgcgucccagggg

SEQ ID NO: 41140 - RNA, 20 nt, Artificial Sequence
  Synthetic
uuggggggcgccauauuggg

SEQ ID NO: 41141 - RNA, 20 nt, Artificial Sequence
  Synthetic
cgcggacggagggucccugg

SEQ ID NO: 41142 - RNA, 20 nt, Artificial Sequence
  Synthetic
cugggacgcgcggccauugg

SEQ ID NO: 41143 - RNA, 20 nt, Artificial Sequence
  Synthetic
auuggggggcgccauauugg

SEQ ID NO: 41144 - RNA, 20 nt, Artificial Sequence
  Synthetic
ugucuggggcgccauauugg

SEQ ID NO: 41145 - RNA, 20 nt, Artificial Sequence
  Synthetic
cgcgcguaaccacuccccug

SEQ ID NO: 41146 - RNA, 20 nt, Artificial Sequence
  Synthetic
ucgcggacggagggucccug

SEQ ID NO: 41147 - RNA, 20 nt, Artificial Sequence
  Synthetic
agcgaguacccgccggccug

SEQ ID NO: 41148 - RNA, 20 nt, Artificial Sequence
  Synthetic
cggccccucaccucgcgcug

SEQ ID NO: 41149 - RNA, 20 nt, Artificial Sequence
  Synthetic
ccggcucccguguaugagug

SEQ ID NO: 41150 - RNA, 20 nt, Artificial Sequence
  Synthetic
ccugggacgcgcggccauug

SEQ ID NO: 41151 - RNA, 20 nt, Artificial Sequence
  Synthetic
uauuggggggcgccauauug

SEQ ID NO: 41152 - RNA, 20 nt, Artificial Sequence
  Synthetic
augucuggggcgccauauug

SEQ ID NO: 41153 - RNA, 20 nt, Artificial Sequence
  Synthetic
uggaaccggccgccauguug

SEQ ID NO: 41154 - RNA, 20 nt, Artificial Sequence
  Synthetic
acggcccggcccccgauuug

SEQ ID NO: 41155 - RNA, 20 nt, Artificial Sequence
  Synthetic
caugcuaaugggguucuuug

SEQ ID NO: 41156 - RNA, 20 nt, Artificial Sequence
  Synthetic
accggguugggcccccaaau

SEQ ID NO: 41157 - RNA, 20 nt, Artificial Sequence
  Synthetic
caauucccgcggcccuuaau

SEQ ID NO: 41158 - RNA, 20 nt, Artificial Sequence
  Synthetic
ccccugggacgcgcggccau

SEQ ID NO: 41159 - RNA, 20 nt, Artificial Sequence
  Synthetic
cauauuggggggcgccauau

SEQ ID NO: 41160 - RNA, 20 nt, Artificial Sequence
  Synthetic
ccaugucuggggcgccauau

SEQ ID NO: 41161 - RNA, 20 nt, Artificial Sequence
  Synthetic
accccggucccuguauauau

SEQ ID NO: 41162 - RNA, 20 nt, Artificial Sequence
  Synthetic
ccgcgcguaaccacuccccu

SEQ ID NO: 41163 - RNA, 20 nt, Artificial Sequence
  Synthetic
ugaacccgcauugguccccu

SEQ ID NO: 41164 - RNA, 20 nt, Artificial Sequence
  Synthetic
ccgccgacgcaacaggggcu

SEQ ID NO: 41165 - RNA, 20 nt, Artificial Sequence
  Synthetic
cccggcucccguguaugagu

SEQ ID NO: 41166 - RNA, 20 nt, Artificial Sequence
  Synthetic
aggccaagccccuguugcgu

SEQ ID NO: 41167 - RNA, 20 nt, Artificial Sequence
  Synthetic
auucuuugggggcgccgggu

SEQ ID NO: 41168 - RNA, 20 nt, Artificial Sequence
  Synthetic
acuggaaccggccgccaugu

SEQ ID NO: 41169 - RNA, 20 nt, Artificial Sequence
  Synthetic
acgggagccgggcgccaugu

SEQ ID NO: 41170 - RNA, 20 nt, Artificial Sequence
  Synthetic
cauauuggggggcgccaugu

SEQ ID NO: 41171 - RNA, 20 nt, Artificial Sequence
  Synthetic
agggaccggggucgcccugu

SEQ ID NO: 41172 - RNA, 20 nt, Artificial Sequence
  Synthetic
cccugggacgcgcggccauu

SEQ ID NO: 41173 - RNA, 20 nt, Artificial Sequence
  Synthetic
caugucuggggcgccauauu

SEQ ID NO: 41174 - RNA, 20 nt, Artificial Sequence
  Synthetic
aaucgucacugccgccccuu

SEQ ID NO: 41175 - RNA, 20 nt, Artificial Sequence
  Synthetic
cuggaaccggccgccauguu

SEQ ID NO: 41176 - RNA, 20 nt, Artificial Sequence
  Synthetic
cgggagccgggcgccauguu

SEQ ID NO: 41177 - RNA, 20 nt, Artificial Sequence
  Synthetic
auauuggggggcgccauguu

SEQ ID NO: 41178 - RNA, 20 nt, Artificial Sequence
  Synthetic
ccauguuggggcgccauguu

SEQ ID NO: 41179 - RNA, 20 nt, Artificial Sequence
  Synthetic
cacggcccggcccccgauuu

SEQ ID NO: 41180 - RNA, 20 nt, Artificial Sequence
  Synthetic
aucgucacugccgccccuuu

SEQ ID NO: 41181 - RNA, 17 nt, Artificial Sequence
  Synthetic
gccuuuccccuccccaa

SEQ ID NO: 41182 - RNA, 17 nt, Artificial Sequence
  Synthetic
gugggggucccccaaca

SEQ ID NO: 41183 - RNA, 17 nt, Artificial Sequence
  Synthetic
ggacccccacucauaca

SEQ ID NO: 41184 - RNA, 17 nt, Artificial Sequence
  Synthetic
gugacacuauauauaca

SEQ ID NO: 41185 - RNA, 17 nt, Artificial Sequence
  Synthetic
ggagggucgcggacgga

SEQ ID NO: 41186 - RNA, 17 nt, Artificial Sequence
  Synthetic
ggcuggagggucgcgga

SEQ ID NO: 41187 - RNA, 17 nt, Artificial Sequence
  Synthetic
ggguugguccccgggga

SEQ ID NO: 41188 - RNA, 17 nt, Artificial Sequence
  Synthetic
gguucuuugggggacac

SEQ ID NO: 41189 - RNA, 17 nt, Artificial Sequence
  Synthetic
gacccccacucauacac

SEQ ID NO: 41190 - RNA, 17 nt, Artificial Sequence
  Synthetic
guccccggggaccaacc

SEQ ID NO: 41191 - RNA, 17 nt, Artificial Sequence
  Synthetic
gauuugggggcccaacc

SEQ ID NO: 41192 - RNA, 17 nt, Artificial Sequence
  Synthetic
guucuuugggggacacc

SEQ ID NO: 41193 - RNA, 17 nt, Artificial Sequence
  Synthetic
gggaggcggggaauacc

SEQ ID NO: 41194 - RNA, 17 nt, Artificial Sequence
  Synthetic
ggaaggcgggaagcccc

SEQ ID NO: 41195 - RNA, 17 nt, Artificial Sequence
  Synthetic
gccugcgucggugcccc

SEQ ID NO: 41196 - RNA, 17 nt, Artificial Sequence
  Synthetic
ggugggccugccucccc

SEQ ID NO: 41197 - RNA, 17 nt, Artificial Sequence
  Synthetic
ggggcggccccgucccc

SEQ ID NO: 41198 - RNA, 17 nt, Artificial Sequence
  Synthetic
gggaaggcgggaagccc

SEQ ID NO: 41199 - RNA, 17 nt, Artificial Sequence
  Synthetic
gggguauaaguuagccc

SEQ ID NO: 41200 - RNA, 17 nt, Artificial Sequence
  Synthetic
ggccugcgucggugccc

SEQ ID NO: 41201 - RNA, 17 nt, Artificial Sequence
  Synthetic
ggcgccggguugguccc

SEQ ID NO: 41202 - RNA, 17 nt, Artificial Sequence
  Synthetic
gccccagacauggcgcc

SEQ ID NO: 41203 - RNA, 17 nt, Artificial Sequence
  Synthetic
gcgcgaggugaggggcc

SEQ ID NO: 41204 - RNA, 17 nt, Artificial Sequence
  Synthetic
ggcggcccgagucugcc

SEQ ID NO: 41205 - RNA, 17 nt, Artificial Sequence
  Synthetic
ggaggcaggcccaccgc

SEQ ID NO: 41206 - RNA, 17 nt, Artificial Sequence
  Synthetic
ggccccucaccucgcgc

SEQ ID NO: 41207 - RNA, 17 nt, Artificial Sequence
  Synthetic
gggggcggcccucaggc

SEQ ID NO: 41208 - RNA, 17 nt, Artificial Sequence
  Synthetic
gcggcccucaggccggc

SEQ ID NO: 41209 - RNA, 17 nt, Artificial Sequence
  Synthetic
gcccccaaaucgggggc

SEQ ID NO: 41210 - RNA, 17 nt, Artificial Sequence
  Synthetic
gguugggcccccaaauc

SEQ ID NO: 41211 - RNA, 17 nt, Artificial Sequence
  Synthetic
gccgccccuuuggggag

SEQ ID NO: 41212 - RNA, 17 nt, Artificial Sequence
  Synthetic
guugguccccggggacg

SEQ ID NO: 41213 - RNA, 17 nt, Artificial Sequence
  Synthetic
gggaggcaggcccaccg

SEQ ID NO: 41214 - RNA, 17 nt, Artificial Sequence
  Synthetic
gaaggcgggaagccccg

SEQ ID NO: 41215 - RNA, 17 nt, Artificial Sequence
  Synthetic
gggacggggccgccccg

SEQ ID NO: 41216 - RNA, 17 nt, Artificial Sequence
  Synthetic
gggcggccccguccccg

SEQ ID NO: 41217 - RNA, 17 nt, Artificial Sequence
  Synthetic
gccuccccugggacgcg

SEQ ID NO: 41218 - RNA, 17 nt, Artificial Sequence
  Synthetic
gaggcaggcccaccgcg

SEQ ID NO: 41219 - RNA, 17 nt, Artificial Sequence
  Synthetic
gggccgcccccagcgcg

SEQ ID NO: 41220 - RNA, 17 nt, Artificial Sequence
  Synthetic
gcgcggcgcgggaggcg

SEQ ID NO: 41221 - RNA, 17 nt, Artificial Sequence
  Synthetic
guacucgcuccggggcg

SEQ ID NO: 41222 - RNA, 17 nt, Artificial Sequence
  Synthetic
guugggcccccaaaucg

SEQ ID NO: 41223 - RNA, 17 nt, Artificial Sequence
  Synthetic
gaguuucuucgggaagg

SEQ ID NO: 41224 - RNA, 17 nt, Artificial Sequence
  Synthetic
guauauauagggucagg

SEQ ID NO: 41225 - RNA, 17 nt, Artificial Sequence
  Synthetic
guggugaugcggagagg

SEQ ID NO: 41226 - RNA, 17 nt, Artificial Sequence
  Synthetic
ggcggcccucaggccgg

SEQ ID NO: 41227 - RNA, 17 nt, Artificial Sequence
  Synthetic
gccgcgcgucccagggg

SEQ ID NO: 41228 - RNA, 17 nt, Artificial Sequence
  Synthetic
gcaggcccaccgcgggg

SEQ ID NO: 41229 - RNA, 17 nt, Artificial Sequence
  Synthetic
gugaugcggagaggggg

SEQ ID NO: 41230 - RNA, 17 nt, Artificial Sequence
  Synthetic
ggggucccccaacaugg

SEQ ID NO: 41231 - RNA, 17 nt, Artificial Sequence
  Synthetic
ggggcggggcuccaugg

SEQ ID NO: 41232 - RNA, 17 nt, Artificial Sequence
  Synthetic
ggacggagggucccugg

SEQ ID NO: 41233 - RNA, 17 nt, Artificial Sequence
  Synthetic
ggggggcgccauauugg

SEQ ID NO: 41234 - RNA, 17 nt, Artificial Sequence
  Synthetic
ggggggcgccauguugg

SEQ ID NO: 41235 - RNA, 17 nt, Artificial Sequence
  Synthetic
gcuaauugcuuuuuugg

SEQ ID NO: 41236 - RNA, 17 nt, Artificial Sequence
  Synthetic
ggaggggcaugcuaaug

SEQ ID NO: 41237 - RNA, 17 nt, Artificial Sequence
  Synthetic
gggcuucuguggugaug

SEQ ID NO: 41238 - RNA, 17 nt, Artificial Sequence
  Synthetic
gccgggcgccaugucug

SEQ ID NO: 41239 - RNA, 17 nt, Artificial Sequence
  Synthetic
gggaggggaaaggcgug

SEQ ID NO: 41240 - RNA, 17 nt, Artificial Sequence
  Synthetic
gcccccagcgcgaggug

SEQ ID NO: 41241 - RNA, 17 nt, Artificial Sequence
  Synthetic
gcccggcccccgauuug

SEQ ID NO: 41242 - RNA, 17 nt, Artificial Sequence
  Synthetic
gcuaaugauauucuuug

SEQ ID NO: 41243 - RNA, 17 nt, Artificial Sequence
  Synthetic
gcuaaugggguucuuug

SEQ ID NO: 41244 - RNA, 17 nt, Artificial Sequence
  Synthetic
ggguugggcccccaaau

SEQ ID NO: 41245 - RNA, 17 nt, Artificial Sequence
  Synthetic
gggaggggcaugcuaau

SEQ ID NO: 41246 - RNA, 17 nt, Artificial Sequence
  Synthetic
gugggccugccuccccu

SEQ ID NO: 41247 - RNA, 17 nt, Artificial Sequence
  Synthetic
gcggacggagggucccu

SEQ ID NO: 41248 - RNA, 17 nt, Artificial Sequence
  Synthetic
gccccucaccucgcgcu

SEQ ID NO: 41249 - RNA, 17 nt, Artificial Sequence
  Synthetic
ggccgggcgccaugucu

SEQ ID NO: 41250 - RNA, 17 nt, Artificial Sequence
  Synthetic
ggcucccguguaugagu

SEQ ID NO: 41251 - RNA, 17 nt, Artificial Sequence
  Synthetic
ggggaggggaaaggcgu

SEQ ID NO: 41252 - RNA, 17 nt, Artificial Sequence
  Synthetic
gguuccaguguaagggu

SEQ ID NO: 41253 - RNA, 17 nt, Artificial Sequence
  Synthetic
ggagccgggcgccaugu

SEQ ID NO: 41254 - RNA, 17 nt, Artificial Sequence
  Synthetic
gaccggggucgcccugu

SEQ ID NO: 41255 - RNA, 17 nt, Artificial Sequence
  Synthetic
gagccgggcgccauguu

SEQ ID NO: 41256 - RNA, 17 nt, Artificial Sequence
  Synthetic
ggcccggcccccgauuu

SEQ ID NO: 41257 - RNA, 17 nt, Artificial Sequence
  Synthetic
gucacugccgccccuuu

SEQ ID NO: 41258 - RNA, 20 nt, Artificial Sequence
  Synthetic
gggucgggggucccccaaca

SEQ ID NO: 41259 - RNA, 20 nt, Artificial Sequence
  Synthetic
gggggacccccacucauaca

SEQ ID NO: 41260 - RNA, 20 nt, Artificial Sequence
  Synthetic
gcuggagggucgcggacgga

SEQ ID NO: 41261 - RNA, 20 nt, Artificial Sequence
  Synthetic
gguaaugaguuucuucggga

SEQ ID NO: 41262 - RNA, 20 nt, Artificial Sequence
  Synthetic
gccggguugguccccgggga

SEQ ID NO: 41263 - RNA, 20 nt, Artificial Sequence
  Synthetic
gccccucccgccgacgcaac

SEQ ID NO: 41264 - RNA, 20 nt, Artificial Sequence
  Synthetic
gggacccccgacccuuacac

SEQ ID NO: 41265 - RNA, 20 nt, Artificial Sequence
  Synthetic
gacacuauauauacagggac

SEQ ID NO: 41266 - RNA, 20 nt, Artificial Sequence
  Synthetic
gggguucuuugggggacacc

SEQ ID NO: 41267 - RNA, 20 nt, Artificial Sequence
  Synthetic
gacccccaacagggcgaccc

SEQ ID NO: 41268 - RNA, 20 nt, Artificial Sequence
  Synthetic
ggggcgccggguuggucccc

SEQ ID NO: 41269 - RNA, 20 nt, Artificial Sequence
  Synthetic
gggggcgccggguugguccc

SEQ ID NO: 41270 - RNA, 20 nt, Artificial Sequence
  Synthetic
gggcccccaaaucgggggcc

SEQ ID NO: 41271 - RNA, 20 nt, Artificial Sequence
  Synthetic
gggggcggcccgagucugcc

SEQ ID NO: 41272 - RNA, 20 nt, Artificial Sequence
  Synthetic
gcugggggcggcccucaggc

SEQ ID NO: 41273 - RNA, 20 nt, Artificial Sequence
  Synthetic
ggggcggcccucaggccggc

SEQ ID NO: 41274 - RNA, 20 nt, Artificial Sequence
  Synthetic
gggucccccaacauggcggc

SEQ ID NO: 41275 - RNA, 20 nt, Artificial Sequence
  Synthetic
gcggguacucgcuccggggc

SEQ ID NO: 41276 - RNA, 20 nt, Artificial Sequence
  Synthetic
gaaccccaggggaccaaugc

SEQ ID NO: 41277 - RNA, 20 nt, Artificial Sequence
  Synthetic
guaugguaaugaguuucuuc

SEQ ID NO: 41278 - RNA, 20 nt, Artificial Sequence
  Synthetic
gcuucuguggugaugcggag

SEQ ID NO: 41279 - RNA, 20 nt, Artificial Sequence
  Synthetic
gcgggaggcggggaauaccg

SEQ ID NO: 41280 - RNA, 20 nt, Artificial Sequence
  Synthetic
gcggggcggccccguccccg

SEQ ID NO: 41281 - RNA, 20 nt, Artificial Sequence
  Synthetic
ggggaggcaggcccaccgcg

SEQ ID NO: 41282 - RNA, 20 nt, Artificial Sequence
  Synthetic
gggcgccauguuagggggcg

SEQ ID NO: 41283 - RNA, 20 nt, Artificial Sequence
  Synthetic
ggcuggagggucgcggacgg

SEQ ID NO: 41284 - RNA, 20 nt, Artificial Sequence
  Synthetic
gggggcggcccucaggccgg

SEQ ID NO: 41285 - RNA, 20 nt, Artificial Sequence
  Synthetic
gggacggggccgccccgcgg

SEQ ID NO: 41286 - RNA, 20 nt, Artificial Sequence
  Synthetic
gaggcaggcccaccgcgggg

SEQ ID NO: 41287 - RNA, 20 nt, Artificial Sequence
  Synthetic
guggugaugcggagaggggg

SEQ ID NO: 41288 - RNA, 20 nt, Artificial Sequence
  Synthetic
gucuggggcgccauauuggg

SEQ ID NO: 41289 - RNA, 20 nt, Artificial Sequence
  Synthetic
ggccccucaccucgcgcugg

SEQ ID NO: 41290 - RNA, 20 nt, Artificial Sequence
  Synthetic
ggaaccggccgccauguugg

SEQ ID NO: 41291 - RNA, 20 nt, Artificial Sequence
  Synthetic
gaccggggucgcccuguugg

SEQ ID NO: 41292 - RNA, 20 nt, Artificial Sequence
  Synthetic
ggaaccccaggggaccaaug

SEQ ID NO: 41293 - RNA, 20 nt, Artificial Sequence
  Synthetic
gcggggcuucuguggugaug

SEQ ID NO: 41294 - RNA, 20 nt, Artificial Sequence
  Synthetic
ggcuccaugggggucguaug

SEQ ID NO: 41295 - RNA, 20 nt, Artificial Sequence
  Synthetic
ggggccgggcgccaugucug

SEQ ID NO: 41296 - RNA, 20 nt, Artificial Sequence
  Synthetic
gccgcccccagcgcgaggug

SEQ ID NO: 41297 - RNA, 20 nt, Artificial Sequence
  Synthetic
gggcgccauguuagggggug

SEQ ID NO: 41298 - RNA, 20 nt, Artificial Sequence
  Synthetic
ggcgggaggggcaugcuaau

SEQ ID NO: 41299 - RNA, 20 nt, Artificial Sequence
  Synthetic
gucgcggacggagggucccu

SEQ ID NO: 41300 - RNA, 20 nt, Artificial Sequence
  Synthetic
gccgguuccaguguaagggu

SEQ ID NO: 41301 - RNA, 20 nt, Artificial Sequence
  Synthetic
gguaugguaaugaguuucuu

SEQ ID NO: 41302 - RNA, 20 nt, Artificial Sequence
  Synthetic
gggaccgggggcgccauguu

SEQ ID NO: 41303 - RNA, 20 nt, Artificial Sequence
  Synthetic
gcaugcuaaugauauucuuu

SEQ ID NO: 41304 - RNA, 20 nt, Artificial Sequence
  Synthetic
gcaugcuaaugggguucuuu

SEQ ID NO: 41305 - RNA, 20 nt, Artificial Sequence
  Synthetic
gguuaugcuaauugcuuuuu

SEQ ID NO: 41306 - RNA, 17 nt, Artificial Sequence
  Synthetic
ccuuuccccuccccaaa

SEQ ID NO: 41307 - RNA, 17 nt, Artificial Sequence
  Synthetic
agugacgauucccccaa

SEQ ID NO: 41308 - RNA, 17 nt, Artificial Sequence
  Synthetic
cccuuuggggaggggaa

SEQ ID NO: 41309 - RNA, 17 nt, Artificial Sequence
  Synthetic
cgggaggggcaugcuaa

SEQ ID NO: 41310 - RNA, 17 nt, Artificial Sequence
  Synthetic
aacauggcgccccaaca

SEQ ID NO: 41311 - RNA, 17 nt, Artificial Sequence
  Synthetic
cucccgccgacgcaaca

SEQ ID NO: 41312 - RNA, 17 nt, Artificial Sequence
  Synthetic
uuccacgcccccuaaca

SEQ ID NO: 41313 - RNA, 17 nt, Artificial Sequence
  Synthetic
uuuuuuggcggaacaca

SEQ ID NO: 41314 - RNA, 17 nt, Artificial Sequence
  Synthetic
auauggcgccccagaca

SEQ ID NO: 41315 - RNA, 17 nt, Artificial Sequence
  Synthetic
cugacccuauauauaca

SEQ ID NO: 41316 - RNA, 17 nt, Artificial Sequence
  Synthetic
ccauacccggaacccca

SEQ ID NO: 41317 - RNA, 17 nt, Artificial Sequence
  Synthetic
uccggggcggggcucca

SEQ ID NO: 41318 - RNA, 17 nt, Artificial Sequence
  Synthetic
aauaucauuagcaugca

SEQ ID NO: 41319 - RNA, 17 nt, Artificial Sequence
  Synthetic
cuguauauauaggguca

SEQ ID NO: 41320 - RNA, 17 nt, Artificial Sequence
  Synthetic
cuguauauauaguguca

SEQ ID NO: 41321 - RNA, 17 nt, Artificial Sequence
  Synthetic
cuguggugaugcggaga

SEQ ID NO: 41322 - RNA, 17 nt, Artificial Sequence
  Synthetic
aaugaguuucuucggga

SEQ ID NO: 41323 - RNA, 17 nt, Artificial Sequence
  Synthetic
ugccgccccuuugggga

SEQ ID NO: 41324 - RNA, 17 nt, Artificial Sequence
  Synthetic
cauggcgccccccaaua

SEQ ID NO: 41325 - RNA, 17 nt, Artificial Sequence
  Synthetic
cccugggguuccgggua

SEQ ID NO: 41326 - RNA, 17 nt, Artificial Sequence
  Synthetic
ccucccgccgacgcaac

SEQ ID NO: 41327 - RNA, 17 nt, Artificial Sequence
  Synthetic
uguauauauagugucac

SEQ ID NO: 41328 - RNA, 17 nt, Artificial Sequence
  Synthetic
acuauauauacagggac

SEQ ID NO: 41329 - RNA, 17 nt, Artificial Sequence
  Synthetic
ccugacccuauauauac

SEQ ID NO: 41330 - RNA, 17 nt, Artificial Sequence
  Synthetic
aagcaauuagcauaacc

SEQ ID NO: 41331 - RNA, 17 nt, Artificial Sequence
  Synthetic
aaacucauuaccauacc

SEQ ID NO: 41332 - RNA, 17 nt, Artificial Sequence
  Synthetic
cccuuaaugggcaaccc

SEQ ID NO: 41333 - RNA, 17 nt, Artificial Sequence
  Synthetic
ccccaacagggcgaccc

SEQ ID NO: 41334 - RNA, 17 nt, Artificial Sequence
  Synthetic
cccauggagccccgccc

SEQ ID NO: 41335 - RNA, 17 nt, Artificial Sequence
  Synthetic
cggggcggccccguccc

SEQ ID NO: 41336 - RNA, 17 nt, Artificial Sequence
  Synthetic
agcgagacgcagcagcc

SEQ ID NO: 41337 - RNA, 17 nt, Artificial Sequence
  Synthetic
acucauacacgggagcc

SEQ ID NO: 41338 - RNA, 17 nt, Artificial Sequence
  Synthetic
cauuagcaugcacggcc

SEQ ID NO: 41339 - RNA, 17 nt, Artificial Sequence
  Synthetic
cacuccccugggguucc

SEQ ID NO: 41340 - RNA, 17 nt, Artificial Sequence
  Synthetic
ugguccccugggguucc

SEQ ID NO: 41341 - RNA, 17 nt, Artificial Sequence
  Synthetic
cacucauacacgggagc

SEQ ID NO: 41342 - RNA, 17 nt, Artificial Sequence
  Synthetic
ccccggggcaccgacgc

SEQ ID NO: 41343 - RNA, 17 nt, Artificial Sequence
  Synthetic
aguuucuucgggaaggc

SEQ ID NO: 41344 - RNA, 17 nt, Artificial Sequence
  Synthetic
cgcgcggcgcgggaggc

SEQ ID NO: 41345 - RNA, 17 nt, Artificial Sequence
  Synthetic
cgcgucccaggggaggc

SEQ ID NO: 41346 - RNA, 17 nt, Artificial Sequence
  Synthetic
ucccccaacauggcggc

SEQ ID NO: 41347 - RNA, 17 nt, Artificial Sequence
  Synthetic
agcgcgaggugaggggc

SEQ ID NO: 41348 - RNA, 17 nt, Artificial Sequence
  Synthetic
ccccaggggaccaaugc

SEQ ID NO: 41349 - RNA, 17 nt, Artificial Sequence
  Synthetic
agcagccaggcagacuc

SEQ ID NO: 41350 - RNA, 17 nt, Artificial Sequence
  Synthetic
cgcugggggcggcccuc

SEQ ID NO: 41351 - RNA, 17 nt, Artificial Sequence
  Synthetic
ccuguauauauaggguc

SEQ ID NO: 41352 - RNA, 17 nt, Artificial Sequence
  Synthetic
ugguaaugaguuucuuc

SEQ ID NO: 41353 - RNA, 17 nt, Artificial Sequence
  Synthetic
ccacuccccugggguuc

SEQ ID NO: 41354 - RNA, 17 nt, Artificial Sequence
  Synthetic
uugguccccugggguuc

SEQ ID NO: 41355 - RNA, 17 nt, Artificial Sequence
  Synthetic
cuuuccccuccccaaag

SEQ ID NO: 41356 - RNA, 17 nt, Artificial Sequence
  Synthetic
cauacccggaaccccag

SEQ ID NO: 41357 - RNA, 17 nt, Artificial Sequence
  Synthetic
uguauauauagggucag

SEQ ID NO: 41358 - RNA, 17 nt, Artificial Sequence
  Synthetic
uguggugaugcggagag

SEQ ID NO: 41359 - RNA, 17 nt, Artificial Sequence
  Synthetic
ucuguggugaugcggag

SEQ ID NO: 41360 - RNA, 17 nt, Artificial Sequence
  Synthetic
uguugcgucggcgggag

SEQ ID NO: 41361 - RNA, 17 nt, Artificial Sequence
  Synthetic
ccggaaccccaggggag

SEQ ID NO: 41362 - RNA, 17 nt, Artificial Sequence
  Synthetic
ccccagcgcgaggugag

SEQ ID NO: 41363 - RNA, 17 nt, Artificial Sequence
  Synthetic
ucucgcuccgagugccg

SEQ ID NO: 41364 - RNA, 17 nt, Artificial Sequence
  Synthetic
ccgcgggccaaugcgcg

SEQ ID NO: 41365 - RNA, 17 nt, Artificial Sequence
  Synthetic
uggggaggggaaaggcg

SEQ ID NO: 41366 - RNA, 17 nt, Artificial Sequence
  Synthetic
uuccaguguaagggucg

SEQ ID NO: 41367 - RNA, 17 nt, Artificial Sequence
  Synthetic
augcggcuggagggucg

SEQ ID NO: 41368 - RNA, 17 nt, Artificial Sequence
  Synthetic
acgcgcggcgcgggagg

SEQ ID NO: 41369 - RNA, 17 nt, Artificial Sequence
  Synthetic
uggagggucgcggacgg

SEQ ID NO: 41370 - RNA, 17 nt, Artificial Sequence
  Synthetic
agccccuguugcgucgg

SEQ ID NO: 41371 - RNA, 17 nt, Artificial Sequence
  Synthetic
uccaguguaagggucgg

SEQ ID NO: 41372 - RNA, 17 nt, Artificial Sequence
  Synthetic
uccccuccccaaagggg

SEQ ID NO: 41373 - RNA, 17 nt, Artificial Sequence
  Synthetic
ucaccucgcgcuggggg

SEQ ID NO: 41374 - RNA, 17 nt, Artificial Sequence
  Synthetic
cugccgccccuuugggg

SEQ ID NO: 41375 - RNA, 17 nt, Artificial Sequence
  Synthetic
cucccguguaugagugg

SEQ ID NO: 41376 - RNA, 17 nt, Artificial Sequence
  Synthetic
accggccgccauguugg

SEQ ID NO: 41377 - RNA, 17 nt, Artificial Sequence
  Synthetic
cccggcccccgauuugg

SEQ ID NO: 41378 - RNA, 17 nt, Artificial Sequence
  Synthetic
cuaaugauauucuuugg

SEQ ID NO: 41379 - RNA, 17 nt, Artificial Sequence
  Synthetic
cuaaugggguucuuugg

SEQ ID NO: 41380 - RNA, 17 nt, Artificial Sequence
  Synthetic
accccaggggaccaaug

SEQ ID NO: 41381 - RNA, 17 nt, Artificial Sequence
  Synthetic
cggggcggggcuccaug

SEQ ID NO: 41382 - RNA, 17 nt, Artificial Sequence
  Synthetic
cggacggagggucccug

SEQ ID NO: 41383 - RNA, 17 nt, Artificial Sequence
  Synthetic
ccccucaccucgcgcug

SEQ ID NO: 41384 - RNA, 17 nt, Artificial Sequence
  Synthetic
cguaggcggggcuucug

SEQ ID NO: 41385 - RNA, 17 nt, Artificial Sequence
  Synthetic
cgccauguuagggggug

SEQ ID NO: 41386 - RNA, 17 nt, Artificial Sequence
  Synthetic
uggggggcgccauguug

SEQ ID NO: 41387 - RNA, 17 nt, Artificial Sequence
  Synthetic
ccggggucgcccuguug

SEQ ID NO: 41388 - RNA, 17 nt, Artificial Sequence
  Synthetic
ucacugccgccccuuug

SEQ ID NO: 41389 - RNA, 17 nt, Artificial Sequence
  Synthetic
ccggggcggggcuccau

SEQ ID NO: 41390 - RNA, 17 nt, Artificial Sequence
  Synthetic
auuugcaccucggcacu

SEQ ID NO: 41391 - RNA, 17 nt, Artificial Sequence
  Synthetic
cagcagccaggcagacu

SEQ ID NO: 41392 - RNA, 17 nt, Artificial Sequence
  Synthetic
acccgcauugguccccu

SEQ ID NO: 41393 - RNA, 17 nt, Artificial Sequence
  Synthetic
aggggcuuggccugcgu

SEQ ID NO: 41394 - RNA, 17 nt, Artificial Sequence
  Synthetic
ccaagccccuguugcgu

SEQ ID NO: 41395 - RNA, 17 nt, Artificial Sequence
  Synthetic
uuugggggacaccgggu

SEQ ID NO: 41396 - RNA, 17 nt, Artificial Sequence
  Synthetic
cggcccggcccccgauu

SEQ ID NO: 41397 - RNA, 17 nt, Artificial Sequence
  Synthetic
augcuaaugauauucuu

SEQ ID NO: 41398 - RNA, 17 nt, Artificial Sequence
  Synthetic
augcuaaugggguucuu

SEQ ID NO: 41399 - RNA, 17 nt, Artificial Sequence
  Synthetic
augguaaugaguuucuu

SEQ ID NO: 41400 - RNA, 17 nt, Artificial Sequence
  Synthetic
ugcuaaugauauucuuu

SEQ ID NO: 41401 - RNA, 17 nt, Artificial Sequence
  Synthetic
ugcuaaugggguucuuu

SEQ ID NO: 41402 - RNA, 17 nt, Artificial Sequence
  Synthetic
uaugcuaauugcuuuuu

SEQ ID NO: 41403 - RNA, 20 nt, Artificial Sequence
  Synthetic
acgccuuuccccuccccaaa

SEQ ID NO: 41404 - RNA, 20 nt, Artificial Sequence
  Synthetic
cacgccuuuccccuccccaa

SEQ ID NO: 41405 - RNA, 20 nt, Artificial Sequence
  Synthetic
cgccccuuuggggaggggaa

SEQ ID NO: 41406 - RNA, 20 nt, Artificial Sequence
  Synthetic
auaccgggguugcccauuaa

SEQ ID NO: 41407 - RNA, 20 nt, Artificial Sequence
  Synthetic
ccccucccgccgacgcaaca

SEQ ID NO: 41408 - RNA, 20 nt, Artificial Sequence
  Synthetic
ugcuuuuuuggcggaacaca

SEQ ID NO: 41409 - RNA, 20 nt, Artificial Sequence
  Synthetic
ccccugacccuauauauaca

SEQ ID NO: 41410 - RNA, 20 nt, Artificial Sequence
  Synthetic
ccagccgcauacgaccccca

SEQ ID NO: 41411 - RNA, 20 nt, Artificial Sequence
  Synthetic
cgcuccggggcggggcucca

SEQ ID NO: 41412 - RNA, 20 nt, Artificial Sequence
  Synthetic
aagaauaucauuagcaugca

SEQ ID NO: 41413 - RNA, 20 nt, Artificial Sequence
  Synthetic
cacugccgccccuuugggga

SEQ ID NO: 41414 - RNA, 20 nt, Artificial Sequence
  Synthetic
ccgcccccagcgcgagguga

SEQ ID NO: 41415 - RNA, 20 nt, Artificial Sequence
  Synthetic
cauguuggggcgccauguua

SEQ ID NO: 41416 - RNA, 20 nt, Artificial Sequence
  Synthetic
cccgacccuuacacuggaac

SEQ ID NO: 41417 - RNA, 20 nt, Artificial Sequence
  Synthetic
cccuguauauauagugucac

SEQ ID NO: 41418 - RNA, 20 nt, Artificial Sequence
  Synthetic
cccccugacccuauauauac

SEQ ID NO: 41419 - RNA, 20 nt, Artificial Sequence
  Synthetic
aaaaagcaauuagcauaacc

SEQ ID NO: 41420 - RNA, 20 nt, Artificial Sequence
  Synthetic
aagaaacucauuaccauacc

SEQ ID NO: 41421 - RNA, 20 nt, Artificial Sequence
  Synthetic
uuagcauaacccggaacccc

SEQ ID NO: 41422 - RNA, 20 nt, Artificial Sequence
  Synthetic
cgcggugggccugccucccc

SEQ ID NO: 41423 - RNA, 20 nt, Artificial Sequence
  Synthetic
cgcggggcggccccgucccc

SEQ ID NO: 41424 - RNA, 20 nt, Artificial Sequence
  Synthetic
augaacccgcauuggucccc

SEQ ID NO: 41425 - RNA, 20 nt, Artificial Sequence
  Synthetic
uucgggaaggcgggaagccc

SEQ ID NO: 41426 - RNA, 20 nt, Artificial Sequence
  Synthetic
cgugggguauaaguuagccc

SEQ ID NO: 41427 - RNA, 20 nt, Artificial Sequence
  Synthetic
acccccauggagccccgccc

SEQ ID NO: 41428 - RNA, 20 nt, Artificial Sequence
  Synthetic
ccccaauggccgcgcguccc

SEQ ID NO: 41429 - RNA, 20 nt, Artificial Sequence
  Synthetic
cggagcgagacgcagcagcc

SEQ ID NO: 41430 - RNA, 20 nt, Artificial Sequence
  Synthetic
cccacucauacacgggagcc

SEQ ID NO: 41431 - RNA, 20 nt, Artificial Sequence
  Synthetic
ugauauucuuugggggcgcc

SEQ ID NO: 41432 - RNA, 20 nt, Artificial Sequence
  Synthetic
ccagcgcgaggugaggggcc

SEQ ID NO: 41433 - RNA, 20 nt, Artificial Sequence
  Synthetic
aaccacuccccugggguucc

SEQ ID NO: 41434 - RNA, 20 nt, Artificial Sequence
  Synthetic
cauugguccccugggguucc

SEQ ID NO: 41435 - RNA, 20 nt, Artificial Sequence
  Synthetic
aagccccggggcaccgacgc

SEQ ID NO: 41436 - RNA, 20 nt, Artificial Sequence
  Synthetic
aggggaggcaggcccaccgc

SEQ ID NO: 41437 - RNA, 20 nt, Artificial Sequence
  Synthetic
cccggccccucaccucgcgc

SEQ ID NO: 41438 - RNA, 20 nt, Artificial Sequence
  Synthetic
augaguuucuucgggaaggc

SEQ ID NO: 41439 - RNA, 20 nt, Artificial Sequence
  Synthetic
uuacgcgcggcgcgggaggc

SEQ ID NO: 41440 - RNA, 20 nt, Artificial Sequence
  Synthetic
ccgcgcgucccaggggaggc

SEQ ID NO: 41441 - RNA, 20 nt, Artificial Sequence
  Synthetic
cccagcgcgaggugaggggc

SEQ ID NO: 41442 - RNA, 20 nt, Artificial Sequence
  Synthetic
ugggcccccaaaucgggggc

SEQ ID NO: 41443 - RNA, 20 nt, Artificial Sequence
  Synthetic
uuaagggccgcgggaauugc

SEQ ID NO: 41444 - RNA, 20 nt, Artificial Sequence
  Synthetic
cgcagcagccaggcagacuc

SEQ ID NO: 41445 - RNA, 20 nt, Artificial Sequence
  Synthetic
ccgguuccaguguaaggguc

SEQ ID NO: 41446 - RNA, 20 nt, Artificial Sequence
  Synthetic
uaaccacuccccugggguuc

SEQ ID NO: 41447 - RNA, 20 nt, Artificial Sequence
  Synthetic
cgccuuuccccuccccaaag

SEQ ID NO: 41448 - RNA, 20 nt, Artificial Sequence
  Synthetic
cccuguauauauagggucag

SEQ ID NO: 41449 - RNA, 20 nt, Artificial Sequence
  Synthetic
aacccggaaccccaggggag

SEQ ID NO: 41450 - RNA, 20 nt, Artificial Sequence
  Synthetic
acugccgccccuuuggggag

SEQ ID NO: 41451 - RNA, 20 nt, Artificial Sequence
  Synthetic
cgcccccagcgcgaggugag

SEQ ID NO: 41452 - RNA, 20 nt, Artificial Sequence
  Synthetic
ccuguauauauagugucacg

SEQ ID NO: 41453 - RNA, 20 nt, Artificial Sequence
  Synthetic
caggggaggcaggcccaccg

SEQ ID NO: 41454 - RNA, 20 nt, Artificial Sequence
  Synthetic
cgggaaggcgggaagccccg

SEQ ID NO: 41455 - RNA, 20 nt, Artificial Sequence
  Synthetic
ccggggacggggccgccccg

SEQ ID NO: 41456 - RNA, 20 nt, Artificial Sequence
  Synthetic
uggccugcgucggugccccg

SEQ ID NO: 41457 - RNA, 20 nt, Artificial Sequence
  Synthetic
ccugccuccccugggacgcg

SEQ ID NO: 41458 - RNA, 20 nt, Artificial Sequence
  Synthetic
ugagggccgcccccagcgcg

SEQ ID NO: 41459 - RNA, 20 nt, Artificial Sequence
  Synthetic
cuuuggggaggggaaaggcg

SEQ ID NO: 41460 - RNA, 20 nt, Artificial Sequence
  Synthetic
uacgcgcggcgcgggaggcg

SEQ ID NO: 41461 - RNA, 20 nt, Artificial Sequence
  Synthetic
ugggggucgcaacguaggcg

SEQ ID NO: 41462 - RNA, 20 nt, Artificial Sequence
  Synthetic
aaugaguuucuucgggaagg

SEQ ID NO: 41463 - RNA, 20 nt, Artificial Sequence
  Synthetic
ccuguauauauagggucagg

SEQ ID NO: 41464 - RNA, 20 nt, Artificial Sequence
  Synthetic
ucuguggugaugcggagagg

SEQ ID NO: 41465 - RNA, 20 nt, Artificial Sequence
  Synthetic
ccaagccccuguugcgucgg

SEQ ID NO: 41466 - RNA, 20 nt, Artificial Sequence
  Synthetic
cuuuccccuccccaaagggg

SEQ ID NO: 41467 - RNA, 20 nt, Artificial Sequence
  Synthetic
cccucaccucgcgcuggggg

SEQ ID NO: 41468 - RNA, 20 nt, Artificial Sequence
  Synthetic
ucacugccgccccuuugggg

SEQ ID NO: 41469 - RNA, 20 nt, Artificial Sequence
  Synthetic
uccggggcggggcuccaugg

SEQ ID NO: 41470 - RNA, 20 nt, Artificial Sequence
  Synthetic
ugggggucguaugcggcugg

SEQ ID NO: 41471 - RNA, 20 nt, Artificial Sequence
  Synthetic
cggcucccguguaugagugg

SEQ ID NO: 41472 - RNA, 20 nt, Artificial Sequence
  Synthetic
auuggggggcgccauguugg

SEQ ID NO: 41473 - RNA, 20 nt, Artificial Sequence
  Synthetic
cggcccggcccccgauuugg

SEQ ID NO: 41474 - RNA, 20 nt, Artificial Sequence
  Synthetic
augcuaaugauauucuuugg

SEQ ID NO: 41475 - RNA, 20 nt, Artificial Sequence
  Synthetic
augcuaaugggguucuuugg

SEQ ID NO: 41476 - RNA, 20 nt, Artificial Sequence
  Synthetic
uaugcuaauugcuuuuuugg

SEQ ID NO: 41477 - RNA, 20 nt, Artificial Sequence
  Synthetic
cuccggggcggggcuccaug

SEQ ID NO: 41478 - RNA, 20 nt, Artificial Sequence
  Synthetic
caacguaggcggggcuucug

SEQ ID NO: 41479 - RNA, 20 nt, Artificial Sequence
  Synthetic
uuggggaggggaaaggcgug

SEQ ID NO: 41480 - RNA, 20 nt, Artificial Sequence
  Synthetic
uauuggggggcgccauguug

SEQ ID NO: 41481 - RNA, 20 nt, Artificial Sequence
  Synthetic
ucgucacugccgccccuuug

SEQ ID NO: 41482 - RNA, 20 nt, Artificial Sequence
  Synthetic
caugcuaaugauauucuuug

SEQ ID NO: 41483 - RNA, 20 nt, Artificial Sequence
  Synthetic
acacacggccccucgcgcau

SEQ ID NO: 41484 - RNA, 20 nt, Artificial Sequence
  Synthetic
cgcauuugcaccucggcacu

SEQ ID NO: 41485 - RNA, 20 nt, Artificial Sequence
  Synthetic
acgcagcagccaggcagacu

SEQ ID NO: 41486 - RNA, 20 nt, Artificial Sequence
  Synthetic
ccggccccucaccucgcgcu

SEQ ID NO: 41487 - RNA, 20 nt, Artificial Sequence
  Synthetic
aggggccgggcgccaugucu

SEQ ID NO: 41488 - RNA, 20 nt, Artificial Sequence
  Synthetic
uuuggggaggggaaaggcgu

SEQ ID NO: 41489 - RNA, 20 nt, Artificial Sequence
  Synthetic
aacaggggcuuggccugcgu

SEQ ID NO: 41490 - RNA, 20 nt, Artificial Sequence
  Synthetic
uucuuugggggacaccgggu

SEQ ID NO: 41491 - RNA, 20 nt, Artificial Sequence
  Synthetic
auauuggggggcgccauauu

SEQ ID NO: 41492 - RNA, 20 nt, Artificial Sequence
  Synthetic
ugcaugcuaaugauauucuu

SEQ ID NO: 41493 - RNA, 20 nt, Artificial Sequence
  Synthetic
ucuuugggggacaccggguu

SEQ ID NO: 41494 - RNA, 17 nt, Artificial Sequence
  Synthetic
gggcuaaggggaaaaaa

SEQ ID NO: 41495 - RNA, 17 nt, Artificial Sequence
  Synthetic
cgggcuaaggggaaaaa

SEQ ID NO: 41496 - RNA, 17 nt, Artificial Sequence
  Synthetic
ccugcgucugagucaaa

SEQ ID NO: 41497 - RNA, 17 nt, Artificial Sequence
  Synthetic
ggaagaggggggagaaa

SEQ ID NO: 41498 - RNA, 17 nt, Artificial Sequence
  Synthetic
aaggggucugcaaccaa

SEQ ID NO: 41499 - RNA, 17 nt, Artificial Sequence
  Synthetic
cgggaguuaccgcccaa

SEQ ID NO: 41500 - RNA, 17 nt, Artificial Sequence
  Synthetic
cgguaacucccgcccaa

SEQ ID NO: 41501 - RNA, 17 nt, Artificial Sequence
  Synthetic
gaggggucgggauccaa

SEQ ID NO: 41502 - RNA, 17 nt, Artificial Sequence
  Synthetic
cccugcgucugagucaa

SEQ ID NO: 41503 - RNA, 17 nt, Artificial Sequence
  Synthetic
aggggggcggguaagaa

SEQ ID NO: 41504 - RNA, 17 nt, Artificial Sequence
  Synthetic
cggaagaggggggagaa

SEQ ID NO: 41505 - RNA, 17 nt, Artificial Sequence
  Synthetic
cauccggggcgggcuaa

SEQ ID NO: 41506 - RNA, 17 nt, Artificial Sequence
  Synthetic
uagaugcgugugaguaa

SEQ ID NO: 41507 - RNA, 17 nt, Artificial Sequence
  Synthetic
aauuagaaacucauuaa

SEQ ID NO: 41508 - RNA, 17 nt, Artificial Sequence
  Synthetic
ggaccacgcccccaaca

SEQ ID NO: 41509 - RNA, 17 nt, Artificial Sequence
  Synthetic
uaccgggaagcggaaca

SEQ ID NO: 41510 - RNA, 17 nt, Artificial Sequence
  Synthetic
cccacaacaaacacaca

SEQ ID NO: 41511 - RNA, 17 nt, Artificial Sequence
  Synthetic
cccccaacacauacaca

SEQ ID NO: 41512 - RNA, 17 nt, Artificial Sequence
  Synthetic
gccagcccgcccucaca

SEQ ID NO: 41513 - RNA, 17 nt, Artificial Sequence
  Synthetic
ugagucaggggguccca

SEQ ID NO: 41514 - RNA, 17 nt, Artificial Sequence
  Synthetic
cggagucggggguccca

SEQ ID NO: 41515 - RNA, 17 nt, Artificial Sequence
  Synthetic
gccggcuccgcgggcca

SEQ ID NO: 41516 - RNA, 17 nt, Artificial Sequence
  Synthetic
cucuuccgaggccagca

SEQ ID NO: 41517 - RNA, 17 nt, Artificial Sequence
  Synthetic
ccuuugacucagacgca

SEQ ID NO: 41518 - RNA, 17 nt, Artificial Sequence
  Synthetic
gccucgggccccaggca

SEQ ID NO: 41519 - RNA, 17 nt, Artificial Sequence
  Synthetic
gggccagggcccgggca

SEQ ID NO: 41520 - RNA, 17 nt, Artificial Sequence
  Synthetic
ucucuguguaugaguca

SEQ ID NO: 41521 - RNA, 17 nt, Artificial Sequence
  Synthetic
gagaagagggaagaaga

SEQ ID NO: 41522 - RNA, 17 nt, Artificial Sequence
  Synthetic
uggagggcgggagaaga

SEQ ID NO: 41523 - RNA, 17 nt, Artificial Sequence
  Synthetic
cugcuggccucggaaga

SEQ ID NO: 41524 - RNA, 17 nt, Artificial Sequence
  Synthetic
gaggcgggggggggaga

SEQ ID NO: 41525 - RNA, 17 nt, Artificial Sequence
  Synthetic
gcucuccggagagacga

SEQ ID NO: 41526 - RNA, 17 nt, Artificial Sequence
  Synthetic
ggucgggauccaaagga

SEQ ID NO: 41527 - RNA, 17 nt, Artificial Sequence
  Synthetic
acuccggugcgucugga

SEQ ID NO: 41528 - RNA, 17 nt, Artificial Sequence
  Synthetic
ggcggcccgcccuguga

SEQ ID NO: 41529 - RNA, 17 nt, Artificial Sequence
  Synthetic
acggcgucccccaaaua

SEQ ID NO: 41530 - RNA, 17 nt, Artificial Sequence
  Synthetic
acauccggggcgggcua

SEQ ID NO: 41531 - RNA, 17 nt, Artificial Sequence
  Synthetic
uuacucacacgcaucua

SEQ ID NO: 41532 - RNA, 17 nt, Artificial Sequence
  Synthetic
cuagaugcgugugagua

SEQ ID NO: 41533 - RNA, 17 nt, Artificial Sequence
  Synthetic
ccgcccacuucccggua

SEQ ID NO: 41534 - RNA, 17 nt, Artificial Sequence
  Synthetic
uguuccgcuucccggua

SEQ ID NO: 41535 - RNA, 17 nt, Artificial Sequence
  Synthetic
ccgcccuccagacgcac

SEQ ID NO: 41536 - RNA, 17 nt, Artificial Sequence
  Synthetic
ggccagggcccgggcac

SEQ ID NO: 41537 - RNA, 17 nt, Artificial Sequence
  Synthetic
agccagcccgcccucac

SEQ ID NO: 41538 - RNA, 17 nt, Artificial Sequence
  Synthetic
cccgcgagcgggccgac

SEQ ID NO: 41539 - RNA, 17 nt, Artificial Sequence
  Synthetic
aacaaacacacaaggac

SEQ ID NO: 41540 - RNA, 17 nt, Artificial Sequence
  Synthetic
cgccucgggggcgggac

SEQ ID NO: 41541 - RNA, 17 nt, Artificial Sequence
  Synthetic
guuucuaauuaccauac

SEQ ID NO: 41542 - RNA, 17 nt, Artificial Sequence
  Synthetic
guuuuuaauuaccauac

SEQ ID NO: 41543 - RNA, 17 nt, Artificial Sequence
  Synthetic
ccucggccuccgccacc

SEQ ID NO: 41544 - RNA, 17 nt, Artificial Sequence
  Synthetic
ccgcgagcgggccgacc

SEQ ID NO: 41545 - RNA, 17 nt, Artificial Sequence
  Synthetic
acaaacacacaaggacc

SEQ ID NO: 41546 - RNA, 17 nt, Artificial Sequence
  Synthetic
uuucuaauuaccauacc

SEQ ID NO: 41547 - RNA, 17 nt, Artificial Sequence
  Synthetic
uuuuuaauuaccauacc

SEQ ID NO: 41548 - RNA, 17 nt, Artificial Sequence
  Synthetic
agcuccgcggaagaccc

SEQ ID NO: 41549 - RNA, 17 nt, Artificial Sequence
  Synthetic
ccccaacacggcgaccc

SEQ ID NO: 41550 - RNA, 17 nt, Artificial Sequence
  Synthetic
gggucccacggcgaccc

SEQ ID NO: 41551 - RNA, 17 nt, Artificial Sequence
  Synthetic
ggucccacggcgacccc

SEQ ID NO: 41552 - RNA, 17 nt, Artificial Sequence
  Synthetic
cacgggccucgggcccc

SEQ ID NO: 41553 - RNA, 17 nt, Artificial Sequence
  Synthetic
uuccccuuagcccgccc

SEQ ID NO: 41554 - RNA, 17 nt, Artificial Sequence
  Synthetic
ucauuaaugggcggccc

SEQ ID NO: 41555 - RNA, 17 nt, Artificial Sequence
  Synthetic
uccgcgggccagggccc

SEQ ID NO: 41556 - RNA, 17 nt, Artificial Sequence
  Synthetic
acucagacgcagggccc

SEQ ID NO: 41557 - RNA, 17 nt, Artificial Sequence
  Synthetic
ggcccgugcccgggccc

SEQ ID NO: 41558 - RNA, 17 nt, Artificial Sequence
  Synthetic
gcccgaggcccgugccc

SEQ ID NO: 41559 - RNA, 17 nt, Artificial Sequence
  Synthetic
ucuuccgcggagcuccc

SEQ ID NO: 41560 - RNA, 17 nt, Artificial Sequence
  Synthetic
cuuggugcggagcuccc

SEQ ID NO: 41561 - RNA, 17 nt, Artificial Sequence
  Synthetic
ggcgccggaaccgagcc

SEQ ID NO: 41562 - RNA, 17 nt, Artificial Sequence
  Synthetic
ggcucgguuccggcgcc

SEQ ID NO: 41563 - RNA, 17 nt, Artificial Sequence
  Synthetic
guuagaccgaguucgcc

SEQ ID NO: 41564 - RNA, 17 nt, Artificial Sequence
  Synthetic
ggcccgcggagccggcc

SEQ ID NO: 41565 - RNA, 17 nt, Artificial Sequence
  Synthetic
uuacacccgaggcggcc

SEQ ID NO: 41566 - RNA, 17 nt, Artificial Sequence
  Synthetic
ccgggaagugggcggcc

SEQ ID NO: 41567 - RNA, 17 nt, Artificial Sequence
  Synthetic
cuccgcgggccagggcc

SEQ ID NO: 41568 - RNA, 17 nt, Artificial Sequence
  Synthetic
gacucagacgcagggcc

SEQ ID NO: 41569 - RNA, 17 nt, Artificial Sequence
  Synthetic
ggccggcuccgcgggcc

SEQ ID NO: 41570 - RNA, 17 nt, Artificial Sequence
  Synthetic
gccagcgcggcggggcc

SEQ ID NO: 41571 - RNA, 17 nt, Artificial Sequence
  Synthetic
gccgagucuucggggcc

SEQ ID NO: 41572 - RNA, 17 nt, Artificial Sequence
  Synthetic
uuaccgcccaaugggcc

SEQ ID NO: 41573 - RNA, 17 nt, Artificial Sequence
  Synthetic
cucccgcccaaugggcc

SEQ ID NO: 41574 - RNA, 17 nt, Artificial Sequence
  Synthetic
gcggacgcugguuggcc

SEQ ID NO: 41575 - RNA, 17 nt, Artificial Sequence
  Synthetic
ggcccgaggcccgugcc

SEQ ID NO: 41576 - RNA, 17 nt, Artificial Sequence
  Synthetic
ggucaucgggccgugcc

SEQ ID NO: 41577 - RNA, 17 nt, Artificial Sequence
  Synthetic
gaaacacccagacaucc

SEQ ID NO: 41578 - RNA, 17 nt, Artificial Sequence
  Synthetic
gucuuccgcggagcucc

SEQ ID NO: 41579 - RNA, 17 nt, Artificial Sequence
  Synthetic
gcuuggugcggagcucc

SEQ ID NO: 41580 - RNA, 17 nt, Artificial Sequence
  Synthetic
ccgggccgcccacuucc

SEQ ID NO: 41581 - RNA, 17 nt, Artificial Sequence
  Synthetic
ggccuuguuccgcuucc

SEQ ID NO: 41582 - RNA, 17 nt, Artificial Sequence
  Synthetic
ccucuuccgaggccagc

SEQ ID NO: 41583 - RNA, 17 nt, Artificial Sequence
  Synthetic
cucgugggcccgcgagc

SEQ ID NO: 41584 - RNA, 17 nt, Artificial Sequence
  Synthetic
gcccuggcccgcggagc

SEQ ID NO: 41585 - RNA, 17 nt, Artificial Sequence
  Synthetic
cccuuugacucagacgc

SEQ ID NO: 41586 - RNA, 17 nt, Artificial Sequence
  Synthetic
gaagacucggcggacgc

SEQ ID NO: 41587 - RNA, 17 nt, Artificial Sequence
  Synthetic
ugggugcugauugacgc

SEQ ID NO: 41588 - RNA, 17 nt, Artificial Sequence
  Synthetic
cccacugacucauacgc

SEQ ID NO: 41589 - RNA, 17 nt, Artificial Sequence
  Synthetic
cgccgggccggcuccgc

SEQ ID NO: 41590 - RNA, 17 nt, Artificial Sequence
  Synthetic
gccgggccccgccgcgc

SEQ ID NO: 41591 - RNA, 17 nt, Artificial Sequence
  Synthetic
ccuccgccacccggcgc

SEQ ID NO: 41592 - RNA, 17 nt, Artificial Sequence
  Synthetic
gggcucgguuccggcgc

SEQ ID NO: 41593 - RNA, 17 nt, Artificial Sequence
  Synthetic
ccggucggcccgcucgc

SEQ ID NO: 41594 - RNA, 17 nt, Artificial Sequence
  Synthetic
cguuagaccgaguucgc

SEQ ID NO: 41595 - RNA, 17 nt, Artificial Sequence
  Synthetic
gcaggacuuugugaggc

SEQ ID NO: 41596 - RNA, 17 nt, Artificial Sequence
  Synthetic
gcggccgccagcgcggc

SEQ ID NO: 41597 - RNA, 17 nt, Artificial Sequence
  Synthetic
gcccgcccucacagggc

SEQ ID NO: 41598 - RNA, 17 nt, Artificial Sequence
  Synthetic
cggugcgucuggagggc

SEQ ID NO: 41599 - RNA, 17 nt, Artificial Sequence
  Synthetic
gcccgcccugugagggc

SEQ ID NO: 41600 - RNA, 17 nt, Artificial Sequence
  Synthetic
gaccgaguucgccgggc

SEQ ID NO: 41601 - RNA, 17 nt, Artificial Sequence
  Synthetic
gcccugugagggcgggc

SEQ ID NO: 41602 - RNA, 17 nt, Artificial Sequence
  Synthetic
acccagacauccggggc

SEQ ID NO: 41603 - RNA, 17 nt, Artificial Sequence
  Synthetic
cgggccgccucgggggc

SEQ ID NO: 41604 - RNA, 17 nt, Artificial Sequence
  Synthetic
ggggaaaaaaggggggc

SEQ ID NO: 41605 - RNA, 17 nt, Artificial Sequence
  Synthetic
gaggccagcaggggggc

SEQ ID NO: 41606 - RNA, 17 nt, Artificial Sequence
  Synthetic
guuaccgcccaaugggc

SEQ ID NO: 41607 - RNA, 17 nt, Artificial Sequence
  Synthetic
acucccgcccaaugggc

SEQ ID NO: 41608 - RNA, 17 nt, Artificial Sequence
  Synthetic
ggcccggcccauugggc

SEQ ID NO: 41609 - RNA, 17 nt, Artificial Sequence
  Synthetic
uccggagagacgauggc

SEQ ID NO: 41610 - RNA, 17 nt, Artificial Sequence
  Synthetic
cgucccccaaauauggc

SEQ ID NO: 41611 - RNA, 17 nt, Artificial Sequence
  Synthetic
ggcggacgcugguuggc

SEQ ID NO: 41612 - RNA, 17 nt, Artificial Sequence
  Synthetic
aaguccugccccccugc

SEQ ID NO: 41613 - RNA, 17 nt, Artificial Sequence
  Synthetic
ggaaacacccagacauc

SEQ ID NO: 41614 - RNA, 17 nt, Artificial Sequence
  Synthetic
aggccgaggcggucauc

SEQ ID NO: 41615 - RNA, 17 nt, Artificial Sequence
  Synthetic
cgugggacccccgacuc

SEQ ID NO: 41616 - RNA, 17 nt, Artificial Sequence
  Synthetic
aagacccaggccgccuc

SEQ ID NO: 41617 - RNA, 17 nt, Artificial Sequence
  Synthetic
acagggcgggccgccuc

SEQ ID NO: 41618 - RNA, 17 nt, Artificial Sequence
  Synthetic
gcccgggcacgggccuc

SEQ ID NO: 41619 - RNA, 17 nt, Artificial Sequence
  Synthetic
cgcaccaagccgcucuc

SEQ ID NO: 41620 - RNA, 17 nt, Artificial Sequence
  Synthetic
uccugccaucgucucuc

SEQ ID NO: 41621 - RNA, 17 nt, Artificial Sequence
  Synthetic
ccagacgcaccggaguc

SEQ ID NO: 41622 - RNA, 17 nt, Artificial Sequence
  Synthetic
gucucuguguaugaguc

SEQ ID NO: 41623 - RNA, 17 nt, Artificial Sequence
  Synthetic
cccgacuccggugcguc

SEQ ID NO: 41624 - RNA, 17 nt, Artificial Sequence
  Synthetic
agggaagaagagggguc

SEQ ID NO: 41625 - RNA, 17 nt, Artificial Sequence
  Synthetic
ugcaaccaaaggugguc

SEQ ID NO: 41626 - RNA, 17 nt, Artificial Sequence
  Synthetic
agcccgccccggauguc

SEQ ID NO: 41627 - RNA, 17 nt, Artificial Sequence
  Synthetic
gcguccgccgagucuuc

SEQ ID NO: 41628 - RNA, 17 nt, Artificial Sequence
  Synthetic
ccgaccgggcucgguuc

SEQ ID NO: 41629 - RNA, 17 nt, Artificial Sequence
  Synthetic
ggcuaaggggaaaaaag

SEQ ID NO: 41630 - RNA, 17 nt, Artificial Sequence
  Synthetic
cugcgucugagucaaag

SEQ ID NO: 41631 - RNA, 17 nt, Artificial Sequence
  Synthetic
gaagaggggggagaaag

SEQ ID NO: 41632 - RNA, 17 nt, Artificial Sequence
  Synthetic
aauuaaaaacuugcaag

SEQ ID NO: 41633 - RNA, 17 nt, Artificial Sequence
  Synthetic
ggagaagagggaagaag

SEQ ID NO: 41634 - RNA, 17 nt, Artificial Sequence
  Synthetic
cuggagggcgggagaag

SEQ ID NO: 41635 - RNA, 17 nt, Artificial Sequence
  Synthetic
ccugcuggccucggaag

SEQ ID NO: 41636 - RNA, 17 nt, Artificial Sequence
  Synthetic
auuaccauaccgggaag

SEQ ID NO: 41637 - RNA, 17 nt, Artificial Sequence
  Synthetic
auccggggcgggcuaag

SEQ ID NO: 41638 - RNA, 17 nt, Artificial Sequence
  Synthetic
agaugcgugugaguaag

SEQ ID NO: 41639 - RNA, 17 nt, Artificial Sequence
  Synthetic
ucuuccgaggccagcag

SEQ ID NO: 41640 - RNA, 17 nt, Artificial Sequence
  Synthetic
gccugcguaugagucag

SEQ ID NO: 41641 - RNA, 17 nt, Artificial Sequence
  Synthetic
cucuguguaugagucag

SEQ ID NO: 41642 - RNA, 17 nt, Artificial Sequence
  Synthetic
agaagagggaagaagag

SEQ ID NO: 41643 - RNA, 17 nt, Artificial Sequence
  Synthetic
ugcuggccucggaagag

SEQ ID NO: 41644 - RNA, 17 nt, Artificial Sequence
  Synthetic
aucgucucuccggagag

SEQ ID NO: 41645 - RNA, 17 nt, Artificial Sequence
  Synthetic
aggcgggggggggagag

SEQ ID NO: 41646 - RNA, 17 nt, Artificial Sequence
  Synthetic
gcucgugggcccgcgag

SEQ ID NO: 41647 - RNA, 17 nt, Artificial Sequence
  Synthetic
ugaggcgggggggggag

SEQ ID NO: 41648 - RNA, 17 nt, Artificial Sequence
  Synthetic
uacucacacgcaucuag

SEQ ID NO: 41649 - RNA, 17 nt, Artificial Sequence
  Synthetic
gugggugcugauugacg

SEQ ID NO: 41650 - RNA, 17 nt, Artificial Sequence
  Synthetic
caaacacacaaggaccg

SEQ ID NO: 41651 - RNA, 17 nt, Artificial Sequence
  Synthetic
gucuaacguuacacccg

SEQ ID NO: 41652 - RNA, 17 nt, Artificial Sequence
  Synthetic
ggccagucccgcccccg

SEQ ID NO: 41653 - RNA, 17 nt, Artificial Sequence
  Synthetic
cucagacgcagggcccg

SEQ ID NO: 41654 - RNA, 17 nt, Artificial Sequence
  Synthetic
gccgugccuggggcccg

SEQ ID NO: 41655 - RNA, 17 nt, Artificial Sequence
  Synthetic
gcccgggcccuggcccg

SEQ ID NO: 41656 - RNA, 17 nt, Artificial Sequence
  Synthetic
auauuugggggacgccg

SEQ ID NO: 41657 - RNA, 17 nt, Artificial Sequence
  Synthetic
agggcccggggucgccg

SEQ ID NO: 41658 - RNA, 17 nt, Artificial Sequence
  Synthetic
ccggguggcggaggccg

SEQ ID NO: 41659 - RNA, 17 nt, Artificial Sequence
  Synthetic
aaacacccagacauccg

SEQ ID NO: 41660 - RNA, 17 nt, Artificial Sequence
  Synthetic
agcucccgggagcuccg

SEQ ID NO: 41661 - RNA, 17 nt, Artificial Sequence
  Synthetic
ucgccgggccggcuccg

SEQ ID NO: 41662 - RNA, 17 nt, Artificial Sequence
  Synthetic
uucuccccccucuuccg

SEQ ID NO: 41663 - RNA, 17 nt, Artificial Sequence
  Synthetic
gcggccugggucuuccg

SEQ ID NO: 41664 - RNA, 17 nt, Artificial Sequence
  Synthetic
aucggcggccgccagcg

SEQ ID NO: 41665 - RNA, 17 nt, Artificial Sequence
  Synthetic
caggacuuugugaggcg

SEQ ID NO: 41666 - RNA, 17 nt, Artificial Sequence
  Synthetic
cggccgccagcgcggcg

SEQ ID NO: 41667 - RNA, 17 nt, Artificial Sequence
  Synthetic
ucgccguguugggggcg

SEQ ID NO: 41668 - RNA, 17 nt, Artificial Sequence
  Synthetic
ccaagcguauauaugcg

SEQ ID NO: 41669 - RNA, 17 nt, Artificial Sequence
  Synthetic
gggagagggggaacucg

SEQ ID NO: 41670 - RNA, 17 nt, Artificial Sequence
  Synthetic
cagggcgggccgccucg

SEQ ID NO: 41671 - RNA, 17 nt, Artificial Sequence
  Synthetic
cccggucggcccgcucg

SEQ ID NO: 41672 - RNA, 17 nt, Artificial Sequence
  Synthetic
cagacgcaccggagucg

SEQ ID NO: 41673 - RNA, 17 nt, Artificial Sequence
  Synthetic
cguccgccgagucuucg

SEQ ID NO: 41674 - RNA, 17 nt, Artificial Sequence
  Synthetic
gcuaaggggaaaaaagg

SEQ ID NO: 41675 - RNA, 17 nt, Artificial Sequence
  Synthetic
gggucugcaaccaaagg

SEQ ID NO: 41676 - RNA, 17 nt, Artificial Sequence
  Synthetic
gaugcgugugaguaagg

SEQ ID NO: 41677 - RNA, 17 nt, Artificial Sequence
  Synthetic
cuuccgaggccagcagg

SEQ ID NO: 41678 - RNA, 17 nt, Artificial Sequence
  Synthetic
ucuguguaugagucagg

SEQ ID NO: 41679 - RNA, 17 nt, Artificial Sequence
  Synthetic
gcuggccucggaagagg

SEQ ID NO: 41680 - RNA, 17 nt, Artificial Sequence
  Synthetic
ggcgggggggggagagg

SEQ ID NO: 41681 - RNA, 17 nt, Artificial Sequence
  Synthetic
uaacguuacacccgagg

SEQ ID NO: 41682 - RNA, 17 nt, Artificial Sequence
  Synthetic
cagucccgcccccgagg

SEQ ID NO: 41683 - RNA, 17 nt, Artificial Sequence
  Synthetic
gguggcggaggccgagg

SEQ ID NO: 41684 - RNA, 17 nt, Artificial Sequence
  Synthetic
ggcaggacuuugugagg

SEQ ID NO: 41685 - RNA, 17 nt, Artificial Sequence
  Synthetic
acucacacgcaucuagg

SEQ ID NO: 41686 - RNA, 17 nt, Artificial Sequence
  Synthetic
ggcggccgccagcgcgg

SEQ ID NO: 41687 - RNA, 17 nt, Artificial Sequence
  Synthetic
aggacuuugugaggcgg

SEQ ID NO: 41688 - RNA, 17 nt, Artificial Sequence
  Synthetic
ccggcgccggguggcgg

SEQ ID NO: 41689 - RNA, 17 nt, Artificial Sequence
  Synthetic
cgggacuggccaaucgg

SEQ ID NO: 41690 - RNA, 17 nt, Artificial Sequence
  Synthetic
gggccccgaagacucgg

SEQ ID NO: 41691 - RNA, 17 nt, Artificial Sequence
  Synthetic
agggcgggccgccucgg

SEQ ID NO: 41692 - RNA, 17 nt, Artificial Sequence
  Synthetic
agacgcaccggagucgg

SEQ ID NO: 41693 - RNA, 17 nt, Artificial Sequence
  Synthetic
cuaaggggaaaaaaggg

SEQ ID NO: 41694 - RNA, 17 nt, Artificial Sequence
  Synthetic
augcgugugaguaaggg

SEQ ID NO: 41695 - RNA, 17 nt, Artificial Sequence
  Synthetic
agcccgcccucacaggg

SEQ ID NO: 41696 - RNA, 17 nt, Artificial Sequence
  Synthetic
uuccgaggccagcaggg

SEQ ID NO: 41697 - RNA, 17 nt, Artificial Sequence
  Synthetic
cuggccucggaagaggg

SEQ ID NO: 41698 - RNA, 17 nt, Artificial Sequence
  Synthetic
ccggugcgucuggaggg

SEQ ID NO: 41699 - RNA, 17 nt, Artificial Sequence
  Synthetic
ggcccgcccugugaggg

SEQ ID NO: 41700 - RNA, 17 nt, Artificial Sequence
  Synthetic
cucacacgcaucuaggg

SEQ ID NO: 41701 - RNA, 17 nt, Artificial Sequence
  Synthetic
ucgguuccggcgccggg

SEQ ID NO: 41702 - RNA, 17 nt, Artificial Sequence
  Synthetic
ggacuuugugaggcggg

SEQ ID NO: 41703 - RNA, 17 nt, Artificial Sequence
  Synthetic
cccccaaauauggcggg

SEQ ID NO: 41704 - RNA, 17 nt, Artificial Sequence
  Synthetic
cacccagacauccgggg

SEQ ID NO: 41705 - RNA, 17 nt, Artificial Sequence
  Synthetic
gacuuugugaggcgggg

SEQ ID NO: 41706 - RNA, 17 nt, Artificial Sequence
  Synthetic
acuuugugaggcggggg

SEQ ID NO: 41707 - RNA, 17 nt, Artificial Sequence
  Synthetic
gcgggccgccucggggg

SEQ ID NO: 41708 - RNA, 17 nt, Artificial Sequence
  Synthetic
aggggaaaaaagggggg

SEQ ID NO: 41709 - RNA, 17 nt, Artificial Sequence
  Synthetic
acacgcaucuagggggg

SEQ ID NO: 41710 - RNA, 17 nt, Artificial Sequence
  Synthetic
cuuugugaggcgggggg

SEQ ID NO: 41711 - RNA, 17 nt, Artificial Sequence
  Synthetic
gcggguaagaauggggg

SEQ ID NO: 41712 - RNA, 17 nt, Artificial Sequence
  Synthetic
ggcggguaagaaugggg

SEQ ID NO: 41713 - RNA, 17 nt, Artificial Sequence
  Synthetic
caucuaggggggugggg

SEQ ID NO: 41714 - RNA, 17 nt, Artificial Sequence
  Synthetic
gggcggguaagaauggg

SEQ ID NO: 41715 - RNA, 17 nt, Artificial Sequence
  Synthetic
agaaacucauuaauggg

SEQ ID NO: 41716 - RNA, 17 nt, Artificial Sequence
  Synthetic
ccauaccgggaaguggg

SEQ ID NO: 41717 - RNA, 17 nt, Artificial Sequence
  Synthetic
cggcccggcccauuggg

SEQ ID NO: 41718 - RNA, 17 nt, Artificial Sequence
  Synthetic
gggcccggcccauuggg

SEQ ID NO: 41719 - RNA, 17 nt, Artificial Sequence
  Synthetic
ggggcggguaagaaugg

SEQ ID NO: 41720 - RNA, 17 nt, Artificial Sequence
  Synthetic
gcgucccccaaauaugg

SEQ ID NO: 41721 - RNA, 17 nt, Artificial Sequence
  Synthetic
gggccccgccgcgcugg

SEQ ID NO: 41722 - RNA, 17 nt, Artificial Sequence
  Synthetic
gacuccggugcgucugg

SEQ ID NO: 41723 - RNA, 17 nt, Artificial Sequence
  Synthetic
guuccggcgccgggugg

SEQ ID NO: 41724 - RNA, 17 nt, Artificial Sequence
  Synthetic
uuguguguuuguugugg

SEQ ID NO: 41725 - RNA, 17 nt, Artificial Sequence
  Synthetic
cggggucgccguguugg

SEQ ID NO: 41726 - RNA, 17 nt, Artificial Sequence
  Synthetic
ccauguguauguguugg

SEQ ID NO: 41727 - RNA, 17 nt, Artificial Sequence
  Synthetic
ccgcccgccauauuugg

SEQ ID NO: 41728 - RNA, 17 nt, Artificial Sequence
  Synthetic
gggggcggguaagaaug

SEQ ID NO: 41729 - RNA, 17 nt, Artificial Sequence
  Synthetic
ucaucgggccgugccug

SEQ ID NO: 41730 - RNA, 17 nt, Artificial Sequence
  Synthetic
cugcguaugagucagug

SEQ ID NO: 41731 - RNA, 17 nt, Artificial Sequence
  Synthetic
acgcaucuaggggggug

SEQ ID NO: 41732 - RNA, 17 nt, Artificial Sequence
  Synthetic
cggagagcggcuuggug

SEQ ID NO: 41733 - RNA, 17 nt, Artificial Sequence
  Synthetic
aggcggcccgcccugug

SEQ ID NO: 41734 - RNA, 17 nt, Artificial Sequence
  Synthetic
cuuguguguuuguugug

SEQ ID NO: 41735 - RNA, 17 nt, Artificial Sequence
  Synthetic
gggggcaggacuuugug

SEQ ID NO: 41736 - RNA, 17 nt, Artificial Sequence
  Synthetic
ccggggucgccguguug

SEQ ID NO: 41737 - RNA, 17 nt, Artificial Sequence
  Synthetic
gccauguguauguguug

SEQ ID NO: 41738 - RNA, 17 nt, Artificial Sequence
  Synthetic
uccuuguguguuuguug

SEQ ID NO: 41739 - RNA, 17 nt, Artificial Sequence
  Synthetic
gccgcccgccauauuug

SEQ ID NO: 41740 - RNA, 17 nt, Artificial Sequence
  Synthetic
gggaguuaccgcccaau

SEQ ID NO: 41741 - RNA, 17 nt, Artificial Sequence
  Synthetic
gguaacucccgcccaau

SEQ ID NO: 41742 - RNA, 17 nt, Artificial Sequence
  Synthetic
gggcgggacuggccaau

SEQ ID NO: 41743 - RNA, 17 nt, Artificial Sequence
  Synthetic
ggggggcggguaagaau

SEQ ID NO: 41744 - RNA, 17 nt, Artificial Sequence
  Synthetic
auuagaaacucauuaau

SEQ ID NO: 41745 - RNA, 17 nt, Artificial Sequence
  Synthetic
ugggcggcccggcccau

SEQ ID NO: 41746 - RNA, 17 nt, Artificial Sequence
  Synthetic
uucggggcccggcccau

SEQ ID NO: 41747 - RNA, 17 nt, Artificial Sequence
  Synthetic
gaggccgaggcggucau

SEQ ID NO: 41748 - RNA, 17 nt, Artificial Sequence
  Synthetic
cgcuggcggccgccgau

SEQ ID NO: 41749 - RNA, 17 nt, Artificial Sequence
  Synthetic
agccggcccggcgaacu

SEQ ID NO: 41750 - RNA, 17 nt, Artificial Sequence
  Synthetic
gccgggccccgaagacu

SEQ ID NO: 41751 - RNA, 17 nt, Artificial Sequence
  Synthetic
cggcccgaugaccgccu

SEQ ID NO: 41752 - RNA, 17 nt, Artificial Sequence
  Synthetic
gaagacccaggccgccu

SEQ ID NO: 41753 - RNA, 17 nt, Artificial Sequence
  Synthetic
cacagggcgggccgccu

SEQ ID NO: 41754 - RNA, 17 nt, Artificial Sequence
  Synthetic
uacacccgaggcggccu

SEQ ID NO: 41755 - RNA, 17 nt, Artificial Sequence
  Synthetic
ggcccgggcacgggccu

SEQ ID NO: 41756 - RNA, 17 nt, Artificial Sequence
  Synthetic
ugccccccugcuggccu

SEQ ID NO: 41757 - RNA, 17 nt, Artificial Sequence
  Synthetic
gucaucgggccgugccu

SEQ ID NO: 41758 - RNA, 17 nt, Artificial Sequence
  Synthetic
ccgcgcauauauacgcu

SEQ ID NO: 41759 - RNA, 17 nt, Artificial Sequence
  Synthetic
cucuccggagagcggcu

SEQ ID NO: 41760 - RNA, 17 nt, Artificial Sequence
  Synthetic
agcgggccgaccgggcu

SEQ ID NO: 41761 - RNA, 17 nt, Artificial Sequence
  Synthetic
cuuacucacacgcaucu

SEQ ID NO: 41762 - RNA, 17 nt, Artificial Sequence
  Synthetic
gcaaccaaagguggucu

SEQ ID NO: 41763 - RNA, 17 nt, Artificial Sequence
  Synthetic
gcccgccccggaugucu

SEQ ID NO: 41764 - RNA, 17 nt, Artificial Sequence
  Synthetic
uuaccauaccgggaagu

SEQ ID NO: 41765 - RNA, 17 nt, Artificial Sequence
  Synthetic
ccugcguaugagucagu

SEQ ID NO: 41766 - RNA, 17 nt, Artificial Sequence
  Synthetic
uccagacgcaccggagu

SEQ ID NO: 41767 - RNA, 17 nt, Artificial Sequence
  Synthetic
uauuugggggacgccgu

SEQ ID NO: 41768 - RNA, 17 nt, Artificial Sequence
  Synthetic
gggcccggggucgccgu

SEQ ID NO: 41769 - RNA, 17 nt, Artificial Sequence
  Synthetic
ggagagggggaacucgu

SEQ ID NO: 41770 - RNA, 17 nt, Artificial Sequence
  Synthetic
ccggaaccgagcccggu

SEQ ID NO: 41771 - RNA, 17 nt, Artificial Sequence
  Synthetic
gagggaagaagaggggu

SEQ ID NO: 41772 - RNA, 17 nt, Artificial Sequence
  Synthetic
cacgcaucuaggggggu

SEQ ID NO: 41773 - RNA, 17 nt, Artificial Sequence
  Synthetic
acucggcggacgcuggu

SEQ ID NO: 41774 - RNA, 17 nt, Artificial Sequence
  Synthetic
gaccggggucgccgugu

SEQ ID NO: 41775 - RNA, 17 nt, Artificial Sequence
  Synthetic
gggccauguguaugugu

SEQ ID NO: 41776 - RNA, 17 nt, Artificial Sequence
  Synthetic
ccuuguguguuuguugu

SEQ ID NO: 41777 - RNA, 17 nt, Artificial Sequence
  Synthetic
gggcggcccggcccauu

SEQ ID NO: 41778 - RNA, 17 nt, Artificial Sequence
  Synthetic
ucggggcccggcccauu

SEQ ID NO: 41779 - RNA, 17 nt, Artificial Sequence
  Synthetic
gagccgcccgccauauu

SEQ ID NO: 41780 - RNA, 17 nt, Artificial Sequence
  Synthetic
cggacccagaccaccuu

SEQ ID NO: 41781 - RNA, 17 nt, Artificial Sequence
  Synthetic
ggucuggguccguccuu

SEQ ID NO: 41782 - RNA, 17 nt, Artificial Sequence
  Synthetic
agcguccgccgagucuu

SEQ ID NO: 41783 - RNA, 17 nt, Artificial Sequence
  Synthetic
accggggucgccguguu

SEQ ID NO: 41784 - RNA, 17 nt, Artificial Sequence
  Synthetic
ggccauguguauguguu

SEQ ID NO: 41785 - RNA, 17 nt, Artificial Sequence
  Synthetic
agccgcccgccauauuu

SEQ ID NO: 41786 - RNA, 20 nt, Artificial Sequence
  Synthetic
ggcgggcuaaggggaaaaaa

SEQ ID NO: 41787 - RNA, 20 nt, Artificial Sequence
  Synthetic
gggcgggcuaaggggaaaaa

SEQ ID NO: 41788 - RNA, 20 nt, Artificial Sequence
  Synthetic
ggcccugcgucugagucaaa

SEQ ID NO: 41789 - RNA, 20 nt, Artificial Sequence
  Synthetic
cucggaagaggggggagaaa

SEQ ID NO: 41790 - RNA, 20 nt, Artificial Sequence
  Synthetic
agaaaggggucugcaaccaa

SEQ ID NO: 41791 - RNA, 20 nt, Artificial Sequence
  Synthetic
gggcgggaguuaccgcccaa

SEQ ID NO: 41792 - RNA, 20 nt, Artificial Sequence
  Synthetic
gggcgguaacucccgcccaa

SEQ ID NO: 41793 - RNA, 20 nt, Artificial Sequence
  Synthetic
gaagaggggucgggauccaa

SEQ ID NO: 41794 - RNA, 20 nt, Artificial Sequence
  Synthetic
gggcccugcgucugagucaa

SEQ ID NO: 41795 - RNA, 20 nt, Artificial Sequence
  Synthetic
aaaaggggggcggguaagaa

SEQ ID NO: 41796 - RNA, 20 nt, Artificial Sequence
  Synthetic
ccucggaagaggggggagaa

SEQ ID NO: 41797 - RNA, 20 nt, Artificial Sequence
  Synthetic
agacauccggggcgggcuaa

SEQ ID NO: 41798 - RNA, 20 nt, Artificial Sequence
  Synthetic
cccuagaugcgugugaguaa

SEQ ID NO: 41799 - RNA, 20 nt, Artificial Sequence
  Synthetic
gguaauuagaaacucauuaa

SEQ ID NO: 41800 - RNA, 20 nt, Artificial Sequence
  Synthetic
uggggaccacgcccccaaca

SEQ ID NO: 41801 - RNA, 20 nt, Artificial Sequence
  Synthetic
ccauaccgggaagcggaaca

SEQ ID NO: 41802 - RNA, 20 nt, Artificial Sequence
  Synthetic
gcccccacaacaaacacaca

SEQ ID NO: 41803 - RNA, 20 nt, Artificial Sequence
  Synthetic
agacccccaacacauacaca

SEQ ID NO: 41804 - RNA, 20 nt, Artificial Sequence
  Synthetic
ggagccagcccgcccucaca

SEQ ID NO: 41805 - RNA, 20 nt, Artificial Sequence
  Synthetic
guaugagucaggggguccca

SEQ ID NO: 41806 - RNA, 20 nt, Artificial Sequence
  Synthetic
caccggagucggggguccca

SEQ ID NO: 41807 - RNA, 20 nt, Artificial Sequence
  Synthetic
cgggccggcuccgcgggcca

SEQ ID NO: 41808 - RNA, 20 nt, Artificial Sequence
  Synthetic
ccccucuuccgaggccagca

SEQ ID NO: 41809 - RNA, 20 nt, Artificial Sequence
  Synthetic
gccccuuugacucagacgca

SEQ ID NO: 41810 - RNA, 20 nt, Artificial Sequence
  Synthetic
cgggccucgggccccaggca

SEQ ID NO: 41811 - RNA, 20 nt, Artificial Sequence
  Synthetic
cgcgggccagggcccgggca

SEQ ID NO: 41812 - RNA, 20 nt, Artificial Sequence
  Synthetic
gugucucuguguaugaguca

SEQ ID NO: 41813 - RNA, 20 nt, Artificial Sequence
  Synthetic
cgggagaagagggaagaaga

SEQ ID NO: 41814 - RNA, 20 nt, Artificial Sequence
  Synthetic
gucuggagggcgggagaaga

SEQ ID NO: 41815 - RNA, 20 nt, Artificial Sequence
  Synthetic
ccccugcuggccucggaaga

SEQ ID NO: 41816 - RNA, 20 nt, Artificial Sequence
  Synthetic
ugugaggcgggggggggaga

SEQ ID NO: 41817 - RNA, 20 nt, Artificial Sequence
  Synthetic
gccgcucuccggagagacga

SEQ ID NO: 41818 - RNA, 20 nt, Artificial Sequence
  Synthetic
aggggucgggauccaaagga

SEQ ID NO: 41819 - RNA, 20 nt, Artificial Sequence
  Synthetic
ccgacuccggugcgucugga

SEQ ID NO: 41820 - RNA, 20 nt, Artificial Sequence
  Synthetic
cgaggcggcccgcccuguga

SEQ ID NO: 41821 - RNA, 20 nt, Artificial Sequence
  Synthetic
cccacggcgucccccaaaua

SEQ ID NO: 41822 - RNA, 20 nt, Artificial Sequence
  Synthetic
cagacauccggggcgggcua

SEQ ID NO: 41823 - RNA, 20 nt, Artificial Sequence
  Synthetic
cccuuacucacacgcaucua

SEQ ID NO: 41824 - RNA, 20 nt, Artificial Sequence
  Synthetic
ccccuagaugcgugugagua

SEQ ID NO: 41825 - RNA, 20 nt, Artificial Sequence
  Synthetic
gggccgcccacuucccggua

SEQ ID NO: 41826 - RNA, 20 nt, Artificial Sequence
  Synthetic
ccuuguuccgcuucccggua

SEQ ID NO: 41827 - RNA, 20 nt, Artificial Sequence
  Synthetic
cucccgcccuccagacgcac

SEQ ID NO: 41828 - RNA, 20 nt, Artificial Sequence
  Synthetic
gcgggccagggcccgggcac

SEQ ID NO: 41829 - RNA, 20 nt, Artificial Sequence
  Synthetic
uggagccagcccgcccucac

SEQ ID NO: 41830 - RNA, 20 nt, Artificial Sequence
  Synthetic
gggcccgcgagcgggccgac

SEQ ID NO: 41831 - RNA, 20 nt, Artificial Sequence
  Synthetic
cacaacaaacacacaaggac

SEQ ID NO: 41832 - RNA, 20 nt, Artificial Sequence
  Synthetic
ggccgccucgggggcgggac

SEQ ID NO: 41833 - RNA, 20 nt, Artificial Sequence
  Synthetic
ugaguuucuaauuaccauac

SEQ ID NO: 41834 - RNA, 20 nt, Artificial Sequence
  Synthetic
caaguuuuuaauuaccauac

SEQ ID NO: 41835 - RNA, 20 nt, Artificial Sequence
  Synthetic
ccgccucggccuccgccacc

SEQ ID NO: 41836 - RNA, 20 nt, Artificial Sequence
  Synthetic
ggcccgcgagcgggccgacc

SEQ ID NO: 41837 - RNA, 20 nt, Artificial Sequence
  Synthetic
acaacaaacacacaaggacc

SEQ ID NO: 41838 - RNA, 20 nt, Artificial Sequence
  Synthetic
gaguuucuaauuaccauacc

SEQ ID NO: 41839 - RNA, 20 nt, Artificial Sequence
  Synthetic
aaguuuuuaauuaccauacc

SEQ ID NO: 41840 - RNA, 20 nt, Artificial Sequence
  Synthetic
gggagcuccgcggaagaccc

SEQ ID NO: 41841 - RNA, 20 nt, Artificial Sequence
  Synthetic
cgcccccaacacggcgaccc

SEQ ID NO: 41842 - RNA, 20 nt, Artificial Sequence
  Synthetic
agggggucccacggcgaccc

SEQ ID NO: 41843 - RNA, 20 nt, Artificial Sequence
  Synthetic
gggggucccacggcgacccc

SEQ ID NO: 41844 - RNA, 20 nt, Artificial Sequence
  Synthetic
gggcacgggccucgggcccc

SEQ ID NO: 41845 - RNA, 20 nt, Artificial Sequence
  Synthetic
uuuuuccccuuagcccgccc

SEQ ID NO: 41846 - RNA, 20 nt, Artificial Sequence
  Synthetic
aacucauuaaugggcggccc

SEQ ID NO: 41847 - RNA, 20 nt, Artificial Sequence
  Synthetic
ggcuccgcgggccagggccc

SEQ ID NO: 41848 - RNA, 20 nt, Artificial Sequence
  Synthetic
uugacucagacgcagggccc

SEQ ID NO: 41849 - RNA, 20 nt, Artificial Sequence
  Synthetic
cgaggcccgugcccgggccc

SEQ ID NO: 41850 - RNA, 20 nt, Artificial Sequence
  Synthetic
ggggcccgaggcccgugccc

SEQ ID NO: 41851 - RNA, 20 nt, Artificial Sequence
  Synthetic
gggucuuccgcggagcuccc

SEQ ID NO: 41852 - RNA, 20 nt, Artificial Sequence
  Synthetic
cggcuuggugcggagcuccc

SEQ ID NO: 41853 - RNA, 20 nt, Artificial Sequence
  Synthetic
cccggcgccggaaccgagcc

SEQ ID NO: 41854 - RNA, 20 nt, Artificial Sequence
  Synthetic
ccgggcucgguuccggcgcc

SEQ ID NO: 41855 - RNA, 20 nt, Artificial Sequence
  Synthetic
aacguuagaccgaguucgcc

SEQ ID NO: 41856 - RNA, 20 nt, Artificial Sequence
  Synthetic
ccuggcccgcggagccggcc

SEQ ID NO: 41857 - RNA, 20 nt, Artificial Sequence
  Synthetic
acguuacacccgaggcggcc

SEQ ID NO: 41858 - RNA, 20 nt, Artificial Sequence
  Synthetic
auaccgggaagugggcggcc

SEQ ID NO: 41859 - RNA, 20 nt, Artificial Sequence
  Synthetic
cggcuccgcgggccagggcc

SEQ ID NO: 41860 - RNA, 20 nt, Artificial Sequence
  Synthetic
uuugacucagacgcagggcc

SEQ ID NO: 41861 - RNA, 20 nt, Artificial Sequence
  Synthetic
ccgggccggcuccgcgggcc

SEQ ID NO: 41862 - RNA, 20 nt, Artificial Sequence
  Synthetic
gccgccagcgcggcggggcc

SEQ ID NO: 41863 - RNA, 20 nt, Artificial Sequence
  Synthetic
uccgccgagucuucggggcc

SEQ ID NO: 41864 - RNA, 20 nt, Artificial Sequence
  Synthetic
gaguuaccgcccaaugggcc

SEQ ID NO: 41865 - RNA, 20 nt, Artificial Sequence
  Synthetic
uaacucccgcccaaugggcc

SEQ ID NO: 41866 - RNA, 20 nt, Artificial Sequence
  Synthetic
ucggcggacgcugguuggcc

SEQ ID NO: 41867 - RNA, 20 nt, Artificial Sequence
  Synthetic
uggggcccgaggcccgugcc

SEQ ID NO: 41868 - RNA, 20 nt, Artificial Sequence
  Synthetic
ggcggucaucgggccgugcc

SEQ ID NO: 41869 - RNA, 20 nt, Artificial Sequence
  Synthetic
agggaaacacccagacaucc

SEQ ID NO: 41870 - RNA, 20 nt, Artificial Sequence
  Synthetic
ugggucuuccgcggagcucc

SEQ ID NO: 41871 - RNA, 20 nt, Artificial Sequence
  Synthetic
gcggcuuggugcggagcucc

SEQ ID NO: 41872 - RNA, 20 nt, Artificial Sequence
  Synthetic
gggccgggccgcccacuucc

SEQ ID NO: 41873 - RNA, 20 nt, Artificial Sequence
  Synthetic
agaggccuuguuccgcuucc

SEQ ID NO: 41874 - RNA, 20 nt, Artificial Sequence
  Synthetic
cccccucuuccgaggccagc

SEQ ID NO: 41875 - RNA, 20 nt, Artificial Sequence
  Synthetic
cggcucgugggcccgcgagc

SEQ ID NO: 41876 - RNA, 20 nt, Artificial Sequence
  Synthetic
cgggcccuggcccgcggagc

SEQ ID NO: 41877 - RNA, 20 nt, Artificial Sequence
  Synthetic
ggccccuuugacucagacgc

SEQ ID NO: 41878 - RNA, 20 nt, Artificial Sequence
  Synthetic
cccgaagacucggcggacgc

SEQ ID NO: 41879 - RNA, 20 nt, Artificial Sequence
  Synthetic
ucgugggugcugauugacgc

SEQ ID NO: 41880 - RNA, 20 nt, Artificial Sequence
  Synthetic
guccccacugacucauacgc

SEQ ID NO: 41881 - RNA, 20 nt, Artificial Sequence
  Synthetic
guucgccgggccggcuccgc

SEQ ID NO: 41882 - RNA, 20 nt, Artificial Sequence
  Synthetic
uuggccgggccccgccgcgc

SEQ ID NO: 41883 - RNA, 20 nt, Artificial Sequence
  Synthetic
cggccuccgccacccggcgc

SEQ ID NO: 41884 - RNA, 20 nt, Artificial Sequence
  Synthetic
accgggcucgguuccggcgc

SEQ ID NO: 41885 - RNA, 20 nt, Artificial Sequence
  Synthetic
agcccggucggcccgcucgc

SEQ ID NO: 41886 - RNA, 20 nt, Artificial Sequence
  Synthetic
uaacguuagaccgaguucgc

SEQ ID NO: 41887 - RNA, 20 nt, Artificial Sequence
  Synthetic
ggggcaggacuuugugaggc

SEQ ID NO: 41888 - RNA, 20 nt, Artificial Sequence
  Synthetic
ucggcggccgccagcgcggc

SEQ ID NO: 41889 - RNA, 20 nt, Artificial Sequence
  Synthetic
ccagcccgcccucacagggc

SEQ ID NO: 41890 - RNA, 20 nt, Artificial Sequence
  Synthetic
cuccggugcgucuggagggc

SEQ ID NO: 41891 - RNA, 20 nt, Artificial Sequence
  Synthetic
gcggcccgcccugugagggc

SEQ ID NO: 41892 - RNA, 20 nt, Artificial Sequence
  Synthetic
uuagaccgaguucgccgggc

SEQ ID NO: 41893 - RNA, 20 nt, Artificial Sequence
  Synthetic
cccgcccugugagggcgggc

SEQ ID NO: 41894 - RNA, 20 nt, Artificial Sequence
  Synthetic
aacacccagacauccggggc

SEQ ID NO: 41895 - RNA, 20 nt, Artificial Sequence
  Synthetic
gggcgggccgccucgggggc

SEQ ID NO: 41896 - RNA, 20 nt, Artificial Sequence
  Synthetic
uaaggggaaaaaaggggggc

SEQ ID NO: 41897 - RNA, 20 nt, Artificial Sequence
  Synthetic
uccgaggccagcaggggggc

SEQ ID NO: 41898 - RNA, 20 nt, Artificial Sequence
  Synthetic
ggaguuaccgcccaaugggc

SEQ ID NO: 41899 - RNA, 20 nt, Artificial Sequence
  Synthetic
guaacucccgcccaaugggc

SEQ ID NO: 41900 - RNA, 20 nt, Artificial Sequence
  Synthetic
cggggcccggcccauugggc

SEQ ID NO: 41901 - RNA, 20 nt, Artificial Sequence
  Synthetic
cucuccggagagacgauggc

SEQ ID NO: 41902 - RNA, 20 nt, Artificial Sequence
  Synthetic
cggcgucccccaaauauggc

SEQ ID NO: 41903 - RNA, 20 nt, Artificial Sequence
  Synthetic
cucggcggacgcugguuggc

SEQ ID NO: 41904 - RNA, 20 nt, Artificial Sequence
  Synthetic
acaaaguccugccccccugc

SEQ ID NO: 41905 - RNA, 20 nt, Artificial Sequence
  Synthetic
cagggaaacacccagacauc

SEQ ID NO: 41906 - RNA, 20 nt, Artificial Sequence
  Synthetic
cggaggccgaggcggucauc

SEQ ID NO: 41907 - RNA, 20 nt, Artificial Sequence
  Synthetic
cgccgugggacccccgacuc

SEQ ID NO: 41908 - RNA, 20 nt, Artificial Sequence
  Synthetic
cggaagacccaggccgccuc

SEQ ID NO: 41909 - RNA, 20 nt, Artificial Sequence
  Synthetic
cucacagggcgggccgccuc

SEQ ID NO: 41910 - RNA, 20 nt, Artificial Sequence
  Synthetic
agggcccgggcacgggccuc

SEQ ID NO: 41911 - RNA, 20 nt, Artificial Sequence
  Synthetic
cuccgcaccaagccgcucuc

SEQ ID NO: 41912 - RNA, 20 nt, Artificial Sequence
  Synthetic
ggcuccugccaucgucucuc

SEQ ID NO: 41913 - RNA, 20 nt, Artificial Sequence
  Synthetic
ccuccagacgcaccggaguc

SEQ ID NO: 41914 - RNA, 20 nt, Artificial Sequence
  Synthetic
cgugucucuguguaugaguc

SEQ ID NO: 41915 - RNA, 20 nt, Artificial Sequence
  Synthetic
acccccgacuccggugcguc

SEQ ID NO: 41916 - RNA, 20 nt, Artificial Sequence
  Synthetic
aagagggaagaagagggguc

SEQ ID NO: 41917 - RNA, 20 nt, Artificial Sequence
  Synthetic
gucugcaaccaaaggugguc

SEQ ID NO: 41918 - RNA, 20 nt, Artificial Sequence
  Synthetic
cuuagcccgccccggauguc

SEQ ID NO: 41919 - RNA, 20 nt, Artificial Sequence
  Synthetic
ccagcguccgccgagucuuc

SEQ ID NO: 41920 - RNA, 20 nt, Artificial Sequence
  Synthetic
gggccgaccgggcucgguuc

SEQ ID NO: 41921 - RNA, 20 nt, Artificial Sequence
  Synthetic
gcgggcuaaggggaaaaaag

SEQ ID NO: 41922 - RNA, 20 nt, Artificial Sequence
  Synthetic
gcccugcgucugagucaaag

SEQ ID NO: 41923 - RNA, 20 nt, Artificial Sequence
  Synthetic
ucggaagaggggggagaaag

SEQ ID NO: 41924 - RNA, 20 nt, Artificial Sequence
  Synthetic
gguaauuaaaaacuugcaag

SEQ ID NO: 41925 - RNA, 20 nt, Artificial Sequence
  Synthetic
gcgggagaagagggaagaag

SEQ ID NO: 41926 - RNA, 20 nt, Artificial Sequence
  Synthetic
cgucuggagggcgggagaag

SEQ ID NO: 41927 - RNA, 20 nt, Artificial Sequence
  Synthetic
cccccugcuggccucggaag

SEQ ID NO: 41928 - RNA, 20 nt, Artificial Sequence
  Synthetic
cuaauuaccauaccgggaag

SEQ ID NO: 41929 - RNA, 20 nt, Artificial Sequence
  Synthetic
uuaauuaccauaccgggaag

SEQ ID NO: 41930 - RNA, 20 nt, Artificial Sequence
  Synthetic
gacauccggggcgggcuaag

SEQ ID NO: 41931 - RNA, 20 nt, Artificial Sequence
  Synthetic
ccuagaugcgugugaguaag

SEQ ID NO: 41932 - RNA, 20 nt, Artificial Sequence
  Synthetic
cccucuuccgaggccagcag

SEQ ID NO: 41933 - RNA, 20 nt, Artificial Sequence
  Synthetic
ggggccugcguaugagucag

SEQ ID NO: 41934 - RNA, 20 nt, Artificial Sequence
  Synthetic
ugucucuguguaugagucag

SEQ ID NO: 41935 - RNA, 20 nt, Artificial Sequence
  Synthetic
gggagaagagggaagaagag

SEQ ID NO: 41936 - RNA, 20 nt, Artificial Sequence
  Synthetic
cccugcuggccucggaagag

SEQ ID NO: 41937 - RNA, 20 nt, Artificial Sequence
  Synthetic
gccaucgucucuccggagag

SEQ ID NO: 41938 - RNA, 20 nt, Artificial Sequence
  Synthetic
gugaggcgggggggggagag

SEQ ID NO: 41939 - RNA, 20 nt, Artificial Sequence
  Synthetic
gcggcucgugggcccgcgag

SEQ ID NO: 41940 - RNA, 20 nt, Artificial Sequence
  Synthetic
uugugaggcgggggggggag

SEQ ID NO: 41941 - RNA, 20 nt, Artificial Sequence
  Synthetic
ccuuacucacacgcaucuag

SEQ ID NO: 41942 - RNA, 20 nt, Artificial Sequence
  Synthetic
cucgugggugcugauugacg

SEQ ID NO: 41943 - RNA, 20 nt, Artificial Sequence
  Synthetic
caacaaacacacaaggaccg

SEQ ID NO: 41944 - RNA, 20 nt, Artificial Sequence
  Synthetic
ucggucuaacguuacacccg

SEQ ID NO: 41945 - RNA, 20 nt, Artificial Sequence
  Synthetic
auuggccagucccgcccccg

SEQ ID NO: 41946 - RNA, 20 nt, Artificial Sequence
  Synthetic
ugacucagacgcagggcccg

SEQ ID NO: 41947 - RNA, 20 nt, Artificial Sequence
  Synthetic
cgggccgugccuggggcccg

SEQ ID NO: 41948 - RNA, 20 nt, Artificial Sequence
  Synthetic
cgugcccgggcccuggcccg

SEQ ID NO: 41949 - RNA, 20 nt, Artificial Sequence
  Synthetic
gccauauuugggggacgccg

SEQ ID NO: 41950 - RNA, 20 nt, Artificial Sequence
  Synthetic
cgcagggcccggggucgccg

SEQ ID NO: 41951 - RNA, 20 nt, Artificial Sequence
  Synthetic
gcgccggguggcggaggccg

SEQ ID NO: 41952 - RNA, 20 nt, Artificial Sequence
  Synthetic
gggaaacacccagacauccg

SEQ ID NO: 41953 - RNA, 20 nt, Artificial Sequence
  Synthetic
cggagcucccgggagcuccg

SEQ ID NO: 41954 - RNA, 20 nt, Artificial Sequence
  Synthetic
aguucgccgggccggcuccg

SEQ ID NO: 41955 - RNA, 20 nt, Artificial Sequence
  Synthetic
ccuuucuccccccucuuccg

SEQ ID NO: 41956 - RNA, 20 nt, Artificial Sequence
  Synthetic
gaggcggccugggucuuccg

SEQ ID NO: 41957 - RNA, 20 nt, Artificial Sequence
  Synthetic
ccaaucggcggccgccagcg

SEQ ID NO: 41958 - RNA, 20 nt, Artificial Sequence
  Synthetic
gggcaggacuuugugaggcg

SEQ ID NO: 41959 - RNA, 20 nt, Artificial Sequence
  Synthetic
cggcggccgccagcgcggcg

SEQ ID NO: 41960 - RNA, 20 nt, Artificial Sequence
  Synthetic
gggucgccguguugggggcg

SEQ ID NO: 41961 - RNA, 20 nt, Artificial Sequence
  Synthetic
gcuccaagcguauauaugcg

SEQ ID NO: 41962 - RNA, 20 nt, Artificial Sequence
  Synthetic
ggggggagagggggaacucg

SEQ ID NO: 41963 - RNA, 20 nt, Artificial Sequence
  Synthetic
ucacagggcgggccgccucg

SEQ ID NO: 41964 - RNA, 20 nt, Artificial Sequence
  Synthetic
gagcccggucggcccgcucg

SEQ ID NO: 41965 - RNA, 20 nt, Artificial Sequence
  Synthetic
cuccagacgcaccggagucg

SEQ ID NO: 41966 - RNA, 20 nt, Artificial Sequence
  Synthetic
cagcguccgccgagucuucg

SEQ ID NO: 41967 - RNA, 20 nt, Artificial Sequence
  Synthetic
cgggcuaaggggaaaaaagg

SEQ ID NO: 41968 - RNA, 20 nt, Artificial Sequence
  Synthetic
aaggggucugcaaccaaagg

SEQ ID NO: 41969 - RNA, 20 nt, Artificial Sequence
  Synthetic
cuagaugcgugugaguaagg

SEQ ID NO: 41970 - RNA, 20 nt, Artificial Sequence
  Synthetic
ccucuuccgaggccagcagg

SEQ ID NO: 41971 - RNA, 20 nt, Artificial Sequence
  Synthetic
gucucuguguaugagucagg

SEQ ID NO: 41972 - RNA, 20 nt, Artificial Sequence
  Synthetic
ccugcuggccucggaagagg

SEQ ID NO: 41973 - RNA, 20 nt, Artificial Sequence
  Synthetic
ugaggcgggggggggagagg

SEQ ID NO: 41974 - RNA, 20 nt, Artificial Sequence
  Synthetic
gucuaacguuacacccgagg

SEQ ID NO: 41975 - RNA, 20 nt, Artificial Sequence
  Synthetic
ggccagucccgcccccgagg

SEQ ID NO: 41976 - RNA, 20 nt, Artificial Sequence
  Synthetic
ccggguggcggaggccgagg

SEQ ID NO: 41977 - RNA, 20 nt, Artificial Sequence
  Synthetic
gggggcaggacuuugugagg

SEQ ID NO: 41978 - RNA, 20 nt, Artificial Sequence
  Synthetic
cuuacucacacgcaucuagg

SEQ ID NO: 41979 - RNA, 20 nt, Artificial Sequence
  Synthetic
aucggcggccgccagcgcgg

SEQ ID NO: 41980 - RNA, 20 nt, Artificial Sequence
  Synthetic
ggcaggacuuugugaggcgg

SEQ ID NO: 41981 - RNA, 20 nt, Artificial Sequence
  Synthetic
guuccggcgccggguggcgg

SEQ ID NO: 41982 - RNA, 20 nt, Artificial Sequence
  Synthetic
gggcgggacuggccaaucgg

SEQ ID NO: 41983 - RNA, 20 nt, Artificial Sequence
  Synthetic
gccgggccccgaagacucgg

SEQ ID NO: 41984 - RNA, 20 nt, Artificial Sequence
  Synthetic
cacagggcgggccgccucgg

SEQ ID NO: 41985 - RNA, 20 nt, Artificial Sequence
  Synthetic
uccagacgcaccggagucgg

SEQ ID NO: 41986 - RNA, 20 nt, Artificial Sequence
  Synthetic
gggcuaaggggaaaaaaggg

SEQ ID NO: 41987 - RNA, 20 nt, Artificial Sequence
  Synthetic
uagaugcgugugaguaaggg

SEQ ID NO: 41988 - RNA, 20 nt, Artificial Sequence
  Synthetic
gccagcccgcccucacaggg

SEQ ID NO: 41989 - RNA, 20 nt, Artificial Sequence
  Synthetic
cucuuccgaggccagcaggg

SEQ ID NO: 41990 - RNA, 20 nt, Artificial Sequence
  Synthetic
cugcuggccucggaagaggg

SEQ ID NO: 41991 - RNA, 20 nt, Artificial Sequence
  Synthetic
acuccggugcgucuggaggg

SEQ ID NO: 41992 - RNA, 20 nt, Artificial Sequence
  Synthetic
ggcggcccgcccugugaggg

SEQ ID NO: 41993 - RNA, 20 nt, Artificial Sequence
  Synthetic
uuacucacacgcaucuaggg

SEQ ID NO: 41994 - RNA, 20 nt, Artificial Sequence
  Synthetic
ggcucgguuccggcgccggg

SEQ ID NO: 41995 - RNA, 20 nt, Artificial Sequence
  Synthetic
gcaggacuuugugaggcggg

SEQ ID NO: 41996 - RNA, 20 nt, Artificial Sequence
  Synthetic
cgucccccaaauauggcggg

SEQ ID NO: 41997 - RNA, 20 nt, Artificial Sequence
  Synthetic
aaacacccagacauccgggg

SEQ ID NO: 41998 - RNA, 20 nt, Artificial Sequence
  Synthetic
caggacuuugugaggcgggg

SEQ ID NO: 41999 - RNA, 20 nt, Artificial Sequence
  Synthetic
aggacuuugugaggcggggg

SEQ ID NO: 42000 - RNA, 20 nt, Artificial Sequence
  Synthetic
agggcgggccgccucggggg

SEQ ID NO: 42001 - RNA, 20 nt, Artificial Sequence
  Synthetic
cuaaggggaaaaaagggggg

SEQ ID NO: 42002 - RNA, 20 nt, Artificial Sequence
  Synthetic
cucacacgcaucuagggggg

SEQ ID NO: 42003 - RNA, 20 nt, Artificial Sequence
  Synthetic
ggacuuugugaggcgggggg

SEQ ID NO: 42004 - RNA, 20 nt, Artificial Sequence
  Synthetic
ggggcggguaagaauggggg

SEQ ID NO: 42005 - RNA, 20 nt, Artificial Sequence
  Synthetic
gggggcggguaagaaugggg

SEQ ID NO: 42006 - RNA, 20 nt, Artificial Sequence
  Synthetic
acgcaucuaggggggugggg

SEQ ID NO: 42007 - RNA, 20 nt, Artificial Sequence
  Synthetic
ggggggcggguaagaauggg

SEQ ID NO: 42008 - RNA, 20 nt, Artificial Sequence
  Synthetic
auuagaaacucauuaauggg

SEQ ID NO: 42009 - RNA, 20 nt, Artificial Sequence
  Synthetic
uuaccauaccgggaaguggg

SEQ ID NO: 42010 - RNA, 20 nt, Artificial Sequence
  Synthetic
gggcggcccggcccauuggg

SEQ ID NO: 42011 - RNA, 20 nt, Artificial Sequence
  Synthetic
ucggggcccggcccauuggg

SEQ ID NO: 42012 - RNA, 20 nt, Artificial Sequence
  Synthetic
aggggggcggguaagaaugg

SEQ ID NO: 42013 - RNA, 20 nt, Artificial Sequence
  Synthetic
acggcgucccccaaauaugg

SEQ ID NO: 42014 - RNA, 20 nt, Artificial Sequence
  Synthetic
gccgggccccgccgcgcugg

SEQ ID NO: 42015 - RNA, 20 nt, Artificial Sequence
  Synthetic
cccgacuccggugcgucugg

SEQ ID NO: 42016 - RNA, 20 nt, Artificial Sequence
  Synthetic
ucgguuccggcgccgggugg

SEQ ID NO: 42017 - RNA, 20 nt, Artificial Sequence
  Synthetic
uccuuguguguuuguugugg

SEQ ID NO: 42018 - RNA, 20 nt, Artificial Sequence
  Synthetic
gaccggggucgccguguugg

SEQ ID NO: 42019 - RNA, 20 nt, Artificial Sequence
  Synthetic
gggccauguguauguguugg

SEQ ID NO: 42020 - RNA, 20 nt, Artificial Sequence
  Synthetic
gagccgcccgccauauuugg

SEQ ID NO: 42021 - RNA, 20 nt, Artificial Sequence
  Synthetic
aaggggggcggguaagaaug

SEQ ID NO: 42022 - RNA, 20 nt, Artificial Sequence
  Synthetic
cggucaucgggccgugccug

SEQ ID NO: 42023 - RNA, 20 nt, Artificial Sequence
  Synthetic
ggccugcguaugagucagug

SEQ ID NO: 42024 - RNA, 20 nt, Artificial Sequence
  Synthetic
cacacgcaucuaggggggug

SEQ ID NO: 42025 - RNA, 20 nt, Artificial Sequence
  Synthetic
cuccggagagcggcuuggug

SEQ ID NO: 42026 - RNA, 20 nt, Artificial Sequence
  Synthetic
ccgaggcggcccgcccugug

SEQ ID NO: 42027 - RNA, 20 nt, Artificial Sequence
  Synthetic
guccuuguguguuuguugug

SEQ ID NO: 42028 - RNA, 20 nt, Artificial Sequence
  Synthetic
caggggggcaggacuuugug

SEQ ID NO: 42029 - RNA, 20 nt, Artificial Sequence
  Synthetic
ggaccggggucgccguguug

SEQ ID NO: 42030 - RNA, 20 nt, Artificial Sequence
  Synthetic
ggggccauguguauguguug

SEQ ID NO: 42031 - RNA, 20 nt, Artificial Sequence
  Synthetic
cgguccuuguguguuuguug

SEQ ID NO: 42032 - RNA, 20 nt, Artificial Sequence
  Synthetic
ggagccgcccgccauauuug

SEQ ID NO: 42033 - RNA, 20 nt, Artificial Sequence
  Synthetic
ggcgggaguuaccgcccaau

SEQ ID NO: 42034 - RNA, 20 nt, Artificial Sequence
  Synthetic
ggcgguaacucccgcccaau

SEQ ID NO: 42035 - RNA, 20 nt, Artificial Sequence
  Synthetic
cgggggcgggacuggccaau

SEQ ID NO: 42036 - RNA, 20 nt, Artificial Sequence
  Synthetic
aaaggggggcggguaagaau

SEQ ID NO: 42037 - RNA, 20 nt, Artificial Sequence
  Synthetic
guaauuagaaacucauuaau

SEQ ID NO: 42038 - RNA, 20 nt, Artificial Sequence
  Synthetic
aagugggcggcccggcccau

SEQ ID NO: 42039 - RNA, 20 nt, Artificial Sequence
  Synthetic
gucuucggggcccggcccau

SEQ ID NO: 42040 - RNA, 20 nt, Artificial Sequence
  Synthetic
gcggaggccgaggcggucau

SEQ ID NO: 42041 - RNA, 20 nt, Artificial Sequence
  Synthetic
ccgcgcuggcggccgccgau

SEQ ID NO: 42042 - RNA, 20 nt, Artificial Sequence
  Synthetic
cggagccggcccggcgaacu

SEQ ID NO: 42043 - RNA, 20 nt, Artificial Sequence
  Synthetic
ugggccgggccccgaagacu

SEQ ID NO: 42044 - RNA, 20 nt, Artificial Sequence
  Synthetic
gcacggcccgaugaccgccu

SEQ ID NO: 42045 - RNA, 20 nt, Artificial Sequence
  Synthetic
gcggaagacccaggccgccu

SEQ ID NO: 42046 - RNA, 20 nt, Artificial Sequence
  Synthetic
ccucacagggcgggccgccu

SEQ ID NO: 42047 - RNA, 20 nt, Artificial Sequence
  Synthetic
cguuacacccgaggcggccu

SEQ ID NO: 42048 - RNA, 20 nt, Artificial Sequence
  Synthetic
cagggcccgggcacgggccu

SEQ ID NO: 42049 - RNA, 20 nt, Artificial Sequence
  Synthetic
uccugccccccugcuggccu

SEQ ID NO: 42050 - RNA, 20 nt, Artificial Sequence
  Synthetic
gcggucaucgggccgugccu

SEQ ID NO: 42051 - RNA, 20 nt, Artificial Sequence
  Synthetic
gagccgcgcauauauacgcu

SEQ ID NO: 42052 - RNA, 20 nt, Artificial Sequence
  Synthetic
cgucucuccggagagcggcu

SEQ ID NO: 42053 - RNA, 20 nt, Artificial Sequence
  Synthetic
gcgagcgggccgaccgggcu

SEQ ID NO: 42054 - RNA, 20 nt, Artificial Sequence
  Synthetic
ccccuuacucacacgcaucu

SEQ ID NO: 42055 - RNA, 20 nt, Artificial Sequence
  Synthetic
ucugcaaccaaagguggucu

SEQ ID NO: 42056 - RNA, 20 nt, Artificial Sequence
  Synthetic
uuagcccgccccggaugucu

SEQ ID NO: 42057 - RNA, 20 nt, Artificial Sequence
  Synthetic
uaauuaccauaccgggaagu

SEQ ID NO: 42058 - RNA, 20 nt, Artificial Sequence
  Synthetic
gggccugcguaugagucagu

SEQ ID NO: 42059 - RNA, 20 nt, Artificial Sequence
  Synthetic
cccuccagacgcaccggagu

SEQ ID NO: 42060 - RNA, 20 nt, Artificial Sequence
  Synthetic
ccauauuugggggacgccgu

SEQ ID NO: 42061 - RNA, 20 nt, Artificial Sequence
  Synthetic
gcagggcccggggucgccgu

SEQ ID NO: 42062 - RNA, 20 nt, Artificial Sequence
  Synthetic
gggggagagggggaacucgu

SEQ ID NO: 42063 - RNA, 20 nt, Artificial Sequence
  Synthetic
gcgccggaaccgagcccggu

SEQ ID NO: 42064 - RNA, 20 nt, Artificial Sequence
  Synthetic
gaagagggaagaagaggggu

SEQ ID NO: 42065 - RNA, 20 nt, Artificial Sequence
  Synthetic
ucacacgcaucuaggggggu

SEQ ID NO: 42066 - RNA, 20 nt, Artificial Sequence
  Synthetic
aagacucggcggacgcuggu

SEQ ID NO: 42067 - RNA, 20 nt, Artificial Sequence
  Synthetic
aaggaccggggucgccgugu

SEQ ID NO: 42068 - RNA, 20 nt, Artificial Sequence
  Synthetic
aaggggccauguguaugugu

SEQ ID NO: 42069 - RNA, 20 nt, Artificial Sequence
  Synthetic
gguccuuguguguuuguugu

SEQ ID NO: 42070 - RNA, 20 nt, Artificial Sequence
  Synthetic
agugggcggcccggcccauu

SEQ ID NO: 42071 - RNA, 20 nt, Artificial Sequence
  Synthetic
ucuucggggcccggcccauu

SEQ ID NO: 42072 - RNA, 20 nt, Artificial Sequence
  Synthetic
gaggagccgcccgccauauu

SEQ ID NO: 42073 - RNA, 20 nt, Artificial Sequence
  Synthetic
ggacggacccagaccaccuu

SEQ ID NO: 42074 - RNA, 20 nt, Artificial Sequence
  Synthetic
gguggucuggguccguccuu

SEQ ID NO: 42075 - RNA, 20 nt, Artificial Sequence
  Synthetic
accagcguccgccgagucuu

SEQ ID NO: 42076 - RNA, 20 nt, Artificial Sequence
  Synthetic
aggaccggggucgccguguu

SEQ ID NO: 42077 - RNA, 20 nt, Artificial Sequence
  Synthetic
aggggccauguguauguguu

SEQ ID NO: 42078 - RNA, 20 nt, Artificial Sequence
  Synthetic
aggagccgcccgccauauuu

SEQ ID NO: 42079 - RNA, 19 nt, Artificial Sequence
  Synthetic
gaccaacccggcgccccca

SEQ ID NO: 42080 - RNA, 20 nt, Artificial Sequence
  Synthetic
ggaccaacccggcgccccca

SEQ ID NO: 42081 - RNA, 21 nt, Artificial Sequence
  Synthetic
gggaccaacccggcgccccca

SEQ ID NO: 42082 - RNA, 22 nt, Artificial Sequence
  Synthetic
ggggaccaacccggcgccccca

SEQ ID NO: 42083 - RNA, 21 nt, Artificial Sequence
  Synthetic
gucccuguauauauaggguca

SEQ ID NO: 42084 - RNA, 22 nt, Artificial Sequence
  Synthetic
ggucccuguauauauaggguca

SEQ ID NO: 42085 - RNA, 21 nt, Artificial Sequence
  Synthetic
gucccuguauauauaguguca

SEQ ID NO: 42086 - RNA, 22 nt, Artificial Sequence
  Synthetic
ggucccuguauauauaguguca

SEQ ID NO: 42087 - RNA, 20 nt, Artificial Sequence
  Synthetic
gaccccggucccuguauaua

SEQ ID NO: 42088 - RNA, 22 nt, Artificial Sequence
  Synthetic
gcgaccccggucccuguauaua

SEQ ID NO: 42089 - RNA, 23 nt, Artificial Sequence
  Synthetic
ggcgaccccggucccuguauaua

SEQ ID NO: 42090 - RNA, 24 nt, Artificial Sequence
  Synthetic
gggcgaccccggucccuguauaua

SEQ ID NO: 42091 - RNA, 18 nt, Artificial Sequence
  Synthetic
gcgggaggcggggaauac

SEQ ID NO: 42092 - RNA, 20 nt, Artificial Sequence
  Synthetic
gcgcgggaggcggggaauac

SEQ ID NO: 42093 - RNA, 21 nt, Artificial Sequence
  Synthetic
ggcgcgggaggcggggaauac

SEQ ID NO: 42094 - RNA, 23 nt, Artificial Sequence
  Synthetic
gcggcgcgggaggcggggaauac

SEQ ID NO: 42095 - RNA, 19 nt, Artificial Sequence
  Synthetic
guugcccauuaagggccgc

SEQ ID NO: 42096 - RNA, 20 nt, Artificial Sequence
  Synthetic
gguugcccauuaagggccgc

SEQ ID NO: 42097 - RNA, 21 nt, Artificial Sequence
  Synthetic
ggguugcccauuaagggccgc

SEQ ID NO: 42098 - RNA, 22 nt, Artificial Sequence
  Synthetic
gggguugcccauuaagggccgc

SEQ ID NO: 42099 - RNA, 19 nt, Artificial Sequence
  Synthetic
gaugcggagagggggcggc

SEQ ID NO: 42100 - RNA, 21 nt, Artificial Sequence
  Synthetic
gugaugcggagagggggcggc

SEQ ID NO: 42101 - RNA, 22 nt, Artificial Sequence
  Synthetic
ggugaugcggagagggggcggc

SEQ ID NO: 42102 - RNA, 24 nt, Artificial Sequence
  Synthetic
guggugaugcggagagggggcggc

SEQ ID NO: 42103 - RNA, 18 nt, Artificial Sequence
  Synthetic
gguuccaguguaaggguc

SEQ ID NO: 42104 - RNA, 21 nt, Artificial Sequence
  Synthetic
gccgguuccaguguaaggguc

SEQ ID NO: 42105 - RNA, 22 nt, Artificial Sequence
  Synthetic
ggccgguuccaguguaaggguc

SEQ ID NO: 42106 - RNA, 24 nt, Artificial Sequence
  Synthetic
gcggccgguuccaguguaaggguc

SEQ ID NO: 42107 - RNA, 21 nt, Artificial Sequence
  Synthetic
gcggcuggagggucgcggacg

SEQ ID NO: 42108 - RNA, 22 nt, Artificial Sequence
  Synthetic
gcugggggcggcccucaggccg

SEQ ID NO: 42109 - RNA, 24 nt, Artificial Sequence
  Synthetic
gcgcugggggcggcccucaggccg

SEQ ID NO: 42110 - RNA, 22 nt, Artificial Sequence
  Synthetic
guuacgcgcggcgcgggaggcg

SEQ ID NO: 42111 - RNA, 23 nt, Artificial Sequence
  Synthetic
gguuacgcgcggcgcgggaggcg

SEQ ID NO: 42112 - RNA, 18 nt, Artificial Sequence
  Synthetic
gggggucguaugcggcug

SEQ ID NO: 42113 - RNA, 18 nt, Artificial Sequence
  Synthetic
gaaccccaggggaccaau

SEQ ID NO: 42114 - RNA, 19 nt, Artificial Sequence
  Synthetic
ggaaccccaggggaccaau

SEQ ID NO: 42115 - RNA, 20 nt, Artificial Sequence
  Synthetic
gcuccggggcggggcuccau

SEQ ID NO: 42116 - RNA, 20 nt, Artificial Sequence
  Synthetic
gucgcggacggagggucccu

SEQ ID NO: 42117 - RNA, 21 nt, Artificial Sequence
  Synthetic
ggucgcggacggagggucccu

SEQ ID NO: 42118 - RNA, 22 nt, Artificial Sequence
  Synthetic
gggucgcggacggagggucccu

SEQ ID NO: 42119 - RNA, 24 nt, Artificial Sequence
  Synthetic
gagggucgcggacggagggucccu

SEQ ID NO: 42120 - RNA, 21 nt, Artificial Sequence
  Synthetic
gccuggcugcugcgucucgcu

SEQ ID NO: 42121 - RNA, 21 nt, Artificial Sequence
  Synthetic
gcccggcucccguguaugagu

SEQ ID NO: 42122 - RNA, 23 nt, Artificial Sequence
  Synthetic
gcgcccggcucccguguaugagu

SEQ ID NO: 42123 - RNA, 24 nt, Artificial Sequence
  Synthetic
ggcgcccggcucccguguaugagu

SEQ ID NO: 42124 - RNA, 18 nt, Artificial Sequence
  Synthetic
ggcggccgguuccagugu

SEQ ID NO: 42125 - RNA, 18 nt, Artificial Sequence
  Synthetic
ggcgcccggcucccgugu

SEQ ID NO: 42126 - RNA, 18 nt, Artificial Sequence
  Synthetic
gcgggaggggcaugcuaa

SEQ ID NO: 42127 - RNA, 19 nt, Artificial Sequence
  Synthetic
ggcgggaggggcaugcuaa

SEQ ID NO: 42128 - RNA, 22 nt, Artificial Sequence
  Synthetic
gucggcgggaggggcaugcuaa

SEQ ID NO: 42129 - RNA, 24 nt, Artificial Sequence
  Synthetic
gcgucggcgggaggggcaugcuaa

SEQ ID NO: 42130 - RNA, 24 nt, Artificial Sequence
  Synthetic
gcuaaugggguucuuugggggaca

SEQ ID NO: 42131 - RNA, 18 nt, Artificial Sequence
  Synthetic
gggguuccggguauggua

SEQ ID NO: 42132 - RNA, 19 nt, Artificial Sequence
  Synthetic
gaccgggggcgccauguua

SEQ ID NO: 42133 - RNA, 20 nt, Artificial Sequence
  Synthetic
ggaccgggggcgccauguua

SEQ ID NO: 42134 - RNA, 21 nt, Artificial Sequence
  Synthetic
gggaccgggggcgccauguua

SEQ ID NO: 42135 - RNA, 20 nt, Artificial Sequence
  Synthetic
gacccuauauauacagggac

SEQ ID NO: 42136 - RNA, 20 nt, Artificial Sequence
  Synthetic
gccgcgcguaaccacucccc

SEQ ID NO: 42137 - RNA, 22 nt, Artificial Sequence
  Synthetic
gcgccgcgcguaaccacucccc

SEQ ID NO: 42138 - RNA, 18 nt, Artificial Sequence
  Synthetic
gaacccgcauuggucccc

SEQ ID NO: 42139 - RNA, 19 nt, Artificial Sequence
  Synthetic
gccccucgcgcauuggccc

SEQ ID NO: 42140 - RNA, 20 nt, Artificial Sequence
  Synthetic
ggccccucgcgcauuggccc

SEQ ID NO: 42141 - RNA, 24 nt, Artificial Sequence
  Synthetic
gccccuuuggggaggggaaaggcg

SEQ ID NO: 42142 - RNA, 23 nt, Artificial Sequence
  Synthetic
gcuaaugauauucuuugggggcg

SEQ ID NO: 42143 - RNA, 18 nt, Artificial Sequence
  Synthetic
gggacgcgcggccauugg

SEQ ID NO: 42144 - RNA, 22 nt, Artificial Sequence
  Synthetic
gcguaaccacuccccugggguu

SEQ ID NO: 42145 - RNA, 24 nt, Artificial Sequence
  Synthetic
gcgcguaaccacuccccugggguu

SEQ ID NO: 42146 - RNA, 19 nt, Artificial Sequence
  Synthetic
gcauugguccccugggguu

SEQ ID NO: 42147 - RNA, 18 nt, Artificial Sequence
  Synthetic
gaccggggucgcccuguu

SEQ ID NO: 42148 - RNA, 19 nt, Artificial Sequence
  Synthetic
ggaccggggucgcccuguu

SEQ ID NO: 42149 - RNA, 20 nt, Artificial Sequence
  Synthetic
gggaccggggucgcccuguu

SEQ ID NO: 42150 - RNA, 18 nt, Artificial Sequence
  Synthetic
accaacccggcgccccca

SEQ ID NO: 42151 - RNA, 23 nt, Artificial Sequence
  Synthetic
cggggaccaacccggcgccccca

SEQ ID NO: 42152 - RNA, 24 nt, Artificial Sequence
  Synthetic
ccggggaccaacccggcgccccca

SEQ ID NO: 42153 - RNA, 18 nt, Artificial Sequence
  Synthetic
ccuguauauauaggguca

SEQ ID NO: 42154 - RNA, 19 nt, Artificial Sequence
  Synthetic
cccuguauauauaggguca

SEQ ID NO: 42155 - RNA, 20 nt, Artificial Sequence
  Synthetic
ucccuguauauauaggguca

SEQ ID NO: 42156 - RNA, 23 nt, Artificial Sequence
  Synthetic
cggucccuguauauauaggguca

SEQ ID NO: 42157 - RNA, 24 nt, Artificial Sequence
  Synthetic
ccggucccuguauauauaggguca

SEQ ID NO: 42158 - RNA, 18 nt, Artificial Sequence
  Synthetic
ccuguauauauaguguca

SEQ ID NO: 42159 - RNA, 19 nt, Artificial Sequence
  Synthetic
cccuguauauauaguguca

SEQ ID NO: 42160 - RNA, 20 nt, Artificial Sequence
  Synthetic
ucccuguauauauaguguca

SEQ ID NO: 42161 - RNA, 23 nt, Artificial Sequence
  Synthetic
cggucccuguauauauaguguca

SEQ ID NO: 42162 - RNA, 24 nt, Artificial Sequence
  Synthetic
ccggucccuguauauauaguguca

SEQ ID NO: 42163 - RNA, 18 nt, Artificial Sequence
  Synthetic
ccccggucccuguauaua

SEQ ID NO: 42164 - RNA, 19 nt, Artificial Sequence
  Synthetic
accccggucccuguauaua

SEQ ID NO: 42165 - RNA, 21 nt, Artificial Sequence
  Synthetic
cgaccccggucccuguauaua

SEQ ID NO: 42166 - RNA, 19 nt, Artificial Sequence
  Synthetic
cgcgggaggcggggaauac

SEQ ID NO: 42167 - RNA, 22 nt, Artificial Sequence
  Synthetic
cggcgcgggaggcggggaauac

SEQ ID NO: 42168 - RNA, 24 nt, Artificial Sequence
  Synthetic
cgcggcgcgggaggcggggaauac

SEQ ID NO: 42169 - RNA, 18 nt, Artificial Sequence
  Synthetic
uugcccauuaagggccgc

SEQ ID NO: 42170 - RNA, 23 nt, Artificial Sequence
  Synthetic
cgggguugcccauuaagggccgc

SEQ ID NO: 42171 - RNA, 24 nt, Artificial Sequence
  Synthetic
ccgggguugcccauuaagggccgc

SEQ ID NO: 42172 - RNA, 18 nt, Artificial Sequence
  Synthetic
augcggagagggggcggc

SEQ ID NO: 42173 - RNA, 20 nt, Artificial Sequence
  Synthetic
ugaugcggagagggggcggc

SEQ ID NO: 42174 - RNA, 23 nt, Artificial Sequence
  Synthetic
uggugaugcggagagggggcggc

SEQ ID NO: 42175 - RNA, 19 nt, Artificial Sequence
  Synthetic
cgguuccaguguaaggguc

SEQ ID NO: 42176 - RNA, 20 nt, Artificial Sequence
  Synthetic
ccgguuccaguguaaggguc

SEQ ID NO: 42177 - RNA, 23 nt, Artificial Sequence
  Synthetic
cggccgguuccaguguaaggguc

SEQ ID NO: 42178 - RNA, 21 nt, Artificial Sequence
  Synthetic
uagcauaacccggaaccccag

SEQ ID NO: 42179 - RNA, 22 nt, Artificial Sequence
  Synthetic
uuagcauaacccggaaccccag

SEQ ID NO: 42180 - RNA, 23 nt, Artificial Sequence
  Synthetic
auuagcauaacccggaaccccag

SEQ ID NO: 42181 - RNA, 24 nt, Artificial Sequence
  Synthetic
aauuagcauaacccggaaccccag

SEQ ID NO: 42182 - RNA, 22 nt, Artificial Sequence
  Synthetic
ugcggcuggagggucgcggacg

SEQ ID NO: 42183 - RNA, 23 nt, Artificial Sequence
  Synthetic
augcggcuggagggucgcggacg

SEQ ID NO: 42184 - RNA, 24 nt, Artificial Sequence
  Synthetic
uaugcggcuggagggucgcggacg

SEQ ID NO: 42185 - RNA, 21 nt, Artificial Sequence
  Synthetic
cugggggcggcccucaggccg

SEQ ID NO: 42186 - RNA, 23 nt, Artificial Sequence
  Synthetic
cgcugggggcggcccucaggccg

SEQ ID NO: 42187 - RNA, 21 nt, Artificial Sequence
  Synthetic
uuacgcgcggcgcgggaggcg

SEQ ID NO: 42188 - RNA, 24 nt, Artificial Sequence
  Synthetic
ugguuacgcgcggcgcgggaggcg

SEQ ID NO: 42189 - RNA, 19 nt, Artificial Sequence
  Synthetic
ugggggucguaugcggcug

SEQ ID NO: 42190 - RNA, 20 nt, Artificial Sequence
  Synthetic
augggggucguaugcggcug

SEQ ID NO: 42191 - RNA, 21 nt, Artificial Sequence
  Synthetic
caugggggucguaugcggcug

SEQ ID NO: 42192 - RNA, 22 nt, Artificial Sequence
  Synthetic
ccaugggggucguaugcggcug

SEQ ID NO: 42193 - RNA, 23 nt, Artificial Sequence
  Synthetic
uccaugggggucguaugcggcug

SEQ ID NO: 42194 - RNA, 24 nt, Artificial Sequence
  Synthetic
cuccaugggggucguaugcggcug

SEQ ID NO: 42195 - RNA, 20 nt, Artificial Sequence
  Synthetic
cggaaccccaggggaccaau

SEQ ID NO: 42196 - RNA, 21 nt, Artificial Sequence
  Synthetic
ccggaaccccaggggaccaau

SEQ ID NO: 42197 - RNA, 22 nt, Artificial Sequence
  Synthetic
cccggaaccccaggggaccaau

SEQ ID NO: 42198 - RNA, 23 nt, Artificial Sequence
  Synthetic
acccggaaccccaggggaccaau

SEQ ID NO: 42199 - RNA, 24 nt, Artificial Sequence
  Synthetic
uacccggaaccccaggggaccaau

SEQ ID NO: 42200 - RNA, 18 nt, Artificial Sequence
  Synthetic
uccggggcggggcuccau

SEQ ID NO: 42201 - RNA, 19 nt, Artificial Sequence
  Synthetic
cuccggggcggggcuccau

SEQ ID NO: 42202 - RNA, 21 nt, Artificial Sequence
  Synthetic
cgcuccggggcggggcuccau

SEQ ID NO: 42203 - RNA, 22 nt, Artificial Sequence
  Synthetic
ucgcuccggggcggggcuccau

SEQ ID NO: 42204 - RNA, 23 nt, Artificial Sequence
  Synthetic
cucgcuccggggcggggcuccau

SEQ ID NO: 42205 - RNA, 24 nt, Artificial Sequence
  Synthetic
acucgcuccggggcggggcuccau

SEQ ID NO: 42206 - RNA, 18 nt, Artificial Sequence
  Synthetic
cgcggacggagggucccu

SEQ ID NO: 42207 - RNA, 19 nt, Artificial Sequence
  Synthetic
ucgcggacggagggucccu

SEQ ID NO: 42208 - RNA, 23 nt, Artificial Sequence
  Synthetic
agggucgcggacggagggucccu

SEQ ID NO: 42209 - RNA, 22 nt, Artificial Sequence
  Synthetic
ugccuggcugcugcgucucgcu

SEQ ID NO: 42210 - RNA, 23 nt, Artificial Sequence
  Synthetic
cugccuggcugcugcgucucgcu

SEQ ID NO: 42211 - RNA, 24 nt, Artificial Sequence
  Synthetic
ucugccuggcugcugcgucucgcu

SEQ ID NO: 42212 - RNA, 18 nt, Artificial Sequence
  Synthetic
cggcucccguguaugagu

SEQ ID NO: 42213 - RNA, 19 nt, Artificial Sequence
  Synthetic
ccggcucccguguaugagu

SEQ ID NO: 42214 - RNA, 20 nt, Artificial Sequence
  Synthetic
cccggcucccguguaugagu

SEQ ID NO: 42215 - RNA, 22 nt, Artificial Sequence
  Synthetic
cgcccggcucccguguaugagu

SEQ ID NO: 42216 - RNA, 19 nt, Artificial Sequence
  Synthetic
uggcggccgguuccagugu

SEQ ID NO: 42217 - RNA, 20 nt, Artificial Sequence
  Synthetic
auggcggccgguuccagugu

SEQ ID NO: 42218 - RNA, 21 nt, Artificial Sequence
  Synthetic
cauggcggccgguuccagugu

SEQ ID NO: 42219 - RNA, 22 nt, Artificial Sequence
  Synthetic
acauggcggccgguuccagugu

SEQ ID NO: 42220 - RNA, 23 nt, Artificial Sequence
  Synthetic
aacauggcggccgguuccagugu

SEQ ID NO: 42221 - RNA, 24 nt, Artificial Sequence
  Synthetic
caacauggcggccgguuccagugu

SEQ ID NO: 42222 - RNA, 19 nt, Artificial Sequence
  Synthetic
uggcgcccggcucccgugu

SEQ ID NO: 42223 - RNA, 20 nt, Artificial Sequence
  Synthetic
auggcgcccggcucccgugu

SEQ ID NO: 42224 - RNA, 21 nt, Artificial Sequence
  Synthetic
cauggcgcccggcucccgugu

SEQ ID NO: 42225 - RNA, 22 nt, Artificial Sequence
  Synthetic
acauggcgcccggcucccgugu

SEQ ID NO: 42226 - RNA, 23 nt, Artificial Sequence
  Synthetic
aacauggcgcccggcucccgugu

SEQ ID NO: 42227 - RNA, 24 nt, Artificial Sequence
  Synthetic
caacauggcgcccggcucccgugu

SEQ ID NO: 42228 - RNA, 20 nt, Artificial Sequence
  Synthetic
cggcgggaggggcaugcuaa

SEQ ID NO: 42229 - RNA, 21 nt, Artificial Sequence
  Synthetic
ucggcgggaggggcaugcuaa

SEQ ID NO: 42230 - RNA, 23 nt, Artificial Sequence
  Synthetic
cgucggcgggaggggcaugcuaa

SEQ ID NO: 42231 - RNA, 21 nt, Artificial Sequence
  Synthetic
aaugggguucuuugggggaca

SEQ ID NO: 42232 - RNA, 22 nt, Artificial Sequence
  Synthetic
uaaugggguucuuugggggaca

SEQ ID NO: 42233 - RNA, 23 nt, Artificial Sequence
  Synthetic
cuaaugggguucuuugggggaca

SEQ ID NO: 42234 - RNA, 18 nt, Artificial Sequence
  Synthetic
auggagccccgccccgga

SEQ ID NO: 42235 - RNA, 19 nt, Artificial Sequence
  Synthetic
cauggagccccgccccgga

SEQ ID NO: 42236 - RNA, 20 nt, Artificial Sequence
  Synthetic
ccauggagccccgccccgga

SEQ ID NO: 42237 - RNA, 21 nt, Artificial Sequence
  Synthetic
cccauggagccccgccccgga

SEQ ID NO: 42238 - RNA, 22 nt, Artificial Sequence
  Synthetic
ccccauggagccccgccccgga

SEQ ID NO: 42239 - RNA, 23 nt, Artificial Sequence
  Synthetic
cccccauggagccccgccccgga

SEQ ID NO: 42240 - RNA, 24 nt, Artificial Sequence
  Synthetic
acccccauggagccccgccccgga

SEQ ID NO: 42241 - RNA, 19 nt, Artificial Sequence
  Synthetic
ugggguuccggguauggua

SEQ ID NO: 42242 - RNA, 20 nt, Artificial Sequence
  Synthetic
cugggguuccggguauggua

SEQ ID NO: 42243 - RNA, 21 nt, Artificial Sequence
  Synthetic
ccugggguuccggguauggua

SEQ ID NO: 42244 - RNA, 22 nt, Artificial Sequence
  Synthetic
cccugggguuccggguauggua

SEQ ID NO: 42245 - RNA, 23 nt, Artificial Sequence
  Synthetic
ccccugggguuccggguauggua

SEQ ID NO: 42246 - RNA, 24 nt, Artificial Sequence
  Synthetic
uccccugggguuccggguauggua

SEQ ID NO: 42247 - RNA, 18 nt, Artificial Sequence
  Synthetic
accgggggcgccauguua

SEQ ID NO: 42248 - RNA, 22 nt, Artificial Sequence
  Synthetic
agggaccgggggcgccauguua

SEQ ID NO: 42249 - RNA, 23 nt, Artificial Sequence
  Synthetic
cagggaccgggggcgccauguua

SEQ ID NO: 42250 - RNA, 24 nt, Artificial Sequence
  Synthetic
acagggaccgggggcgccauguua

SEQ ID NO: 42251 - RNA, 18 nt, Artificial Sequence
  Synthetic
cccuauauauacagggac

SEQ ID NO: 42252 - RNA, 19 nt, Artificial Sequence
  Synthetic
acccuauauauacagggac

SEQ ID NO: 42253 - RNA, 21 nt, Artificial Sequence
  Synthetic
ugacccuauauauacagggac

SEQ ID NO: 42254 - RNA, 22 nt, Artificial Sequence
  Synthetic
cugacccuauauauacagggac

SEQ ID NO: 42255 - RNA, 23 nt, Artificial Sequence
  Synthetic
ccugacccuauauauacagggac

SEQ ID NO: 42256 - RNA, 24 nt, Artificial Sequence
  Synthetic
cccugacccuauauauacagggac

SEQ ID NO: 42257 - RNA, 18 nt, Artificial Sequence
  Synthetic
cgcgcguaaccacucccc

SEQ ID NO: 42258 - RNA, 19 nt, Artificial Sequence
  Synthetic
ccgcgcguaaccacucccc

SEQ ID NO: 42259 - RNA, 21 nt, Artificial Sequence
  Synthetic
cgccgcgcguaaccacucccc

SEQ ID NO: 42260 - RNA, 23 nt, Artificial Sequence
  Synthetic
cgcgccgcgcguaaccacucccc

SEQ ID NO: 42261 - RNA, 24 nt, Artificial Sequence
  Synthetic
ccgcgccgcgcguaaccacucccc

SEQ ID NO: 42262 - RNA, 19 nt, Artificial Sequence
  Synthetic
ugaacccgcauuggucccc

SEQ ID NO: 42263 - RNA, 20 nt, Artificial Sequence
  Synthetic
augaacccgcauuggucccc

SEQ ID NO: 42264 - RNA, 21 nt, Artificial Sequence
  Synthetic
aaugaacccgcauuggucccc

SEQ ID NO: 42265 - RNA, 22 nt, Artificial Sequence
  Synthetic
caaugaacccgcauuggucccc

SEQ ID NO: 42266 - RNA, 23 nt, Artificial Sequence
  Synthetic
ucaaugaacccgcauuggucccc

SEQ ID NO: 42267 - RNA, 24 nt, Artificial Sequence
  Synthetic
cucaaugaacccgcauuggucccc

SEQ ID NO: 42268 - RNA, 18 nt, Artificial Sequence
  Synthetic
ccccucgcgcauuggccc

SEQ ID NO: 42269 - RNA, 21 nt, Artificial Sequence
  Synthetic
cggccccucgcgcauuggccc

SEQ ID NO: 42270 - RNA, 22 nt, Artificial Sequence
  Synthetic
acggccccucgcgcauuggccc

SEQ ID NO: 42271 - RNA, 23 nt, Artificial Sequence
  Synthetic
cacggccccucgcgcauuggccc

SEQ ID NO: 42272 - RNA, 24 nt, Artificial Sequence
  Synthetic
acacggccccucgcgcauuggccc

SEQ ID NO: 42273 - RNA, 21 nt, Artificial Sequence
  Synthetic
ccuuuggggaggggaaaggcg

SEQ ID NO: 42274 - RNA, 22 nt, Artificial Sequence
  Synthetic
cccuuuggggaggggaaaggcg

SEQ ID NO: 42275 - RNA, 23 nt, Artificial Sequence
  Synthetic
ccccuuuggggaggggaaaggcg

SEQ ID NO: 42276 - RNA, 18 nt, Artificial Sequence
  Synthetic
ugauauucuuugggggcg

SEQ ID NO: 42277 - RNA, 19 nt, Artificial Sequence
  Synthetic
augauauucuuugggggcg

SEQ ID NO: 42278 - RNA, 20 nt, Artificial Sequence
  Synthetic
aaugauauucuuugggggcg

SEQ ID NO: 42279 - RNA, 21 nt, Artificial Sequence
  Synthetic
uaaugauauucuuugggggcg

SEQ ID NO: 42280 - RNA, 22 nt, Artificial Sequence
  Synthetic
cuaaugauauucuuugggggcg

SEQ ID NO: 42281 - RNA, 24 nt, Artificial Sequence
  Synthetic
ugcuaaugauauucuuugggggcg

SEQ ID NO: 42282 - RNA, 19 nt, Artificial Sequence
  Synthetic
ugggacgcgcggccauugg

SEQ ID NO: 42283 - RNA, 20 nt, Artificial Sequence
  Synthetic
cugggacgcgcggccauugg

SEQ ID NO: 42284 - RNA, 21 nt, Artificial Sequence
  Synthetic
ccugggacgcgcggccauugg

SEQ ID NO: 42285 - RNA, 22 nt, Artificial Sequence
  Synthetic
cccugggacgcgcggccauugg

SEQ ID NO: 42286 - RNA, 23 nt, Artificial Sequence
  Synthetic
ccccugggacgcgcggccauugg

SEQ ID NO: 42287 - RNA, 24 nt, Artificial Sequence
  Synthetic
uccccugggacgcgcggccauugg

SEQ ID NO: 42288 - RNA, 21 nt, Artificial Sequence
  Synthetic
cguaaccacuccccugggguu

SEQ ID NO: 42289 - RNA, 23 nt, Artificial Sequence
  Synthetic
cgcguaaccacuccccugggguu

SEQ ID NO: 42290 - RNA, 18 nt, Artificial Sequence
  Synthetic
cauugguccccugggguu

SEQ ID NO: 42291 - RNA, 20 nt, Artificial Sequence
  Synthetic
cgcauugguccccugggguu

SEQ ID NO: 42292 - RNA, 21 nt, Artificial Sequence
  Synthetic
ccgcauugguccccugggguu

SEQ ID NO: 42293 - RNA, 22 nt, Artificial Sequence
  Synthetic
cccgcauugguccccugggguu

SEQ ID NO: 42294 - RNA, 23 nt, Artificial Sequence
  Synthetic
acccgcauugguccccugggguu

SEQ ID NO: 42295 - RNA, 24 nt, Artificial Sequence
  Synthetic
aacccgcauugguccccugggguu

SEQ ID NO: 42296 - RNA, 21 nt, Artificial Sequence
  Synthetic
agggaccggggucgcccuguu

SEQ ID NO: 42297 - RNA, 22 nt, Artificial Sequence
  Synthetic
cagggaccggggucgcccuguu

SEQ ID NO: 42298 - RNA, 23 nt, Artificial Sequence
  Synthetic
acagggaccggggucgcccuguu

SEQ ID NO: 42299 - RNA, 24 nt, Artificial Sequence
  Synthetic
uacagggaccggggucgcccuguu

SEQ ID NO: 42300 - RNA, 18 nt, Artificial Sequence
  Synthetic
cauaacccggaaccccag

SEQ ID NO: 42301 - RNA, 19 nt, Artificial Sequence
  Synthetic
gcauaacccggaaccccag

SEQ ID NO: 42302 - RNA, 20 nt, Artificial Sequence
  Synthetic
agcauaacccggaaccccag

SEQ ID NO: 42303 - RNA, 18 nt, Artificial Sequence
  Synthetic
gcuggagggucgcggacg

SEQ ID NO: 42304 - RNA, 19 nt, Artificial Sequence
  Synthetic
ggcuggagggucgcggacg

SEQ ID NO: 42305 - RNA, 20 nt, Artificial Sequence
  Synthetic
cggcuggagggucgcggacg

SEQ ID NO: 42306 - RNA, 18 nt, Artificial Sequence
  Synthetic
ggggcggcccucaggccg

SEQ ID NO: 42307 - RNA, 19 nt, Artificial Sequence
  Synthetic
gggggcggcccucaggccg

SEQ ID NO: 42308 - RNA, 20 nt, Artificial Sequence
  Synthetic
ugggggcggcccucaggccg

SEQ ID NO: 42309 - RNA, 18 nt, Artificial Sequence
  Synthetic
cgcgcggcgcgggaggcg

SEQ ID NO: 42310 - RNA, 19 nt, Artificial Sequence
  Synthetic
acgcgcggcgcgggaggcg

SEQ ID NO: 42311 - RNA, 20 nt, Artificial Sequence
  Synthetic
uacgcgcggcgcgggaggcg

SEQ ID NO: 42312 - RNA, 18 nt, Artificial Sequence
  Synthetic
uggcugcugcgucucgcu

SEQ ID NO: 42313 - RNA, 19 nt, Artificial Sequence
  Synthetic
cuggcugcugcgucucgcu

SEQ ID NO: 42314 - RNA, 20 nt, Artificial Sequence
  Synthetic
ccuggcugcugcgucucgcu

SEQ ID NO: 42315 - RNA, 18 nt, Artificial Sequence
  Synthetic
gggguucuuugggggaca

SEQ ID NO: 42316 - RNA, 19 nt, Artificial Sequence
  Synthetic
ugggguucuuugggggaca

SEQ ID NO: 42317 - RNA, 20 nt, Artificial Sequence
  Synthetic
augggguucuuugggggaca

SEQ ID NO: 42318 - RNA, 18 nt, Artificial Sequence
  Synthetic
uuggggaggggaaaggcg

SEQ ID NO: 42319 - RNA, 19 nt, Artificial Sequence
  Synthetic
uuuggggaggggaaaggcg

SEQ ID NO: 42320 - RNA, 20 nt, Artificial Sequence
  Synthetic
cuuuggggaggggaaaggcg

SEQ ID NO: 42321 - RNA, 18 nt, Artificial Sequence
  Synthetic
aaccacuccccugggguu

SEQ ID NO: 42322 - RNA, 19 nt, Artificial Sequence
  Synthetic
uaaccacuccccugggguu

SEQ ID NO: 42323 - RNA, 20 nt, Artificial Sequence
  Synthetic
guaaccacuccccugggguu

SEQ ID NO: 42324 - RNA, 18 nt, Artificial Sequence
  Synthetic
ucacauggcgacccccaa

SEQ ID NO: 42325 - RNA, 19 nt, Artificial Sequence
  Synthetic
gucacauggcgacccccaa

SEQ ID NO: 42326 - RNA, 20 nt, Artificial Sequence
  Synthetic
ggucacauggcgacccccaa

SEQ ID NO: 42327 - RNA, 21 nt, Artificial Sequence
  Synthetic
gggucacauggcgacccccaa

SEQ ID NO: 42328 - RNA, 22 nt, Artificial Sequence
  Synthetic
ggggucacauggcgacccccaa

SEQ ID NO: 42329 - RNA, 23 nt, Artificial Sequence
  Synthetic
gggggucacauggcgacccccaa

SEQ ID NO: 42330 - RNA, 24 nt, Artificial Sequence
  Synthetic
agggggucacauggcgacccccaa

SEQ ID NO: 42331 - RNA, 18 nt, Artificial Sequence
  Synthetic
cgccuuuccccuccccaa

SEQ ID NO: 42332 - RNA, 19 nt, Artificial Sequence
  Synthetic
acgccuuuccccuccccaa

SEQ ID NO: 42333 - RNA, 20 nt, Artificial Sequence
  Synthetic
cacgccuuuccccuccccaa

SEQ ID NO: 42334 - RNA, 21 nt, Artificial Sequence
  Synthetic
ccacgccuuuccccuccccaa

SEQ ID NO: 42335 - RNA, 22 nt, Artificial Sequence
  Synthetic
cccacgccuuuccccuccccaa

SEQ ID NO: 42336 - RNA, 23 nt, Artificial Sequence
  Synthetic
ccccacgccuuuccccuccccaa

SEQ ID NO: 42337 - RNA, 24 nt, Artificial Sequence
  Synthetic
accccacgccuuuccccuccccaa

SEQ ID NO: 42338 - RNA, 18 nt, Artificial Sequence
  Synthetic
ccccucccgccgacgcaa

SEQ ID NO: 42339 - RNA, 19 nt, Artificial Sequence
  Synthetic
gccccucccgccgacgcaa

SEQ ID NO: 42340 - RNA, 20 nt, Artificial Sequence
  Synthetic
ugccccucccgccgacgcaa

SEQ ID NO: 42341 - RNA, 21 nt, Artificial Sequence
  Synthetic
augccccucccgccgacgcaa

SEQ ID NO: 42342 - RNA, 22 nt, Artificial Sequence
  Synthetic
caugccccucccgccgacgcaa

SEQ ID NO: 42343 - RNA, 23 nt, Artificial Sequence
  Synthetic
gcaugccccucccgccgacgcaa

SEQ ID NO: 42344 - RNA, 24 nt, Artificial Sequence
  Synthetic
agcaugccccucccgccgacgcaa

SEQ ID NO: 42345 - RNA, 18 nt, Artificial Sequence
  Synthetic
ccgcgggaauugccggaa

SEQ ID NO: 42346 - RNA, 19 nt, Artificial Sequence
  Synthetic
gccgcgggaauugccggaa

SEQ ID NO: 42347 - RNA, 20 nt, Artificial Sequence
  Synthetic
ggccgcgggaauugccggaa

SEQ ID NO: 42348 - RNA, 21 nt, Artificial Sequence
  Synthetic
gggccgcgggaauugccggaa

SEQ ID NO: 42349 - RNA, 22 nt, Artificial Sequence
  Synthetic
agggccgcgggaauugccggaa

SEQ ID NO: 42350 - RNA, 23 nt, Artificial Sequence
  Synthetic
aagggccgcgggaauugccggaa

SEQ ID NO: 42351 - RNA, 24 nt, Artificial Sequence
  Synthetic
uaagggccgcgggaauugccggaa

SEQ ID NO: 42352 - RNA, 18 nt, Artificial Sequence
  Synthetic
gcauaacccggaacccca

SEQ ID NO: 42353 - RNA, 19 nt, Artificial Sequence
  Synthetic
agcauaacccggaacccca

SEQ ID NO: 42354 - RNA, 20 nt, Artificial Sequence
  Synthetic
uagcauaacccggaacccca

SEQ ID NO: 42355 - RNA, 21 nt, Artificial Sequence
  Synthetic
uuagcauaacccggaacccca

SEQ ID NO: 42356 - RNA, 22 nt, Artificial Sequence
  Synthetic
auuagcauaacccggaacccca

SEQ ID NO: 42357 - RNA, 23 nt, Artificial Sequence
  Synthetic
aauuagcauaacccggaacccca

SEQ ID NO: 42358 - RNA, 24 nt, Artificial Sequence
  Synthetic
caauuagcauaacccggaacccca

SEQ ID NO: 42359 - RNA, 18 nt, Artificial Sequence
  Synthetic
accauacccggaacccca

SEQ ID NO: 42360 - RNA, 19 nt, Artificial Sequence
  Synthetic
uaccauacccggaacccca

SEQ ID NO: 42361 - RNA, 20 nt, Artificial Sequence
  Synthetic
uuaccauacccggaacccca

SEQ ID NO: 42362 - RNA, 21 nt, Artificial Sequence
  Synthetic
auuaccauacccggaacccca

SEQ ID NO: 42363 - RNA, 22 nt, Artificial Sequence
  Synthetic
cauuaccauacccggaacccca

SEQ ID NO: 42364 - RNA, 23 nt, Artificial Sequence
  Synthetic
ucauuaccauacccggaacccca

SEQ ID NO: 42365 - RNA, 24 nt, Artificial Sequence
  Synthetic
cucauuaccauacccggaacccca

SEQ ID NO: 42366 - RNA, 18 nt, Artificial Sequence
  Synthetic
ccaacccgguguccccca

SEQ ID NO: 42367 - RNA, 19 nt, Artificial Sequence
  Synthetic
cccaacccgguguccccca

SEQ ID NO: 42368 - RNA, 20 nt, Artificial Sequence
  Synthetic
gcccaacccgguguccccca

SEQ ID NO: 42369 - RNA, 21 nt, Artificial Sequence
  Synthetic
ggcccaacccgguguccccca

SEQ ID NO: 42370 - RNA, 22 nt, Artificial Sequence
  Synthetic
gggcccaacccgguguccccca

SEQ ID NO: 42371 - RNA, 23 nt, Artificial Sequence
  Synthetic
ggggcccaacccgguguccccca

SEQ ID NO: 42372 - RNA, 24 nt, Artificial Sequence
  Synthetic
gggggcccaacccgguguccccca

SEQ ID NO: 42373 - RNA, 18 nt, Artificial Sequence
  Synthetic
acgccuuuccccucccca

SEQ ID NO: 42374 - RNA, 19 nt, Artificial Sequence
  Synthetic
cacgccuuuccccucccca

SEQ ID NO: 42375 - RNA, 20 nt, Artificial Sequence
  Synthetic
ccacgccuuuccccucccca

SEQ ID NO: 42376 - RNA, 21 nt, Artificial Sequence
  Synthetic
cccacgccuuuccccucccca

SEQ ID NO: 42377 - RNA, 22 nt, Artificial Sequence
  Synthetic
ccccacgccuuuccccucccca

SEQ ID NO: 42378 - RNA, 23 nt, Artificial Sequence
  Synthetic
accccacgccuuuccccucccca

SEQ ID NO: 42379 - RNA, 24 nt, Artificial Sequence
  Synthetic
uaccccacgccuuuccccucccca

SEQ ID NO: 42380 - RNA, 18 nt, Artificial Sequence
  Synthetic
caauggccgcgcguccca

SEQ ID NO: 42381 - RNA, 19 nt, Artificial Sequence
  Synthetic
ccaauggccgcgcguccca

SEQ ID NO: 42382 - RNA, 20 nt, Artificial Sequence
  Synthetic
cccaauggccgcgcguccca

SEQ ID NO: 42383 - RNA, 21 nt, Artificial Sequence
  Synthetic
ccccaauggccgcgcguccca

SEQ ID NO: 42384 - RNA, 22 nt, Artificial Sequence
  Synthetic
cccccaauggccgcgcguccca

SEQ ID NO: 42385 - RNA, 23 nt, Artificial Sequence
  Synthetic
ucccccaauggccgcgcguccca

SEQ ID NO: 42386 - RNA, 24 nt, Artificial Sequence
  Synthetic
uucccccaauggccgcgcguccca

SEQ ID NO: 42387 - RNA, 18 nt, Artificial Sequence
  Synthetic
cuccggggcggggcucca

SEQ ID NO: 42388 - RNA, 19 nt, Artificial Sequence
  Synthetic
gcuccggggcggggcucca

SEQ ID NO: 42389 - RNA, 20 nt, Artificial Sequence
  Synthetic
cgcuccggggcggggcucca

SEQ ID NO: 42390 - RNA, 21 nt, Artificial Sequence
  Synthetic
ucgcuccggggcggggcucca

SEQ ID NO: 42391 - RNA, 22 nt, Artificial Sequence
  Synthetic
cucgcuccggggcggggcucca

SEQ ID NO: 42392 - RNA, 23 nt, Artificial Sequence
  Synthetic
acucgcuccggggcggggcucca

SEQ ID NO: 42393 - RNA, 24 nt, Artificial Sequence
  Synthetic
uacucgcuccggggcggggcucca

SEQ ID NO: 42394 - RNA, 18 nt, Artificial Sequence
  Synthetic
gggaccaaugcggguuca

SEQ ID NO: 42395 - RNA, 19 nt, Artificial Sequence
  Synthetic
ggggaccaaugcggguuca

SEQ ID NO: 42396 - RNA, 20 nt, Artificial Sequence
  Synthetic
aggggaccaaugcggguuca

SEQ ID NO: 42397 - RNA, 21 nt, Artificial Sequence
  Synthetic
caggggaccaaugcggguuca

SEQ ID NO: 42398 - RNA, 22 nt, Artificial Sequence
  Synthetic
ccaggggaccaaugcggguuca

SEQ ID NO: 42399 - RNA, 23 nt, Artificial Sequence
  Synthetic
cccaggggaccaaugcggguuca

SEQ ID NO: 42400 - RNA, 24 nt, Artificial Sequence
  Synthetic
ccccaggggaccaaugcggguuca

SEQ ID NO: 42401 - RNA, 18 nt, Artificial Sequence
  Synthetic
ucuguggugaugcggaga

SEQ ID NO: 42402 - RNA, 19 nt, Artificial Sequence
  Synthetic
uucuguggugaugcggaga

SEQ ID NO: 42403 - RNA, 20 nt, Artificial Sequence
  Synthetic
cuucuguggugaugcggaga

SEQ ID NO: 42404 - RNA, 21 nt, Artificial Sequence
  Synthetic
gcuucuguggugaugcggaga

SEQ ID NO: 42405 - RNA, 22 nt, Artificial Sequence
  Synthetic
ggcuucuguggugaugcggaga

SEQ ID NO: 42406 - RNA, 23 nt, Artificial Sequence
  Synthetic
gggcuucuguggugaugcggaga

SEQ ID NO: 42407 - RNA, 24 nt, Artificial Sequence
  Synthetic
ggggcuucuguggugaugcggaga

SEQ ID NO: 42408 - RNA, 18 nt, Artificial Sequence
  Synthetic
cggcuggagggucgcgga

SEQ ID NO: 42409 - RNA, 19 nt, Artificial Sequence
  Synthetic
gcggcuggagggucgcgga

SEQ ID NO: 42410 - RNA, 20 nt, Artificial Sequence
  Synthetic
ugcggcuggagggucgcgga

SEQ ID NO: 42411 - RNA, 21 nt, Artificial Sequence
  Synthetic
augcggcuggagggucgcgga

SEQ ID NO: 42412 - RNA, 22 nt, Artificial Sequence
  Synthetic
uaugcggcuggagggucgcgga

SEQ ID NO: 42413 - RNA, 23 nt, Artificial Sequence
  Synthetic
guaugcggcuggagggucgcgga

SEQ ID NO: 42414 - RNA, 24 nt, Artificial Sequence
  Synthetic
cguaugcggcuggagggucgcgga

SEQ ID NO: 42415 - RNA, 18 nt, Artificial Sequence
  Synthetic
cuucuguggugaugcgga

SEQ ID NO: 42416 - RNA, 19 nt, Artificial Sequence
  Synthetic
gcuucuguggugaugcgga

SEQ ID NO: 42417 - RNA, 20 nt, Artificial Sequence
  Synthetic
ggcuucuguggugaugcgga

SEQ ID NO: 42418 - RNA, 21 nt, Artificial Sequence
  Synthetic
gggcuucuguggugaugcgga

SEQ ID NO: 42419 - RNA, 22 nt, Artificial Sequence
  Synthetic
ggggcuucuguggugaugcgga

SEQ ID NO: 42420 - RNA, 23 nt, Artificial Sequence
  Synthetic
cggggcuucuguggugaugcgga

SEQ ID NO: 42421 - RNA, 24 nt, Artificial Sequence
  Synthetic
gcggggcuucuguggugaugcgga

SEQ ID NO: 42422 - RNA, 18 nt, Artificial Sequence
  Synthetic
cccggcucccguguauga

SEQ ID NO: 42423 - RNA, 19 nt, Artificial Sequence
  Synthetic
gcccggcucccguguauga

SEQ ID NO: 42424 - RNA, 20 nt, Artificial Sequence
  Synthetic
cgcccggcucccguguauga

SEQ ID NO: 42425 - RNA, 21 nt, Artificial Sequence
  Synthetic
gcgcccggcucccguguauga

SEQ ID NO: 42426 - RNA, 22 nt, Artificial Sequence
  Synthetic
ggcgcccggcucccguguauga

SEQ ID NO: 42427 - RNA, 23 nt, Artificial Sequence
  Synthetic
uggcgcccggcucccguguauga

SEQ ID NO: 42428 - RNA, 24 nt, Artificial Sequence
  Synthetic
auggcgcccggcucccguguauga

SEQ ID NO: 42429 - RNA, 18 nt, Artificial Sequence
  Synthetic
cgcgggaggcggggaaua

SEQ ID NO: 42430 - RNA, 19 nt, Artificial Sequence
  Synthetic
gcgcgggaggcggggaaua

SEQ ID NO: 42431 - RNA, 20 nt, Artificial Sequence
  Synthetic
ggcgcgggaggcggggaaua

SEQ ID NO: 42432 - RNA, 21 nt, Artificial Sequence
  Synthetic
cggcgcgggaggcggggaaua

SEQ ID NO: 42433 - RNA, 22 nt, Artificial Sequence
  Synthetic
gcggcgcgggaggcggggaaua

SEQ ID NO: 42434 - RNA, 23 nt, Artificial Sequence
  Synthetic
cgcggcgcgggaggcggggaaua

SEQ ID NO: 42435 - RNA, 24 nt, Artificial Sequence
  Synthetic
gcgcggcgcgggaggcggggaaua

SEQ ID NO: 42436 - RNA, 18 nt, Artificial Sequence
  Synthetic
cccucccgccgacgcaac

SEQ ID NO: 42437 - RNA, 19 nt, Artificial Sequence
  Synthetic
ccccucccgccgacgcaac

SEQ ID NO: 42438 - RNA, 20 nt, Artificial Sequence
  Synthetic
gccccucccgccgacgcaac

SEQ ID NO: 42439 - RNA, 21 nt, Artificial Sequence
  Synthetic
ugccccucccgccgacgcaac

SEQ ID NO: 42440 - RNA, 22 nt, Artificial Sequence
  Synthetic
augccccucccgccgacgcaac

SEQ ID NO: 42441 - RNA, 23 nt, Artificial Sequence
  Synthetic
caugccccucccgccgacgcaac

SEQ ID NO: 42442 - RNA, 24 nt, Artificial Sequence
  Synthetic
gcaugccccucccgccgacgcaac

SEQ ID NO: 42443 - RNA, 18 nt, Artificial Sequence
  Synthetic
aaaagcaauuagcauaac

SEQ ID NO: 42444 - RNA, 19 nt, Artificial Sequence
  Synthetic
aaaaagcaauuagcauaac

SEQ ID NO: 42445 - RNA, 20 nt, Artificial Sequence
  Synthetic
aaaaaagcaauuagcauaac

SEQ ID NO: 42446 - RNA, 21 nt, Artificial Sequence
  Synthetic
caaaaaagcaauuagcauaac

SEQ ID NO: 42447 - RNA, 22 nt, Artificial Sequence
  Synthetic
ccaaaaaagcaauuagcauaac

SEQ ID NO: 42448 - RNA, 23 nt, Artificial Sequence
  Synthetic
gccaaaaaagcaauuagcauaac

SEQ ID NO: 42449 - RNA, 24 nt, Artificial Sequence
  Synthetic
cgccaaaaaagcaauuagcauaac

SEQ ID NO: 42450 - RNA, 18 nt, Artificial Sequence
  Synthetic
agaaacucauuaccauac

SEQ ID NO: 42451 - RNA, 19 nt, Artificial Sequence
  Synthetic
aagaaacucauuaccauac

SEQ ID NO: 42452 - RNA, 20 nt, Artificial Sequence
  Synthetic
gaagaaacucauuaccauac

SEQ ID NO: 42453 - RNA, 21 nt, Artificial Sequence
  Synthetic
cgaagaaacucauuaccauac

SEQ ID NO: 42454 - RNA, 22 nt, Artificial Sequence
  Synthetic
ccgaagaaacucauuaccauac

SEQ ID NO: 42455 - RNA, 23 nt, Artificial Sequence
  Synthetic
cccgaagaaacucauuaccauac

SEQ ID NO: 42456 - RNA, 24 nt, Artificial Sequence
  Synthetic
ucccgaagaaacucauuaccauac

SEQ ID NO: 42457 - RNA, 18 nt, Artificial Sequence
  Synthetic
aaagcaauuagcauaacc

SEQ ID NO: 42458 - RNA, 19 nt, Artificial Sequence
  Synthetic
aaaagcaauuagcauaacc

SEQ ID NO: 42459 - RNA, 20 nt, Artificial Sequence
  Synthetic
aaaaagcaauuagcauaacc

SEQ ID NO: 42460 - RNA, 21 nt, Artificial Sequence
  Synthetic
aaaaaagcaauuagcauaacc

SEQ ID NO: 42461 - RNA, 22 nt, Artificial Sequence
  Synthetic
caaaaaagcaauuagcauaacc

SEQ ID NO: 42462 - RNA, 23 nt, Artificial Sequence
  Synthetic
ccaaaaaagcaauuagcauaacc

SEQ ID NO: 42463 - RNA, 24 nt, Artificial Sequence
  Synthetic
gccaaaaaagcaauuagcauaacc

SEQ ID NO: 42464 - RNA, 18 nt, Artificial Sequence
  Synthetic
aggggaggcaggcccacc

SEQ ID NO: 42465 - RNA, 19 nt, Artificial Sequence
  Synthetic
caggggaggcaggcccacc

SEQ ID NO: 42466 - RNA, 20 nt, Artificial Sequence
  Synthetic
ccaggggaggcaggcccacc

SEQ ID NO: 42467 - RNA, 21 nt, Artificial Sequence
  Synthetic
cccaggggaggcaggcccacc

SEQ ID NO: 42468 - RNA, 22 nt, Artificial Sequence
  Synthetic
ucccaggggaggcaggcccacc

SEQ ID NO: 42469 - RNA, 23 nt, Artificial Sequence
  Synthetic
gucccaggggaggcaggcccacc

SEQ ID NO: 42470 - RNA, 24 nt, Artificial Sequence
  Synthetic
cgucccaggggaggcaggcccacc

SEQ ID NO: 42471 - RNA, 18 nt, Artificial Sequence
  Synthetic
gaaacucauuaccauacc

SEQ ID NO: 42472 - RNA, 19 nt, Artificial Sequence
  Synthetic
agaaacucauuaccauacc

SEQ ID NO: 42473 - RNA, 20 nt, Artificial Sequence
  Synthetic
aagaaacucauuaccauacc

SEQ ID NO: 42474 - RNA, 21 nt, Artificial Sequence
  Synthetic
gaagaaacucauuaccauacc

SEQ ID NO: 42475 - RNA, 22 nt, Artificial Sequence
  Synthetic
cgaagaaacucauuaccauacc

SEQ ID NO: 42476 - RNA, 23 nt, Artificial Sequence
  Synthetic
ccgaagaaacucauuaccauacc

SEQ ID NO: 42477 - RNA, 24 nt, Artificial Sequence
  Synthetic
cccgaagaaacucauuaccauacc

SEQ ID NO: 42478 - RNA, 18 nt, Artificial Sequence
  Synthetic
uagcauaacccggaaccc

SEQ ID NO: 42479 - RNA, 19 nt, Artificial Sequence
  Synthetic
uuagcauaacccggaaccc

SEQ ID NO: 42480 - RNA, 20 nt, Artificial Sequence
  Synthetic
auuagcauaacccggaaccc

SEQ ID NO: 42481 - RNA, 21 nt, Artificial Sequence
  Synthetic
aauuagcauaacccggaaccc

SEQ ID NO: 42482 - RNA, 22 nt, Artificial Sequence
  Synthetic
caauuagcauaacccggaaccc

SEQ ID NO: 42483 - RNA, 23 nt, Artificial Sequence
  Synthetic
gcaauuagcauaacccggaaccc

SEQ ID NO: 42484 - RNA, 24 nt, Artificial Sequence
  Synthetic
agcaauuagcauaacccggaaccc

SEQ ID NO: 42485 - RNA, 18 nt, Artificial Sequence
  Synthetic
uuaccauacccggaaccc

SEQ ID NO: 42486 - RNA, 19 nt, Artificial Sequence
  Synthetic
auuaccauacccggaaccc

SEQ ID NO: 42487 - RNA, 20 nt, Artificial Sequence
  Synthetic
cauuaccauacccggaaccc

SEQ ID NO: 42488 - RNA, 21 nt, Artificial Sequence
  Synthetic
ucauuaccauacccggaaccc

SEQ ID NO: 42489 - RNA, 22 nt, Artificial Sequence
  Synthetic
cucauuaccauacccggaaccc

SEQ ID NO: 42490 - RNA, 23 nt, Artificial Sequence
  Synthetic
acucauuaccauacccggaaccc

SEQ ID NO: 42491 - RNA, 24 nt, Artificial Sequence
  Synthetic
aacucauuaccauacccggaaccc

SEQ ID NO: 42492 - RNA, 18 nt, Artificial Sequence
  Synthetic
ggguucauugagcgaccc

SEQ ID NO: 42493 - RNA, 19 nt, Artificial Sequence
  Synthetic
cggguucauugagcgaccc

SEQ ID NO: 42494 - RNA, 20 nt, Artificial Sequence
  Synthetic
gcggguucauugagcgaccc

SEQ ID NO: 42495 - RNA, 21 nt, Artificial Sequence
  Synthetic
ugcggguucauugagcgaccc

SEQ ID NO: 42496 - RNA, 22 nt, Artificial Sequence
  Synthetic
augcggguucauugagcgaccc

SEQ ID NO: 42497 - RNA, 23 nt, Artificial Sequence
  Synthetic
aaugcggguucauugagcgaccc

SEQ ID NO: 42498 - RNA, 24 nt, Artificial Sequence
  Synthetic
caaugcggguucauugagcgaccc

SEQ ID NO: 42499 - RNA, 18 nt, Artificial Sequence
  Synthetic
agcauaacccggaacccc

SEQ ID NO: 42500 - RNA, 19 nt, Artificial Sequence
  Synthetic
uagcauaacccggaacccc

SEQ ID NO: 42501 - RNA, 20 nt, Artificial Sequence
  Synthetic
uuagcauaacccggaacccc

SEQ ID NO: 42502 - RNA, 21 nt, Artificial Sequence
  Synthetic
auuagcauaacccggaacccc

SEQ ID NO: 42503 - RNA, 22 nt, Artificial Sequence
  Synthetic
aauuagcauaacccggaacccc

SEQ ID NO: 42504 - RNA, 23 nt, Artificial Sequence
  Synthetic
caauuagcauaacccggaacccc

SEQ ID NO: 42505 - RNA, 24 nt, Artificial Sequence
  Synthetic
gcaauuagcauaacccggaacccc

SEQ ID NO: 42506 - RNA, 18 nt, Artificial Sequence
  Synthetic
uaccauacccggaacccc

SEQ ID NO: 42507 - RNA, 19 nt, Artificial Sequence
  Synthetic
uuaccauacccggaacccc

SEQ ID NO: 42508 - RNA, 20 nt, Artificial Sequence
  Synthetic
auuaccauacccggaacccc

SEQ ID NO: 42509 - RNA, 21 nt, Artificial Sequence
  Synthetic
cauuaccauacccggaacccc

SEQ ID NO: 42510 - RNA, 22 nt, Artificial Sequence
  Synthetic
ucauuaccauacccggaacccc

SEQ ID NO: 42511 - RNA, 23 nt, Artificial Sequence
  Synthetic
cucauuaccauacccggaacccc

SEQ ID NO: 42512 - RNA, 24 nt, Artificial Sequence
  Synthetic
acucauuaccauacccggaacccc

SEQ ID NO: 42513 - RNA, 18 nt, Artificial Sequence
  Synthetic
cggggcggccccgucccc

SEQ ID NO: 42514 - RNA, 19 nt, Artificial Sequence
  Synthetic
gcggggcggccccgucccc

SEQ ID NO: 42515 - RNA, 20 nt, Artificial Sequence
  Synthetic
cgcggggcggccccgucccc

SEQ ID NO: 42516 - RNA, 21 nt, Artificial Sequence
  Synthetic
ccgcggggcggccccgucccc

SEQ ID NO: 42517 - RNA, 22 nt, Artificial Sequence
  Synthetic
accgcggggcggccccgucccc

SEQ ID NO: 42518 - RNA, 23 nt, Artificial Sequence
  Synthetic
caccgcggggcggccccgucccc

SEQ ID NO: 42519 - RNA, 24 nt, Artificial Sequence
  Synthetic
ccaccgcggggcggccccgucccc

SEQ ID NO: 42520 - RNA, 18 nt, Artificial Sequence
  Synthetic
uggccugcgucggugccc

SEQ ID NO: 42521 - RNA, 19 nt, Artificial Sequence
  Synthetic
uuggccugcgucggugccc

SEQ ID NO: 42522 - RNA, 20 nt, Artificial Sequence
  Synthetic
cuuggccugcgucggugccc

SEQ ID NO: 42523 - RNA, 21 nt, Artificial Sequence
  Synthetic
gcuuggccugcgucggugccc

SEQ ID NO: 42524 - RNA, 22 nt, Artificial Sequence
  Synthetic
ggcuuggccugcgucggugccc

SEQ ID NO: 42525 - RNA, 23 nt, Artificial Sequence
  Synthetic
gggcuuggccugcgucggugccc

SEQ ID NO: 42526 - RNA, 24 nt, Artificial Sequence
  Synthetic
ggggcuuggccugcgucggugccc

SEQ ID NO: 42527 - RNA, 18 nt, Artificial Sequence
  Synthetic
gcggggcggccccguccc

SEQ ID NO: 42528 - RNA, 19 nt, Artificial Sequence
  Synthetic
cgcggggcggccccguccc

SEQ ID NO: 42529 - RNA, 20 nt, Artificial Sequence
  Synthetic
ccgcggggcggccccguccc

SEQ ID NO: 42530 - RNA, 21 nt, Artificial Sequence
  Synthetic
accgcggggcggccccguccc

SEQ ID NO: 42531 - RNA, 22 nt, Artificial Sequence
  Synthetic
caccgcggggcggccccguccc

SEQ ID NO: 42532 - RNA, 23 nt, Artificial Sequence
  Synthetic
ccaccgcggggcggccccguccc

SEQ ID NO: 42533 - RNA, 24 nt, Artificial Sequence
  Synthetic
cccaccgcggggcggccccguccc

SEQ ID NO: 42534 - RNA, 18 nt, Artificial Sequence
  Synthetic
ccaauggccgcgcguccc

SEQ ID NO: 42535 - RNA, 19 nt, Artificial Sequence
  Synthetic
cccaauggccgcgcguccc

SEQ ID NO: 42536 - RNA, 20 nt, Artificial Sequence
  Synthetic
ccccaauggccgcgcguccc

SEQ ID NO: 42537 - RNA, 21 nt, Artificial Sequence
  Synthetic
cccccaauggccgcgcguccc

SEQ ID NO: 42538 - RNA, 22 nt, Artificial Sequence
  Synthetic
ucccccaauggccgcgcguccc

SEQ ID NO: 42539 - RNA, 23 nt, Artificial Sequence
  Synthetic
uucccccaauggccgcgcguccc

SEQ ID NO: 42540 - RNA, 24 nt, Artificial Sequence
  Synthetic
auucccccaauggccgcgcguccc

SEQ ID NO: 42541 - RNA, 18 nt, Artificial Sequence
  Synthetic
ucgcggacggaggguccc

SEQ ID NO: 42542 - RNA, 19 nt, Artificial Sequence
  Synthetic
gucgcggacggaggguccc

SEQ ID NO: 42543 - RNA, 20 nt, Artificial Sequence
  Synthetic
ggucgcggacggaggguccc

SEQ ID NO: 42544 - RNA, 21 nt, Artificial Sequence
  Synthetic
gggucgcggacggaggguccc

SEQ ID NO: 42545 - RNA, 22 nt, Artificial Sequence
  Synthetic
agggucgcggacggaggguccc

SEQ ID NO: 42546 - RNA, 23 nt, Artificial Sequence
  Synthetic
gagggucgcggacggaggguccc

SEQ ID NO: 42547 - RNA, 24 nt, Artificial Sequence
  Synthetic
ggagggucgcggacggaggguccc

SEQ ID NO: 42548 - RNA, 18 nt, Artificial Sequence
  Synthetic
gguugcccauuaagggcc

SEQ ID NO: 42549 - RNA, 19 nt, Artificial Sequence
  Synthetic
ggguugcccauuaagggcc

SEQ ID NO: 42550 - RNA, 20 nt, Artificial Sequence
  Synthetic
gggguugcccauuaagggcc

SEQ ID NO: 42551 - RNA, 21 nt, Artificial Sequence
  Synthetic
cgggguugcccauuaagggcc

SEQ ID NO: 42552 - RNA, 22 nt, Artificial Sequence
  Synthetic
ccgggguugcccauuaagggcc

SEQ ID NO: 42553 - RNA, 23 nt, Artificial Sequence
  Synthetic
accgggguugcccauuaagggcc

SEQ ID NO: 42554 - RNA, 24 nt, Artificial Sequence
  Synthetic
uaccgggguugcccauuaagggcc

SEQ ID NO: 42555 - RNA, 18 nt, Artificial Sequence
  Synthetic
uuggccugcgucggugcc

SEQ ID NO: 42556 - RNA, 19 nt, Artificial Sequence
  Synthetic
cuuggccugcgucggugcc

SEQ ID NO: 42557 - RNA, 20 nt, Artificial Sequence
  Synthetic
gcuuggccugcgucggugcc

SEQ ID NO: 42558 - RNA, 21 nt, Artificial Sequence
  Synthetic
ggcuuggccugcgucggugcc

SEQ ID NO: 42559 - RNA, 22 nt, Artificial Sequence
  Synthetic
gggcuuggccugcgucggugcc

SEQ ID NO: 42560 - RNA, 23 nt, Artificial Sequence
  Synthetic
ggggcuuggccugcgucggugcc

SEQ ID NO: 42561 - RNA, 24 nt, Artificial Sequence
  Synthetic
aggggcuuggccugcgucggugcc

SEQ ID NO: 42562 - RNA, 18 nt, Artificial Sequence
  Synthetic
gcuccggggcggggcucc

SEQ ID NO: 42563 - RNA, 19 nt, Artificial Sequence
  Synthetic
cgcuccggggcggggcucc

SEQ ID NO: 42564 - RNA, 20 nt, Artificial Sequence
  Synthetic
ucgcuccggggcggggcucc

SEQ ID NO: 42565 - RNA, 21 nt, Artificial Sequence
  Synthetic
cucgcuccggggcggggcucc

SEQ ID NO: 42566 - RNA, 22 nt, Artificial Sequence
  Synthetic
acucgcuccggggcggggcucc

SEQ ID NO: 42567 - RNA, 23 nt, Artificial Sequence
  Synthetic
uacucgcuccggggcggggcucc

SEQ ID NO: 42568 - RNA, 24 nt, Artificial Sequence
  Synthetic
guacucgcuccggggcggggcucc

SEQ ID NO: 42569 - RNA, 18 nt, Artificial Sequence
  Synthetic
cgcggggcggccccgucc

SEQ ID NO: 42570 - RNA, 19 nt, Artificial Sequence
  Synthetic
ccgcggggcggccccgucc

SEQ ID NO: 42571 - RNA, 20 nt, Artificial Sequence
  Synthetic
accgcggggcggccccgucc

SEQ ID NO: 42572 - RNA, 21 nt, Artificial Sequence
  Synthetic
caccgcggggcggccccgucc

SEQ ID NO: 42573 - RNA, 22 nt, Artificial Sequence
  Synthetic
ccaccgcggggcggccccgucc

SEQ ID NO: 42574 - RNA, 23 nt, Artificial Sequence
  Synthetic
cccaccgcggggcggccccgucc

SEQ ID NO: 42575 - RNA, 24 nt, Artificial Sequence
  Synthetic
gcccaccgcggggcggccccgucc

SEQ ID NO: 42576 - RNA, 18 nt, Artificial Sequence
  Synthetic
cccaauggccgcgcgucc

SEQ ID NO: 42577 - RNA, 19 nt, Artificial Sequence
  Synthetic
ccccaauggccgcgcgucc

SEQ ID NO: 42578 - RNA, 20 nt, Artificial Sequence
  Synthetic
cccccaauggccgcgcgucc

SEQ ID NO: 42579 - RNA, 21 nt, Artificial Sequence
  Synthetic
ucccccaauggccgcgcgucc

SEQ ID NO: 42580 - RNA, 22 nt, Artificial Sequence
  Synthetic
uucccccaauggccgcgcgucc

SEQ ID NO: 42581 - RNA, 23 nt, Artificial Sequence
  Synthetic
auucccccaauggccgcgcgucc

SEQ ID NO: 42582 - RNA, 24 nt, Artificial Sequence
  Synthetic
gauucccccaauggccgcgcgucc

SEQ ID NO: 42583 - RNA, 18 nt, Artificial Sequence
  Synthetic
gucgcggacggagggucc

SEQ ID NO: 42584 - RNA, 19 nt, Artificial Sequence
  Synthetic
ggucgcggacggagggucc

SEQ ID NO: 42585 - RNA, 20 nt, Artificial Sequence
  Synthetic
gggucgcggacggagggucc

SEQ ID NO: 42586 - RNA, 21 nt, Artificial Sequence
  Synthetic
agggucgcggacggagggucc

SEQ ID NO: 42587 - RNA, 22 nt, Artificial Sequence
  Synthetic
gagggucgcggacggagggucc

SEQ ID NO: 42588 - RNA, 23 nt, Artificial Sequence
  Synthetic
ggagggucgcggacggagggucc

SEQ ID NO: 42589 - RNA, 24 nt, Artificial Sequence
  Synthetic
uggagggucgcggacggagggucc

SEQ ID NO: 42590 - RNA, 18 nt, Artificial Sequence
  Synthetic
gcgggaauugccggaagc

SEQ ID NO: 42591 - RNA, 19 nt, Artificial Sequence
  Synthetic
cgcgggaauugccggaagc

SEQ ID NO: 42592 - RNA, 20 nt, Artificial Sequence
  Synthetic
ccgcgggaauugccggaagc

SEQ ID NO: 42593 - RNA, 21 nt, Artificial Sequence
  Synthetic
gccgcgggaauugccggaagc

SEQ ID NO: 42594 - RNA, 22 nt, Artificial Sequence
  Synthetic
ggccgcgggaauugccggaagc

SEQ ID NO: 42595 - RNA, 23 nt, Artificial Sequence
  Synthetic
gggccgcgggaauugccggaagc

SEQ ID NO: 42596 - RNA, 24 nt, Artificial Sequence
  Synthetic
agggccgcgggaauugccggaagc

SEQ ID NO: 42597 - RNA, 18 nt, Artificial Sequence
  Synthetic
cggccccucaccucgcgc

SEQ ID NO: 42598 - RNA, 19 nt, Artificial Sequence
  Synthetic
ccggccccucaccucgcgc

SEQ ID NO: 42599 - RNA, 20 nt, Artificial Sequence
  Synthetic
cccggccccucaccucgcgc

SEQ ID NO: 42600 - RNA, 21 nt, Artificial Sequence
  Synthetic
gcccggccccucaccucgcgc

SEQ ID NO: 42601 - RNA, 22 nt, Artificial Sequence
  Synthetic
cgcccggccccucaccucgcgc

SEQ ID NO: 42602 - RNA, 23 nt, Artificial Sequence
  Synthetic
gcgcccggccccucaccucgcgc

SEQ ID NO: 42603 - RNA, 24 nt, Artificial Sequence
  Synthetic
ggcgcccggccccucaccucgcgc

SEQ ID NO: 42604 - RNA, 18 nt, Artificial Sequence
  Synthetic
agugguuacgcgcggcgc

SEQ ID NO: 42605 - RNA, 19 nt, Artificial Sequence
  Synthetic
gagugguuacgcgcggcgc

SEQ ID NO: 42606 - RNA, 20 nt, Artificial Sequence
  Synthetic
ggagugguuacgcgcggcgc

SEQ ID NO: 42607 - RNA, 21 nt, Artificial Sequence
  Synthetic
gggagugguuacgcgcggcgc

SEQ ID NO: 42608 - RNA, 22 nt, Artificial Sequence
  Synthetic
ggggagugguuacgcgcggcgc

SEQ ID NO: 42609 - RNA, 23 nt, Artificial Sequence
  Synthetic
aggggagugguuacgcgcggcgc

SEQ ID NO: 42610 - RNA, 24 nt, Artificial Sequence
  Synthetic
caggggagugguuacgcgcggcgc

SEQ ID NO: 42611 - RNA, 18 nt, Artificial Sequence
  Synthetic
acccgcgggccaaugcgc

SEQ ID NO: 42612 - RNA, 19 nt, Artificial Sequence
  Synthetic
gacccgcgggccaaugcgc

SEQ ID NO: 42613 - RNA, 20 nt, Artificial Sequence
  Synthetic
cgacccgcgggccaaugcgc

SEQ ID NO: 42614 - RNA, 21 nt, Artificial Sequence
  Synthetic
gcgacccgcgggccaaugcgc

SEQ ID NO: 42615 - RNA, 22 nt, Artificial Sequence
  Synthetic
agcgacccgcgggccaaugcgc

SEQ ID NO: 42616 - RNA, 23 nt, Artificial Sequence
  Synthetic
gagcgacccgcgggccaaugcgc

SEQ ID NO: 42617 - RNA, 24 nt, Artificial Sequence
  Synthetic
ugagcgacccgcgggccaaugcgc

SEQ ID NO: 42618 - RNA, 18 nt, Artificial Sequence
  Synthetic
acgcgcggcgcgggaggc

SEQ ID NO: 42619 - RNA, 19 nt, Artificial Sequence
  Synthetic
uacgcgcggcgcgggaggc

SEQ ID NO: 42620 - RNA, 20 nt, Artificial Sequence
  Synthetic
uuacgcgcggcgcgggaggc

SEQ ID NO: 42621 - RNA, 21 nt, Artificial Sequence
  Synthetic
guuacgcgcggcgcgggaggc

SEQ ID NO: 42622 - RNA, 22 nt, Artificial Sequence
  Synthetic
gguuacgcgcggcgcgggaggc

SEQ ID NO: 42623 - RNA, 23 nt, Artificial Sequence
  Synthetic
ugguuacgcgcggcgcgggaggc

SEQ ID NO: 42624 - RNA, 24 nt, Artificial Sequence
  Synthetic
gugguuacgcgcggcgcgggaggc

SEQ ID NO: 42625 - RNA, 18 nt, Artificial Sequence
  Synthetic
ggagugguuacgcgcggc

SEQ ID NO: 42626 - RNA, 19 nt, Artificial Sequence
  Synthetic
gggagugguuacgcgcggc

SEQ ID NO: 42627 - RNA, 20 nt, Artificial Sequence
  Synthetic
ggggagugguuacgcgcggc

SEQ ID NO: 42628 - RNA, 21 nt, Artificial Sequence
  Synthetic
aggggagugguuacgcgcggc

SEQ ID NO: 42629 - RNA, 22 nt, Artificial Sequence
  Synthetic
caggggagugguuacgcgcggc

SEQ ID NO: 42630 - RNA, 23 nt, Artificial Sequence
  Synthetic
ccaggggagugguuacgcgcggc

SEQ ID NO: 42631 - RNA, 24 nt, Artificial Sequence
  Synthetic
cccaggggagugguuacgcgcggc

SEQ ID NO: 42632 - RNA, 18 nt, Artificial Sequence
  Synthetic
augggggucguaugcggc

SEQ ID NO: 42633 - RNA, 19 nt, Artificial Sequence
  Synthetic
caugggggucguaugcggc

SEQ ID NO: 42634 - RNA, 20 nt, Artificial Sequence
  Synthetic
ccaugggggucguaugcggc

SEQ ID NO: 42635 - RNA, 21 nt, Artificial Sequence
  Synthetic
uccaugggggucguaugcggc

SEQ ID NO: 42636 - RNA, 22 nt, Artificial Sequence
  Synthetic
cuccaugggggucguaugcggc

SEQ ID NO: 42637 - RNA, 23 nt, Artificial Sequence
  Synthetic
gcuccaugggggucguaugcggc

SEQ ID NO: 42638 - RNA, 24 nt, Artificial Sequence
  Synthetic
ggcuccaugggggucguaugcggc

SEQ ID NO: 42639 - RNA, 18 nt, Artificial Sequence
  Synthetic
cgacccgcgggccaaugc

SEQ ID NO: 42640 - RNA, 19 nt, Artificial Sequence
  Synthetic
gcgacccgcgggccaaugc

SEQ ID NO: 42641 - RNA, 20 nt, Artificial Sequence
  Synthetic
agcgacccgcgggccaaugc

SEQ ID NO: 42642 - RNA, 21 nt, Artificial Sequence
  Synthetic
gagcgacccgcgggccaaugc

SEQ ID NO: 42643 - RNA, 22 nt, Artificial Sequence
  Synthetic
ugagcgacccgcgggccaaugc

SEQ ID NO: 42644 - RNA, 23 nt, Artificial Sequence
  Synthetic
uugagcgacccgcgggccaaugc

SEQ ID NO: 42645 - RNA, 24 nt, Artificial Sequence
  Synthetic
auugagcgacccgcgggccaaugc

SEQ ID NO: 42646 - RNA, 18 nt, Artificial Sequence
  Synthetic
aagggccgcgggaauugc

SEQ ID NO: 42647 - RNA, 19 nt, Artificial Sequence
  Synthetic
uaagggccgcgggaauugc

SEQ ID NO: 42648 - RNA, 20 nt, Artificial Sequence
  Synthetic
uuaagggccgcgggaauugc

SEQ ID NO: 42649 - RNA, 21 nt, Artificial Sequence
  Synthetic
auuaagggccgcgggaauugc

SEQ ID NO: 42650 - RNA, 22 nt, Artificial Sequence
  Synthetic
cauuaagggccgcgggaauugc

SEQ ID NO: 42651 - RNA, 23 nt, Artificial Sequence
  Synthetic
ccauuaagggccgcgggaauugc

SEQ ID NO: 42652 - RNA, 24 nt, Artificial Sequence
  Synthetic
cccauuaagggccgcgggaauugc

SEQ ID NO: 42653 - RNA, 18 nt, Artificial Sequence
  Synthetic
gccggcggguacucgcuc

SEQ ID NO: 42654 - RNA, 19 nt, Artificial Sequence
  Synthetic
ggccggcggguacucgcuc

SEQ ID NO: 42655 - RNA, 20 nt, Artificial Sequence
  Synthetic
aggccggcggguacucgcuc

SEQ ID NO: 42656 - RNA, 21 nt, Artificial Sequence
  Synthetic
caggccggcggguacucgcuc

SEQ ID NO: 42657 - RNA, 22 nt, Artificial Sequence
  Synthetic
ucaggccggcggguacucgcuc

SEQ ID NO: 42658 - RNA, 23 nt, Artificial Sequence
  Synthetic
cucaggccggcggguacucgcuc

SEQ ID NO: 42659 - RNA, 24 nt, Artificial Sequence
  Synthetic
ccucaggccggcggguacucgcuc

SEQ ID NO: 42660 - RNA, 18 nt, Artificial Sequence
  Synthetic
guaugcggcuggaggguc

SEQ ID NO: 42661 - RNA, 19 nt, Artificial Sequence
  Synthetic
cguaugcggcuggaggguc

SEQ ID NO: 42662 - RNA, 20 nt, Artificial Sequence
  Synthetic
ucguaugcggcuggaggguc

SEQ ID NO: 42663 - RNA, 21 nt, Artificial Sequence
  Synthetic
gucguaugcggcuggaggguc

SEQ ID NO: 42664 - RNA, 22 nt, Artificial Sequence
  Synthetic
ggucguaugcggcuggaggguc

SEQ ID NO: 42665 - RNA, 23 nt, Artificial Sequence
  Synthetic
gggucguaugcggcuggaggguc

SEQ ID NO: 42666 - RNA, 24 nt, Artificial Sequence
  Synthetic
ggggucguaugcggcuggaggguc

SEQ ID NO: 42667 - RNA, 18 nt, Artificial Sequence
  Synthetic
cccuguauauauaggguc

SEQ ID NO: 42668 - RNA, 19 nt, Artificial Sequence
  Synthetic
ucccuguauauauaggguc

SEQ ID NO: 42669 - RNA, 20 nt, Artificial Sequence
  Synthetic
gucccuguauauauaggguc

SEQ ID NO: 42670 - RNA, 21 nt, Artificial Sequence
  Synthetic
ggucccuguauauauaggguc

SEQ ID NO: 42671 - RNA, 22 nt, Artificial Sequence
  Synthetic
cggucccuguauauauaggguc

SEQ ID NO: 42672 - RNA, 23 nt, Artificial Sequence
  Synthetic
ccggucccuguauauauaggguc

SEQ ID NO: 42673 - RNA, 24 nt, Artificial Sequence
  Synthetic
cccggucccuguauauauaggguc

SEQ ID NO: 42674 - RNA, 18 nt, Artificial Sequence
  Synthetic
cccuguauauauaguguc

SEQ ID NO: 42675 - RNA, 19 nt, Artificial Sequence
  Synthetic
ucccuguauauauaguguc

SEQ ID NO: 42676 - RNA, 20 nt, Artificial Sequence
  Synthetic
gucccuguauauauaguguc

SEQ ID NO: 42677 - RNA, 21 nt, Artificial Sequence
  Synthetic
ggucccuguauauauaguguc

SEQ ID NO: 42678 - RNA, 22 nt, Artificial Sequence
  Synthetic
cggucccuguauauauaguguc

SEQ ID NO: 42679 - RNA, 23 nt, Artificial Sequence
  Synthetic
ccggucccuguauauauaguguc

SEQ ID NO: 42680 - RNA, 24 nt, Artificial Sequence
  Synthetic
cccggucccuguauauauaguguc

SEQ ID NO: 42681 - RNA, 18 nt, Artificial Sequence
  Synthetic
ccggggcuucccgccuuc

SEQ ID NO: 42682 - RNA, 19 nt, Artificial Sequence
  Synthetic
cccggggcuucccgccuuc

SEQ ID NO: 42683 - RNA, 20 nt, Artificial Sequence
  Synthetic
ccccggggcuucccgccuuc

SEQ ID NO: 42684 - RNA, 21 nt, Artificial Sequence
  Synthetic
gccccggggcuucccgccuuc

SEQ ID NO: 42685 - RNA, 22 nt, Artificial Sequence
  Synthetic
ugccccggggcuucccgccuuc

SEQ ID NO: 42686 - RNA, 23 nt, Artificial Sequence
  Synthetic
gugccccggggcuucccgccuuc

SEQ ID NO: 42687 - RNA, 24 nt, Artificial Sequence
  Synthetic
ggugccccggggcuucccgccuuc

SEQ ID NO: 42688 - RNA, 18 nt, Artificial Sequence
  Synthetic
cgcgggaauugccggaag

SEQ ID NO: 42689 - RNA, 19 nt, Artificial Sequence
  Synthetic
ccgcgggaauugccggaag

SEQ ID NO: 42690 - RNA, 20 nt, Artificial Sequence
  Synthetic
gccgcgggaauugccggaag

SEQ ID NO: 42691 - RNA, 21 nt, Artificial Sequence
  Synthetic
ggccgcgggaauugccggaag

SEQ ID NO: 42692 - RNA, 22 nt, Artificial Sequence
  Synthetic
gggccgcgggaauugccggaag

SEQ ID NO: 42693 - RNA, 23 nt, Artificial Sequence
  Synthetic
agggccgcgggaauugccggaag

SEQ ID NO: 42694 - RNA, 24 nt, Artificial Sequence
  Synthetic
aagggccgcgggaauugccggaag

SEQ ID NO: 42695 - RNA, 18 nt, Artificial Sequence
  Synthetic
aauggccgcgcgucccag

SEQ ID NO: 42696 - RNA, 19 nt, Artificial Sequence
  Synthetic
caauggccgcgcgucccag

SEQ ID NO: 42697 - RNA, 20 nt, Artificial Sequence
  Synthetic
ccaauggccgcgcgucccag

SEQ ID NO: 42698 - RNA, 21 nt, Artificial Sequence
  Synthetic
cccaauggccgcgcgucccag

SEQ ID NO: 42699 - RNA, 22 nt, Artificial Sequence
  Synthetic
ccccaauggccgcgcgucccag

SEQ ID NO: 42700 - RNA, 23 nt, Artificial Sequence
  Synthetic
cccccaauggccgcgcgucccag

SEQ ID NO: 42701 - RNA, 24 nt, Artificial Sequence
  Synthetic
ucccccaauggccgcgcgucccag

SEQ ID NO: 42702 - RNA, 18 nt, Artificial Sequence
  Synthetic
uucuguggugaugcggag

SEQ ID NO: 42703 - RNA, 19 nt, Artificial Sequence
  Synthetic
cuucuguggugaugcggag

SEQ ID NO: 42704 - RNA, 20 nt, Artificial Sequence
  Synthetic
gcuucuguggugaugcggag

SEQ ID NO: 42705 - RNA, 21 nt, Artificial Sequence
  Synthetic
ggcuucuguggugaugcggag

SEQ ID NO: 42706 - RNA, 22 nt, Artificial Sequence
  Synthetic
gggcuucuguggugaugcggag

SEQ ID NO: 42707 - RNA, 23 nt, Artificial Sequence
  Synthetic
ggggcuucuguggugaugcggag

SEQ ID NO: 42708 - RNA, 24 nt, Artificial Sequence
  Synthetic
cggggcuucuguggugaugcggag

SEQ ID NO: 42709 - RNA, 18 nt, Artificial Sequence
  Synthetic
uuacgcgcggcgcgggag

SEQ ID NO: 42710 - RNA, 19 nt, Artificial Sequence
  Synthetic
guuacgcgcggcgcgggag

SEQ ID NO: 42711 - RNA, 20 nt, Artificial Sequence
  Synthetic
gguuacgcgcggcgcgggag

SEQ ID NO: 42712 - RNA, 21 nt, Artificial Sequence
  Synthetic
ugguuacgcgcggcgcgggag

SEQ ID NO: 42713 - RNA, 22 nt, Artificial Sequence
  Synthetic
gugguuacgcgcggcgcgggag

SEQ ID NO: 42714 - RNA, 23 nt, Artificial Sequence
  Synthetic
agugguuacgcgcggcgcgggag

SEQ ID NO: 42715 - RNA, 24 nt, Artificial Sequence
  Synthetic
gagugguuacgcgcggcgcgggag

SEQ ID NO: 42716 - RNA, 18 nt, Artificial Sequence
  Synthetic
ccggcucccguguaugag

SEQ ID NO: 42717 - RNA, 19 nt, Artificial Sequence
  Synthetic
cccggcucccguguaugag

SEQ ID NO: 42718 - RNA, 20 nt, Artificial Sequence
  Synthetic
gcccggcucccguguaugag

SEQ ID NO: 42719 - RNA, 21 nt, Artificial Sequence
  Synthetic
cgcccggcucccguguaugag

SEQ ID NO: 42720 - RNA, 22 nt, Artificial Sequence
  Synthetic
gcgcccggcucccguguaugag

SEQ ID NO: 42721 - RNA, 23 nt, Artificial Sequence
  Synthetic
ggcgcccggcucccguguaugag

SEQ ID NO: 42722 - RNA, 24 nt, Artificial Sequence
  Synthetic
uggcgcccggcucccguguaugag

SEQ ID NO: 42723 - RNA, 18 nt, Artificial Sequence
  Synthetic
cugggggucgcaacguag

SEQ ID NO: 42724 - RNA, 19 nt, Artificial Sequence
  Synthetic
ccugggggucgcaacguag

SEQ ID NO: 42725 - RNA, 20 nt, Artificial Sequence
  Synthetic
cccugggggucgcaacguag

SEQ ID NO: 42726 - RNA, 21 nt, Artificial Sequence
  Synthetic
ucccugggggucgcaacguag

SEQ ID NO: 42727 - RNA, 22 nt, Artificial Sequence
  Synthetic
gucccugggggucgcaacguag

SEQ ID NO: 42728 - RNA, 23 nt, Artificial Sequence
  Synthetic
ggucccugggggucgcaacguag

SEQ ID NO: 42729 - RNA, 24 nt, Artificial Sequence
  Synthetic
gggucccugggggucgcaacguag

SEQ ID NO: 42730 - RNA, 18 nt, Artificial Sequence
  Synthetic
ggggaggcaggcccaccg

SEQ ID NO: 42731 - RNA, 19 nt, Artificial Sequence
  Synthetic
aggggaggcaggcccaccg

SEQ ID NO: 42732 - RNA, 20 nt, Artificial Sequence
  Synthetic
caggggaggcaggcccaccg

SEQ ID NO: 42733 - RNA, 21 nt, Artificial Sequence
  Synthetic
ccaggggaggcaggcccaccg

SEQ ID NO: 42734 - RNA, 22 nt, Artificial Sequence
  Synthetic
cccaggggaggcaggcccaccg

SEQ ID NO: 42735 - RNA, 23 nt, Artificial Sequence
  Synthetic
ucccaggggaggcaggcccaccg

SEQ ID NO: 42736 - RNA, 24 nt, Artificial Sequence
  Synthetic
gucccaggggaggcaggcccaccg

SEQ ID NO: 42737 - RNA, 18 nt, Artificial Sequence
  Synthetic
gggcuucccgccuucccg

SEQ ID NO: 42738 - RNA, 19 nt, Artificial Sequence
  Synthetic
ggggcuucccgccuucccg

SEQ ID NO: 42739 - RNA, 20 nt, Artificial Sequence
  Synthetic
cggggcuucccgccuucccg

SEQ ID NO: 42740 - RNA, 21 nt, Artificial Sequence
  Synthetic
ccggggcuucccgccuucccg

SEQ ID NO: 42741 - RNA, 22 nt, Artificial Sequence
  Synthetic
cccggggcuucccgccuucccg

SEQ ID NO: 42742 - RNA, 23 nt, Artificial Sequence
  Synthetic
ccccggggcuucccgccuucccg

SEQ ID NO: 42743 - RNA, 24 nt, Artificial Sequence
  Synthetic
gccccggggcuucccgccuucccg

SEQ ID NO: 42744 - RNA, 18 nt, Artificial Sequence
  Synthetic
guugcccauuaagggccg

SEQ ID NO: 42745 - RNA, 19 nt, Artificial Sequence
  Synthetic
gguugcccauuaagggccg

SEQ ID NO: 42746 - RNA, 20 nt, Artificial Sequence
  Synthetic
ggguugcccauuaagggccg

SEQ ID NO: 42747 - RNA, 21 nt, Artificial Sequence
  Synthetic
gggguugcccauuaagggccg

SEQ ID NO: 42748 - RNA, 22 nt, Artificial Sequence
  Synthetic
cgggguugcccauuaagggccg

SEQ ID NO: 42749 - RNA, 23 nt, Artificial Sequence
  Synthetic
ccgggguugcccauuaagggccg

SEQ ID NO: 42750 - RNA, 24 nt, Artificial Sequence
  Synthetic
accgggguugcccauuaagggccg

SEQ ID NO: 42751 - RNA, 18 nt, Artificial Sequence
  Synthetic
cccgcgggccaaugcgcg

SEQ ID NO: 42752 - RNA, 19 nt, Artificial Sequence
  Synthetic
acccgcgggccaaugcgcg

SEQ ID NO: 42753 - RNA, 20 nt, Artificial Sequence
  Synthetic
gacccgcgggccaaugcgcg

SEQ ID NO: 42754 - RNA, 21 nt, Artificial Sequence
  Synthetic
cgacccgcgggccaaugcgcg

SEQ ID NO: 42755 - RNA, 22 nt, Artificial Sequence
  Synthetic
gcgacccgcgggccaaugcgcg

SEQ ID NO: 42756 - RNA, 23 nt, Artificial Sequence
  Synthetic
agcgacccgcgggccaaugcgcg

SEQ ID NO: 42757 - RNA, 24 nt, Artificial Sequence
  Synthetic
gagcgacccgcgggccaaugcgcg

SEQ ID NO: 42758 - RNA, 18 nt, Artificial Sequence
  Synthetic
ccggccccucaccucgcg

SEQ ID NO: 42759 - RNA, 19 nt, Artificial Sequence
  Synthetic
cccggccccucaccucgcg

SEQ ID NO: 42760 - RNA, 20 nt, Artificial Sequence
  Synthetic
gcccggccccucaccucgcg

SEQ ID NO: 42761 - RNA, 21 nt, Artificial Sequence
  Synthetic
cgcccggccccucaccucgcg

SEQ ID NO: 42762 - RNA, 22 nt, Artificial Sequence
  Synthetic
gcgcccggccccucaccucgcg

SEQ ID NO: 42763 - RNA, 23 nt, Artificial Sequence
  Synthetic
ggcgcccggccccucaccucgcg

SEQ ID NO: 42764 - RNA, 24 nt, Artificial Sequence
  Synthetic
uggcgcccggccccucaccucgcg

SEQ ID NO: 42765 - RNA, 18 nt, Artificial Sequence
  Synthetic
gagugguuacgcgcggcg

SEQ ID NO: 42766 - RNA, 19 nt, Artificial Sequence
  Synthetic
ggagugguuacgcgcggcg

SEQ ID NO: 42767 - RNA, 20 nt, Artificial Sequence
  Synthetic
gggagugguuacgcgcggcg

SEQ ID NO: 42768 - RNA, 21 nt, Artificial Sequence
  Synthetic
ggggagugguuacgcgcggcg

SEQ ID NO: 42769 - RNA, 22 nt, Artificial Sequence
  Synthetic
aggggagugguuacgcgcggcg

SEQ ID NO: 42770 - RNA, 23 nt, Artificial Sequence
  Synthetic
caggggagugguuacgcgcggcg

SEQ ID NO: 42771 - RNA, 24 nt, Artificial Sequence
  Synthetic
ccaggggagugguuacgcgcggcg

SEQ ID NO: 42772 - RNA, 18 nt, Artificial Sequence
  Synthetic
ggcuucuguggugaugcg

SEQ ID NO: 42773 - RNA, 19 nt, Artificial Sequence
  Synthetic
gggcuucuguggugaugcg

SEQ ID NO: 42774 - RNA, 20 nt, Artificial Sequence
  Synthetic
ggggcuucuguggugaugcg

SEQ ID NO: 42775 - RNA, 21 nt, Artificial Sequence
  Synthetic
cggggcuucuguggugaugcg

SEQ ID NO: 42776 - RNA, 22 nt, Artificial Sequence
  Synthetic
gcggggcuucuguggugaugcg

SEQ ID NO: 42777 - RNA, 23 nt, Artificial Sequence
  Synthetic
ggcggggcuucuguggugaugcg

SEQ ID NO: 42778 - RNA, 24 nt, Artificial Sequence
  Synthetic
aggcggggcuucuguggugaugcg

SEQ ID NO: 42779 - RNA, 18 nt, Artificial Sequence
  Synthetic
uacgcgcggcgcgggagg

SEQ ID NO: 42780 - RNA, 19 nt, Artificial Sequence
  Synthetic
uuacgcgcggcgcgggagg

SEQ ID NO: 42781 - RNA, 20 nt, Artificial Sequence
  Synthetic
guuacgcgcggcgcgggagg

SEQ ID NO: 42782 - RNA, 21 nt, Artificial Sequence
  Synthetic
gguuacgcgcggcgcgggagg

SEQ ID NO: 42783 - RNA, 22 nt, Artificial Sequence
  Synthetic
ugguuacgcgcggcgcgggagg

SEQ ID NO: 42784 - RNA, 23 nt, Artificial Sequence
  Synthetic
gugguuacgcgcggcgcgggagg

SEQ ID NO: 42785 - RNA, 24 nt, Artificial Sequence
  Synthetic
agugguuacgcgcggcgcgggagg

SEQ ID NO: 42786 - RNA, 18 nt, Artificial Sequence
  Synthetic
ugggggucgcaacguagg

SEQ ID NO: 42787 - RNA, 19 nt, Artificial Sequence
  Synthetic
cugggggucgcaacguagg

SEQ ID NO: 42788 - RNA, 20 nt, Artificial Sequence
  Synthetic
ccugggggucgcaacguagg

SEQ ID NO: 42789 - RNA, 21 nt, Artificial Sequence
  Synthetic
cccugggggucgcaacguagg

SEQ ID NO: 42790 - RNA, 22 nt, Artificial Sequence
  Synthetic
ucccugggggucgcaacguagg

SEQ ID NO: 42791 - RNA, 23 nt, Artificial Sequence
  Synthetic
gucccugggggucgcaacguagg

SEQ ID NO: 42792 - RNA, 24 nt, Artificial Sequence
  Synthetic
ggucccugggggucgcaacguagg

SEQ ID NO: 42793 - RNA, 18 nt, Artificial Sequence
  Synthetic
gcggcuggagggucgcgg

SEQ ID NO: 42794 - RNA, 19 nt, Artificial Sequence
  Synthetic
ugcggcuggagggucgcgg

SEQ ID NO: 42795 - RNA, 20 nt, Artificial Sequence
  Synthetic
augcggcuggagggucgcgg

SEQ ID NO: 42796 - RNA, 21 nt, Artificial Sequence
  Synthetic
uaugcggcuggagggucgcgg

SEQ ID NO: 42797 - RNA, 22 nt, Artificial Sequence
  Synthetic
guaugcggcuggagggucgcgg

SEQ ID NO: 42798 - RNA, 23 nt, Artificial Sequence
  Synthetic
cguaugcggcuggagggucgcgg

SEQ ID NO: 42799 - RNA, 24 nt, Artificial Sequence
  Synthetic
ucguaugcggcuggagggucgcgg

SEQ ID NO: 42800 - RNA, 18 nt, Artificial Sequence
  Synthetic
caugggggucguaugcgg

SEQ ID NO: 42801 - RNA, 19 nt, Artificial Sequence
  Synthetic
ccaugggggucguaugcgg

SEQ ID NO: 42802 - RNA, 20 nt, Artificial Sequence
  Synthetic
uccaugggggucguaugcgg

SEQ ID NO: 42803 - RNA, 21 nt, Artificial Sequence
  Synthetic
cuccaugggggucguaugcgg

SEQ ID NO: 42804 - RNA, 22 nt, Artificial Sequence
  Synthetic
gcuccaugggggucguaugcgg

SEQ ID NO: 42805 - RNA, 23 nt, Artificial Sequence
  Synthetic
ggcuccaugggggucguaugcgg

SEQ ID NO: 42806 - RNA, 24 nt, Artificial Sequence
  Synthetic
gggcuccaugggggucguaugcgg

SEQ ID NO: 42807 - RNA, 18 nt, Artificial Sequence
  Synthetic
ccgguuccaguguaaggg

SEQ ID NO: 42808 - RNA, 19 nt, Artificial Sequence
  Synthetic
gccgguuccaguguaaggg

SEQ ID NO: 42809 - RNA, 20 nt, Artificial Sequence
  Synthetic
ggccgguuccaguguaaggg

SEQ ID NO: 42810 - RNA, 21 nt, Artificial Sequence
  Synthetic
cggccgguuccaguguaaggg

SEQ ID NO: 42811 - RNA, 22 nt, Artificial Sequence
  Synthetic
gcggccgguuccaguguaaggg

SEQ ID NO: 42812 - RNA, 23 nt, Artificial Sequence
  Synthetic
ggcggccgguuccaguguaaggg

SEQ ID NO: 42813 - RNA, 24 nt, Artificial Sequence
  Synthetic
uggcggccgguuccaguguaaggg

SEQ ID NO: 42814 - RNA, 18 nt, Artificial Sequence
  Synthetic
gcggguacucgcuccggg

SEQ ID NO: 42815 - RNA, 19 nt, Artificial Sequence
  Synthetic
ggcggguacucgcuccggg

SEQ ID NO: 42816 - RNA, 20 nt, Artificial Sequence
  Synthetic
cggcggguacucgcuccggg

SEQ ID NO: 42817 - RNA, 21 nt, Artificial Sequence
  Synthetic
ccggcggguacucgcuccggg

SEQ ID NO: 42818 - RNA, 22 nt, Artificial Sequence
  Synthetic
gccggcggguacucgcuccggg

SEQ ID NO: 42819 - RNA, 23 nt, Artificial Sequence
  Synthetic
ggccggcggguacucgcuccggg

SEQ ID NO: 42820 - RNA, 24 nt, Artificial Sequence
  Synthetic
aggccggcggguacucgcuccggg

SEQ ID NO: 42821 - RNA, 18 nt, Artificial Sequence
  Synthetic
cggguacucgcuccgggg

SEQ ID NO: 42822 - RNA, 19 nt, Artificial Sequence
  Synthetic
gcggguacucgcuccgggg

SEQ ID NO: 42823 - RNA, 20 nt, Artificial Sequence
  Synthetic
ggcggguacucgcuccgggg

SEQ ID NO: 42824 - RNA, 21 nt, Artificial Sequence
  Synthetic
cggcggguacucgcuccgggg

SEQ ID NO: 42825 - RNA, 22 nt, Artificial Sequence
  Synthetic
ccggcggguacucgcuccgggg

SEQ ID NO: 42826 - RNA, 23 nt, Artificial Sequence
  Synthetic
gccggcggguacucgcuccgggg

SEQ ID NO: 42827 - RNA, 24 nt, Artificial Sequence
  Synthetic
ggccggcggguacucgcuccgggg

SEQ ID NO: 42828 - RNA, 18 nt, Artificial Sequence
  Synthetic
ggggcuucuguggugaug

SEQ ID NO: 42829 - RNA, 19 nt, Artificial Sequence
  Synthetic
cggggcuucuguggugaug

SEQ ID NO: 42830 - RNA, 20 nt, Artificial Sequence
  Synthetic
gcggggcuucuguggugaug

SEQ ID NO: 42831 - RNA, 21 nt, Artificial Sequence
  Synthetic
ggcggggcuucuguggugaug

SEQ ID NO: 42832 - RNA, 22 nt, Artificial Sequence
  Synthetic
aggcggggcuucuguggugaug

SEQ ID NO: 42833 - RNA, 23 nt, Artificial Sequence
  Synthetic
uaggcggggcuucuguggugaug

SEQ ID NO: 42834 - RNA, 24 nt, Artificial Sequence
  Synthetic
guaggcggggcuucuguggugaug

SEQ ID NO: 42835 - RNA, 18 nt, Artificial Sequence
  Synthetic
ugcgucucgcuccgagug

SEQ ID NO: 42836 - RNA, 19 nt, Artificial Sequence
  Synthetic
cugcgucucgcuccgagug

SEQ ID NO: 42837 - RNA, 20 nt, Artificial Sequence
  Synthetic
gcugcgucucgcuccgagug

SEQ ID NO: 42838 - RNA, 21 nt, Artificial Sequence
  Synthetic
ugcugcgucucgcuccgagug

SEQ ID NO: 42839 - RNA, 22 nt, Artificial Sequence
  Synthetic
cugcugcgucucgcuccgagug

SEQ ID NO: 42840 - RNA, 23 nt, Artificial Sequence
  Synthetic
gcugcugcgucucgcuccgagug

SEQ ID NO: 42841 - RNA, 24 nt, Artificial Sequence
  Synthetic
ggcugcugcgucucgcuccgagug

SEQ ID NO: 42842 - RNA, 18 nt, Artificial Sequence
  Synthetic
uaagggccgcgggaauug

SEQ ID NO: 42843 - RNA, 19 nt, Artificial Sequence
  Synthetic
uuaagggccgcgggaauug

SEQ ID NO: 42844 - RNA, 20 nt, Artificial Sequence
  Synthetic
auuaagggccgcgggaauug

SEQ ID NO: 42845 - RNA, 21 nt, Artificial Sequence
  Synthetic
cauuaagggccgcgggaauug

SEQ ID NO: 42846 - RNA, 22 nt, Artificial Sequence
  Synthetic
ccauuaagggccgcgggaauug

SEQ ID NO: 42847 - RNA, 23 nt, Artificial Sequence
  Synthetic
cccauuaagggccgcgggaauug

SEQ ID NO: 42848 - RNA, 24 nt, Artificial Sequence
  Synthetic
gcccauuaagggccgcgggaauug

SEQ ID NO: 42849 - RNA, 18 nt, Artificial Sequence
  Synthetic
cacggcccggcccccgau

SEQ ID NO: 42850 - RNA, 19 nt, Artificial Sequence
  Synthetic
gcacggcccggcccccgau

SEQ ID NO: 42851 - RNA, 20 nt, Artificial Sequence
  Synthetic
ugcacggcccggcccccgau

SEQ ID NO: 42852 - RNA, 21 nt, Artificial Sequence
  Synthetic
augcacggcccggcccccgau

SEQ ID NO: 42853 - RNA, 22 nt, Artificial Sequence
  Synthetic
caugcacggcccggcccccgau

SEQ ID NO: 42854 - RNA, 23 nt, Artificial Sequence
  Synthetic
gcaugcacggcccggcccccgau

SEQ ID NO: 42855 - RNA, 24 nt, Artificial Sequence
  Synthetic
agcaugcacggcccggcccccgau

SEQ ID NO: 42856 - RNA, 18 nt, Artificial Sequence
  Synthetic
cggggcuucuguggugau

SEQ ID NO: 42857 - RNA, 19 nt, Artificial Sequence
  Synthetic
gcggggcuucuguggugau

SEQ ID NO: 42858 - RNA, 20 nt, Artificial Sequence
  Synthetic
ggcggggcuucuguggugau

SEQ ID NO: 42859 - RNA, 21 nt, Artificial Sequence
  Synthetic
aggcggggcuucuguggugau

SEQ ID NO: 42860 - RNA, 22 nt, Artificial Sequence
  Synthetic
uaggcggggcuucuguggugau

SEQ ID NO: 42861 - RNA, 23 nt, Artificial Sequence
  Synthetic
guaggcggggcuucuguggugau

SEQ ID NO: 42862 - RNA, 24 nt, Artificial Sequence
  Synthetic
cguaggcggggcuucuguggugau

SEQ ID NO: 42863 - RNA, 18 nt, Artificial Sequence
  Synthetic
ggccccucaccucgcgcu

SEQ ID NO: 42864 - RNA, 19 nt, Artificial Sequence
  Synthetic
cggccccucaccucgcgcu

SEQ ID NO: 42865 - RNA, 20 nt, Artificial Sequence
  Synthetic
ccggccccucaccucgcgcu

SEQ ID NO: 42866 - RNA, 21 nt, Artificial Sequence
  Synthetic
cccggccccucaccucgcgcu

SEQ ID NO: 42867 - RNA, 22 nt, Artificial Sequence
  Synthetic
gcccggccccucaccucgcgcu

SEQ ID NO: 42868 - RNA, 23 nt, Artificial Sequence
  Synthetic
cgcccggccccucaccucgcgcu

SEQ ID NO: 42869 - RNA, 24 nt, Artificial Sequence
  Synthetic
gcgcccggccccucaccucgcgcu

SEQ ID NO: 42870 - RNA, 18 nt, Artificial Sequence
  Synthetic
ggccggcggguacucgcu

SEQ ID NO: 42871 - RNA, 19 nt, Artificial Sequence
  Synthetic
aggccggcggguacucgcu

SEQ ID NO: 42872 - RNA, 20 nt, Artificial Sequence
  Synthetic
caggccggcggguacucgcu

SEQ ID NO: 42873 - RNA, 21 nt, Artificial Sequence
  Synthetic
ucaggccggcggguacucgcu

SEQ ID NO: 42874 - RNA, 22 nt, Artificial Sequence
  Synthetic
cucaggccggcggguacucgcu

SEQ ID NO: 42875 - RNA, 23 nt, Artificial Sequence
  Synthetic
ccucaggccggcggguacucgcu

SEQ ID NO: 42876 - RNA, 24 nt, Artificial Sequence
  Synthetic
cccucaggccggcggguacucgcu

SEQ ID NO: 42877 - RNA, 18 nt, Artificial Sequence
  Synthetic
cgguuccaguguaagggu

SEQ ID NO: 42878 - RNA, 19 nt, Artificial Sequence
  Synthetic
ccgguuccaguguaagggu

SEQ ID NO: 42879 - RNA, 20 nt, Artificial Sequence
  Synthetic
gccgguuccaguguaagggu

SEQ ID NO: 42880 - RNA, 21 nt, Artificial Sequence
  Synthetic
ggccgguuccaguguaagggu

SEQ ID NO: 42881 - RNA, 22 nt, Artificial Sequence
  Synthetic
cggccgguuccaguguaagggu

SEQ ID NO: 42882 - RNA, 23 nt, Artificial Sequence
  Synthetic
gcggccgguuccaguguaagggu

SEQ ID NO: 42883 - RNA, 24 nt, Artificial Sequence
  Synthetic
ggcggccgguuccaguguaagggu

SEQ ID NO: 42884 - RNA, 18 nt, Artificial Sequence
  Synthetic
ucccuguauauauagggu

SEQ ID NO: 42885 - RNA, 19 nt, Artificial Sequence
  Synthetic
gucccuguauauauagggu

SEQ ID NO: 42886 - RNA, 20 nt, Artificial Sequence
  Synthetic
ggucccuguauauauagggu

SEQ ID NO: 42887 - RNA, 21 nt, Artificial Sequence
  Synthetic
cggucccuguauauauagggu

SEQ ID NO: 42888 - RNA, 22 nt, Artificial Sequence
  Synthetic
ccggucccuguauauauagggu

SEQ ID NO: 42889 - RNA, 23 nt, Artificial Sequence
  Synthetic
cccggucccuguauauauagggu

SEQ ID NO: 42890 - RNA, 24 nt, Artificial Sequence
  Synthetic
ccccggucccuguauauauagggu

SEQ ID NO: 42891 - RNA, 18 nt, Artificial Sequence
  Synthetic
auaccgggguugcccauu

SEQ ID NO: 42892 - RNA, 19 nt, Artificial Sequence
  Synthetic
aauaccgggguugcccauu

SEQ ID NO: 42893 - RNA, 20 nt, Artificial Sequence
  Synthetic
gaauaccgggguugcccauu

SEQ ID NO: 42894 - RNA, 21 nt, Artificial Sequence
  Synthetic
ggaauaccgggguugcccauu

SEQ ID NO: 42895 - RNA, 22 nt, Artificial Sequence
  Synthetic
gggaauaccgggguugcccauu

SEQ ID NO: 42896 - RNA, 23 nt, Artificial Sequence
  Synthetic
ggggaauaccgggguugcccauu

SEQ ID NO: 42897 - RNA, 24 nt, Artificial Sequence
  Synthetic
cggggaauaccgggguugcccauu

SEQ ID NO: 42898 - RNA, 18 nt, Artificial Sequence
  Synthetic
acggcccggcccccgauu

SEQ ID NO: 42899 - RNA, 19 nt, Artificial Sequence
  Synthetic
cacggcccggcccccgauu

SEQ ID NO: 42900 - RNA, 20 nt, Artificial Sequence
  Synthetic
gcacggcccggcccccgauu

SEQ ID NO: 42901 - RNA, 21 nt, Artificial Sequence
  Synthetic
ugcacggcccggcccccgauu

SEQ ID NO: 42902 - RNA, 22 nt, Artificial Sequence
  Synthetic
augcacggcccggcccccgauu

SEQ ID NO: 42903 - RNA, 23 nt, Artificial Sequence
  Synthetic
caugcacggcccggcccccgauu

SEQ ID NO: 42904 - RNA, 24 nt, Artificial Sequence
  Synthetic
gcaugcacggcccggcccccgauu

SEQ ID NO: 42905 - RNA, 18 nt, Artificial Sequence
  Synthetic
cggcccggcccccgauuu

SEQ ID NO: 42906 - RNA, 19 nt, Artificial Sequence
  Synthetic
acggcccggcccccgauuu

SEQ ID NO: 42907 - RNA, 20 nt, Artificial Sequence
  Synthetic
cacggcccggcccccgauuu

SEQ ID NO: 42908 - RNA, 21 nt, Artificial Sequence
  Synthetic
gcacggcccggcccccgauuu

SEQ ID NO: 42909 - RNA, 22 nt, Artificial Sequence
  Synthetic
ugcacggcccggcccccgauuu

SEQ ID NO: 42910 - RNA, 23 nt, Artificial Sequence
  Synthetic
augcacggcccggcccccgauuu

SEQ ID NO: 42911 - RNA, 24 nt, Artificial Sequence
  Synthetic
caugcacggcccggcccccgauuu

SEQ ID NO: 42912 - RNA, 18 nt, Artificial Sequence
  Synthetic
ccggguugggcccccaaa

SEQ ID NO: 42913 - RNA, 19 nt, Artificial Sequence
  Synthetic
accggguugggcccccaaa

SEQ ID NO: 42914 - RNA, 20 nt, Artificial Sequence
  Synthetic
caccggguugggcccccaaa

SEQ ID NO: 42915 - RNA, 21 nt, Artificial Sequence
  Synthetic
acaccggguugggcccccaaa

SEQ ID NO: 42916 - RNA, 22 nt, Artificial Sequence
  Synthetic
gacaccggguugggcccccaaa

SEQ ID NO: 42917 - RNA, 23 nt, Artificial Sequence
  Synthetic
ggacaccggguugggcccccaaa

SEQ ID NO: 42918 - RNA, 24 nt, Artificial Sequence
  Synthetic
gggacaccggguugggcccccaaa

SEQ ID NO: 42919 - RNA, 18 nt, Artificial Sequence
  Synthetic
gggacccccacucauaca

SEQ ID NO: 42920 - RNA, 19 nt, Artificial Sequence
  Synthetic
ggggacccccacucauaca

SEQ ID NO: 42921 - RNA, 20 nt, Artificial Sequence
  Synthetic
gggggacccccacucauaca

SEQ ID NO: 42922 - RNA, 21 nt, Artificial Sequence
  Synthetic
ugggggacccccacucauaca

SEQ ID NO: 42923 - RNA, 22 nt, Artificial Sequence
  Synthetic
uugggggacccccacucauaca

SEQ ID NO: 42924 - RNA, 23 nt, Artificial Sequence
  Synthetic
guugggggacccccacucauaca

SEQ ID NO: 42925 - RNA, 24 nt, Artificial Sequence
  Synthetic
uguugggggacccccacucauaca

SEQ ID NO: 42926 - RNA, 18 nt, Artificial Sequence
  Synthetic
ggacccccgacccuuaca

SEQ ID NO: 42927 - RNA, 19 nt, Artificial Sequence
  Synthetic
gggacccccgacccuuaca

SEQ ID NO: 42928 - RNA, 20 nt, Artificial Sequence
  Synthetic
ggggacccccgacccuuaca

SEQ ID NO: 42929 - RNA, 21 nt, Artificial Sequence
  Synthetic
gggggacccccgacccuuaca

SEQ ID NO: 42930 - RNA, 22 nt, Artificial Sequence
  Synthetic
ugggggacccccgacccuuaca

SEQ ID NO: 42931 - RNA, 23 nt, Artificial Sequence
  Synthetic
uugggggacccccgacccuuaca

SEQ ID NO: 42932 - RNA, 24 nt, Artificial Sequence
  Synthetic
guugggggacccccgacccuuaca

SEQ ID NO: 42933 - RNA, 18 nt, Artificial Sequence
  Synthetic
ccccucuccgcaucacca

SEQ ID NO: 42934 - RNA, 19 nt, Artificial Sequence
  Synthetic
cccccucuccgcaucacca

SEQ ID NO: 42935 - RNA, 20 nt, Artificial Sequence
  Synthetic
gcccccucuccgcaucacca

SEQ ID NO: 42936 - RNA, 21 nt, Artificial Sequence
  Synthetic
cgcccccucuccgcaucacca

SEQ ID NO: 42937 - RNA, 22 nt, Artificial Sequence
  Synthetic
ccgcccccucuccgcaucacca

SEQ ID NO: 42938 - RNA, 23 nt, Artificial Sequence
  Synthetic
gccgcccccucuccgcaucacca

SEQ ID NO: 42939 - RNA, 24 nt, Artificial Sequence
  Synthetic
ggccgcccccucuccgcaucacca

SEQ ID NO: 42940 - RNA, 18 nt, Artificial Sequence
  Synthetic
agccgcauacgaccccca

SEQ ID NO: 42941 - RNA, 19 nt, Artificial Sequence
  Synthetic
cagccgcauacgaccccca

SEQ ID NO: 42942 - RNA, 20 nt, Artificial Sequence
  Synthetic
ccagccgcauacgaccccca

SEQ ID NO: 42943 - RNA, 21 nt, Artificial Sequence
  Synthetic
uccagccgcauacgaccccca

SEQ ID NO: 42944 - RNA, 22 nt, Artificial Sequence
  Synthetic
cuccagccgcauacgaccccca

SEQ ID NO: 42945 - RNA, 23 nt, Artificial Sequence
  Synthetic
ccuccagccgcauacgaccccca

SEQ ID NO: 42946 - RNA, 24 nt, Artificial Sequence
  Synthetic
cccuccagccgcauacgaccccca

SEQ ID NO: 42947 - RNA, 18 nt, Artificial Sequence
  Synthetic
cccugggacgcgcggcca

SEQ ID NO: 42948 - RNA, 19 nt, Artificial Sequence
  Synthetic
ccccugggacgcgcggcca

SEQ ID NO: 42949 - RNA, 20 nt, Artificial Sequence
  Synthetic
uccccugggacgcgcggcca

SEQ ID NO: 42950 - RNA, 21 nt, Artificial Sequence
  Synthetic
cuccccugggacgcgcggcca

SEQ ID NO: 42951 - RNA, 22 nt, Artificial Sequence
  Synthetic
ccuccccugggacgcgcggcca

SEQ ID NO: 42952 - RNA, 23 nt, Artificial Sequence
  Synthetic
gccuccccugggacgcgcggcca

SEQ ID NO: 42953 - RNA, 24 nt, Artificial Sequence
  Synthetic
ugccuccccugggacgcgcggcca

SEQ ID NO: 42954 - RNA, 18 nt, Artificial Sequence
  Synthetic
uggcccgcgggucgcuca

SEQ ID NO: 42955 - RNA, 19 nt, Artificial Sequence
  Synthetic
uuggcccgcgggucgcuca

SEQ ID NO: 42956 - RNA, 20 nt, Artificial Sequence
  Synthetic
auuggcccgcgggucgcuca

SEQ ID NO: 42957 - RNA, 21 nt, Artificial Sequence
  Synthetic
cauuggcccgcgggucgcuca

SEQ ID NO: 42958 - RNA, 22 nt, Artificial Sequence
  Synthetic
gcauuggcccgcgggucgcuca

SEQ ID NO: 42959 - RNA, 23 nt, Artificial Sequence
  Synthetic
cgcauuggcccgcgggucgcuca

SEQ ID NO: 42960 - RNA, 24 nt, Artificial Sequence
  Synthetic
gcgcauuggcccgcgggucgcuca

SEQ ID NO: 42961 - RNA, 18 nt, Artificial Sequence
  Synthetic
ugcaccucggcacucgga

SEQ ID NO: 42962 - RNA, 19 nt, Artificial Sequence
  Synthetic
uugcaccucggcacucgga

SEQ ID NO: 42963 - RNA, 20 nt, Artificial Sequence
  Synthetic
uuugcaccucggcacucgga

SEQ ID NO: 42964 - RNA, 21 nt, Artificial Sequence
  Synthetic
auuugcaccucggcacucgga

SEQ ID NO: 42965 - RNA, 22 nt, Artificial Sequence
  Synthetic
cauuugcaccucggcacucgga

SEQ ID NO: 42966 - RNA, 23 nt, Artificial Sequence
  Synthetic
gcauuugcaccucggcacucgga

SEQ ID NO: 42967 - RNA, 24 nt, Artificial Sequence
  Synthetic
cgcauuugcaccucggcacucgga

SEQ ID NO: 42968 - RNA, 18 nt, Artificial Sequence
  Synthetic
acacuauauauacaggga

SEQ ID NO: 42969 - RNA, 19 nt, Artificial Sequence
  Synthetic
gacacuauauauacaggga

SEQ ID NO: 42970 - RNA, 20 nt, Artificial Sequence
  Synthetic
ugacacuauauauacaggga

SEQ ID NO: 42971 - RNA, 21 nt, Artificial Sequence
  Synthetic
gugacacuauauauacaggga

SEQ ID NO: 42972 - RNA, 22 nt, Artificial Sequence
  Synthetic
cgugacacuauauauacaggga

SEQ ID NO: 42973 - RNA, 23 nt, Artificial Sequence
  Synthetic
ccgugacacuauauauacaggga

SEQ ID NO: 42974 - RNA, 24 nt, Artificial Sequence
  Synthetic
cccgugacacuauauauacaggga

SEQ ID NO: 42975 - RNA, 18 nt, Artificial Sequence
  Synthetic
acccuauauauacaggga

SEQ ID NO: 42976 - RNA, 19 nt, Artificial Sequence
  Synthetic
gacccuauauauacaggga

SEQ ID NO: 42977 - RNA, 20 nt, Artificial Sequence
  Synthetic
ugacccuauauauacaggga

SEQ ID NO: 42978 - RNA, 21 nt, Artificial Sequence
  Synthetic
cugacccuauauauacaggga

SEQ ID NO: 42979 - RNA, 22 nt, Artificial Sequence
  Synthetic
ccugacccuauauauacaggga

SEQ ID NO: 42980 - RNA, 23 nt, Artificial Sequence
  Synthetic
cccugacccuauauauacaggga

SEQ ID NO: 42981 - RNA, 24 nt, Artificial Sequence
  Synthetic
ccccugacccuauauauacaggga

SEQ ID NO: 42982 - RNA, 18 nt, Artificial Sequence
  Synthetic
cggguugguccccgggga

SEQ ID NO: 42983 - RNA, 19 nt, Artificial Sequence
  Synthetic
ccggguugguccccgggga

SEQ ID NO: 42984 - RNA, 20 nt, Artificial Sequence
  Synthetic
gccggguugguccccgggga

SEQ ID NO: 42985 - RNA, 21 nt, Artificial Sequence
  Synthetic
cgccggguugguccccgggga

SEQ ID NO: 42986 - RNA, 22 nt, Artificial Sequence
  Synthetic
gcgccggguugguccccgggga

SEQ ID NO: 42987 - RNA, 23 nt, Artificial Sequence
  Synthetic
ggcgccggguugguccccgggga

SEQ ID NO: 42988 - RNA, 24 nt, Artificial Sequence
  Synthetic
gggcgccggguugguccccgggga

SEQ ID NO: 42989 - RNA, 18 nt, Artificial Sequence
  Synthetic
cugccgccccuuugggga

SEQ ID NO: 42990 - RNA, 19 nt, Artificial Sequence
  Synthetic
acugccgccccuuugggga

SEQ ID NO: 42991 - RNA, 20 nt, Artificial Sequence
  Synthetic
cacugccgccccuuugggga

SEQ ID NO: 42992 - RNA, 21 nt, Artificial Sequence
  Synthetic
ucacugccgccccuuugggga

SEQ ID NO: 42993 - RNA, 22 nt, Artificial Sequence
  Synthetic
gucacugccgccccuuugggga

SEQ ID NO: 42994 - RNA, 23 nt, Artificial Sequence
  Synthetic
cgucacugccgccccuuugggga

SEQ ID NO: 42995 - RNA, 24 nt, Artificial Sequence
  Synthetic
ucgucacugccgccccuuugggga

SEQ ID NO: 42996 - RNA, 18 nt, Artificial Sequence
  Synthetic
auauuggggggcgccaua

SEQ ID NO: 42997 - RNA, 19 nt, Artificial Sequence
  Synthetic
cauauuggggggcgccaua

SEQ ID NO: 42998 - RNA, 20 nt, Artificial Sequence
  Synthetic
ccauauuggggggcgccaua

SEQ ID NO: 42999 - RNA, 21 nt, Artificial Sequence
  Synthetic
gccauauuggggggcgccaua

SEQ ID NO: 43000 - RNA, 22 nt, Artificial Sequence
  Synthetic
cgccauauuggggggcgccaua

SEQ ID NO: 43001 - RNA, 23 nt, Artificial Sequence
  Synthetic
gcgccauauuggggggcgccaua

SEQ ID NO: 43002 - RNA, 24 nt, Artificial Sequence
  Synthetic
ggcgccauauuggggggcgccaua

SEQ ID NO: 43003 - RNA, 18 nt, Artificial Sequence
  Synthetic
caugucuggggcgccaua

SEQ ID NO: 43004 - RNA, 19 nt, Artificial Sequence
  Synthetic
ccaugucuggggcgccaua

SEQ ID NO: 43005 - RNA, 20 nt, Artificial Sequence
  Synthetic
gccaugucuggggcgccaua

SEQ ID NO: 43006 - RNA, 21 nt, Artificial Sequence
  Synthetic
cgccaugucuggggcgccaua

SEQ ID NO: 43007 - RNA, 22 nt, Artificial Sequence
  Synthetic
gcgccaugucuggggcgccaua

SEQ ID NO: 43008 - RNA, 23 nt, Artificial Sequence
  Synthetic
ggcgccaugucuggggcgccaua

SEQ ID NO: 43009 - RNA, 24 nt, Artificial Sequence
  Synthetic
gggcgccaugucuggggcgccaua

SEQ ID NO: 43010 - RNA, 18 nt, Artificial Sequence
  Synthetic
cccgugacacuauauaua

SEQ ID NO: 43011 - RNA, 19 nt, Artificial Sequence
  Synthetic
ccccgugacacuauauaua

SEQ ID NO: 43012 - RNA, 20 nt, Artificial Sequence
  Synthetic
accccgugacacuauauaua

SEQ ID NO: 43013 - RNA, 21 nt, Artificial Sequence
  Synthetic
aaccccgugacacuauauaua

SEQ ID NO: 43014 - RNA, 22 nt, Artificial Sequence
  Synthetic
gaaccccgugacacuauauaua

SEQ ID NO: 43015 - RNA, 23 nt, Artificial Sequence
  Synthetic
ggaaccccgugacacuauauaua

SEQ ID NO: 43016 - RNA, 24 nt, Artificial Sequence
  Synthetic
uggaaccccgugacacuauauaua

SEQ ID NO: 43017 - RNA, 18 nt, Artificial Sequence
  Synthetic
ccccugacccuauauaua

SEQ ID NO: 43018 - RNA, 19 nt, Artificial Sequence
  Synthetic
cccccugacccuauauaua

SEQ ID NO: 43019 - RNA, 20 nt, Artificial Sequence
  Synthetic
acccccugacccuauauaua

SEQ ID NO: 43020 - RNA, 21 nt, Artificial Sequence
  Synthetic
aacccccugacccuauauaua

SEQ ID NO: 43021 - RNA, 22 nt, Artificial Sequence
  Synthetic
gaacccccugacccuauauaua

SEQ ID NO: 43022 - RNA, 23 nt, Artificial Sequence
  Synthetic
ggaacccccugacccuauauaua

SEQ ID NO: 43023 - RNA, 24 nt, Artificial Sequence
  Synthetic
cggaacccccugacccuauauaua

SEQ ID NO: 43024 - RNA, 18 nt, Artificial Sequence
  Synthetic
ggcgggaggggcaugcua

SEQ ID NO: 43025 - RNA, 19 nt, Artificial Sequence
  Synthetic
cggcgggaggggcaugcua

SEQ ID NO: 43026 - RNA, 20 nt, Artificial Sequence
  Synthetic
ucggcgggaggggcaugcua

SEQ ID NO: 43027 - RNA, 21 nt, Artificial Sequence
  Synthetic
gucggcgggaggggcaugcua

SEQ ID NO: 43028 - RNA, 22 nt, Artificial Sequence
  Synthetic
cgucggcgggaggggcaugcua

SEQ ID NO: 43029 - RNA, 23 nt, Artificial Sequence
  Synthetic
gcgucggcgggaggggcaugcua

SEQ ID NO: 43030 - RNA, 24 nt, Artificial Sequence
  Synthetic
ugcgucggcgggaggggcaugcua

SEQ ID NO: 43031 - RNA, 18 nt, Artificial Sequence
  Synthetic
caauucccgcggcccuua

SEQ ID NO: 43032 - RNA, 19 nt, Artificial Sequence
  Synthetic
gcaauucccgcggcccuua

SEQ ID NO: 43033 - RNA, 20 nt, Artificial Sequence
  Synthetic
ggcaauucccgcggcccuua

SEQ ID NO: 43034 - RNA, 21 nt, Artificial Sequence
  Synthetic
cggcaauucccgcggcccuua

SEQ ID NO: 43035 - RNA, 22 nt, Artificial Sequence
  Synthetic
ccggcaauucccgcggcccuua

SEQ ID NO: 43036 - RNA, 23 nt, Artificial Sequence
  Synthetic
uccggcaauucccgcggcccuua

SEQ ID NO: 43037 - RNA, 24 nt, Artificial Sequence
  Synthetic
uuccggcaauucccgcggcccuua

SEQ ID NO: 43038 - RNA, 18 nt, Artificial Sequence
  Synthetic
uguuggggcgccauguua

SEQ ID NO: 43039 - RNA, 19 nt, Artificial Sequence
  Synthetic
auguuggggcgccauguua

SEQ ID NO: 43040 - RNA, 20 nt, Artificial Sequence
  Synthetic
cauguuggggcgccauguua

SEQ ID NO: 43041 - RNA, 21 nt, Artificial Sequence
  Synthetic
ccauguuggggcgccauguua

SEQ ID NO: 43042 - RNA, 22 nt, Artificial Sequence
  Synthetic
gccauguuggggcgccauguua

SEQ ID NO: 43043 - RNA, 23 nt, Artificial Sequence
  Synthetic
cgccauguuggggcgccauguua

SEQ ID NO: 43044 - RNA, 24 nt, Artificial Sequence
  Synthetic
gcgccauguuggggcgccauguua

SEQ ID NO: 43045 - RNA, 18 nt, Artificial Sequence
  Synthetic
ggacccccacucauacac

SEQ ID NO: 43046 - RNA, 19 nt, Artificial Sequence
  Synthetic
gggacccccacucauacac

SEQ ID NO: 43047 - RNA, 20 nt, Artificial Sequence
  Synthetic
ggggacccccacucauacac

SEQ ID NO: 43048 - RNA, 21 nt, Artificial Sequence
  Synthetic
gggggacccccacucauacac

SEQ ID NO: 43049 - RNA, 22 nt, Artificial Sequence
  Synthetic
ugggggacccccacucauacac

SEQ ID NO: 43050 - RNA, 23 nt, Artificial Sequence
  Synthetic
uugggggacccccacucauacac

SEQ ID NO: 43051 - RNA, 24 nt, Artificial Sequence
  Synthetic
guugggggacccccacucauacac

SEQ ID NO: 43052 - RNA, 18 nt, Artificial Sequence
  Synthetic
gacccccgacccuuacac

SEQ ID NO: 43053 - RNA, 19 nt, Artificial Sequence
  Synthetic
ggacccccgacccuuacac

SEQ ID NO: 43054 - RNA, 20 nt, Artificial Sequence
  Synthetic
gggacccccgacccuuacac

SEQ ID NO: 43055 - RNA, 21 nt, Artificial Sequence
  Synthetic
ggggacccccgacccuuacac

SEQ ID NO: 43056 - RNA, 22 nt, Artificial Sequence
  Synthetic
gggggacccccgacccuuacac

SEQ ID NO: 43057 - RNA, 23 nt, Artificial Sequence
  Synthetic
ugggggacccccgacccuuacac

SEQ ID NO: 43058 - RNA, 24 nt, Artificial Sequence
  Synthetic
uugggggacccccgacccuuacac

SEQ ID NO: 43059 - RNA, 18 nt, Artificial Sequence
  Synthetic
gcauuugcaccucggcac

SEQ ID NO: 43060 - RNA, 19 nt, Artificial Sequence
  Synthetic
cgcauuugcaccucggcac

SEQ ID NO: 43061 - RNA, 20 nt, Artificial Sequence
  Synthetic
ucgcauuugcaccucggcac

SEQ ID NO: 43062 - RNA, 18 nt, Artificial Sequence
  Synthetic
cgcagcagccaggcagac

SEQ ID NO: 43063 - RNA, 19 nt, Artificial Sequence
  Synthetic
acgcagcagccaggcagac

SEQ ID NO: 43064 - RNA, 20 nt, Artificial Sequence
  Synthetic
gacgcagcagccaggcagac

SEQ ID NO: 43065 - RNA, 21 nt, Artificial Sequence
  Synthetic
agacgcagcagccaggcagac

SEQ ID NO: 43066 - RNA, 22 nt, Artificial Sequence
  Synthetic
gagacgcagcagccaggcagac

SEQ ID NO: 43067 - RNA, 23 nt, Artificial Sequence
  Synthetic
cgagacgcagcagccaggcagac

SEQ ID NO: 43068 - RNA, 24 nt, Artificial Sequence
  Synthetic
gcgagacgcagcagccaggcagac

SEQ ID NO: 43069 - RNA, 18 nt, Artificial Sequence
  Synthetic
cacuauauauacagggac

SEQ ID NO: 43070 - RNA, 19 nt, Artificial Sequence
  Synthetic
acacuauauauacagggac

SEQ ID NO: 43071 - RNA, 20 nt, Artificial Sequence
  Synthetic
gacacuauauauacagggac

SEQ ID NO: 43072 - RNA, 21 nt, Artificial Sequence
  Synthetic
ugacacuauauauacagggac

SEQ ID NO: 43073 - RNA, 22 nt, Artificial Sequence
  Synthetic
gugacacuauauauacagggac

SEQ ID NO: 43074 - RNA, 23 nt, Artificial Sequence
  Synthetic
cgugacacuauauauacagggac

SEQ ID NO: 43075 - RNA, 24 nt, Artificial Sequence
  Synthetic
ccgugacacuauauauacagggac

SEQ ID NO: 43076 - RNA, 18 nt, Artificial Sequence
  Synthetic
ggggacccccacucauac

SEQ ID NO: 43077 - RNA, 19 nt, Artificial Sequence
  Synthetic
gggggacccccacucauac

SEQ ID NO: 43078 - RNA, 20 nt, Artificial Sequence
  Synthetic
ugggggacccccacucauac

SEQ ID NO: 43079 - RNA, 21 nt, Artificial Sequence
  Synthetic
uugggggacccccacucauac

SEQ ID NO: 43080 - RNA, 22 nt, Artificial Sequence
  Synthetic
guugggggacccccacucauac

SEQ ID NO: 43081 - RNA, 23 nt, Artificial Sequence
  Synthetic
uguugggggacccccacucauac

SEQ ID NO: 43082 - RNA, 24 nt, Artificial Sequence
  Synthetic
auguugggggacccccacucauac

SEQ ID NO: 43083 - RNA, 18 nt, Artificial Sequence
  Synthetic
ccgugacacuauauauac

SEQ ID NO: 43084 - RNA, 19 nt, Artificial Sequence
  Synthetic
cccgugacacuauauauac

SEQ ID NO: 43085 - RNA, 20 nt, Artificial Sequence
  Synthetic
ccccgugacacuauauauac

SEQ ID NO: 43086 - RNA, 21 nt, Artificial Sequence
  Synthetic
accccgugacacuauauauac

SEQ ID NO: 43087 - RNA, 22 nt, Artificial Sequence
  Synthetic
aaccccgugacacuauauauac

SEQ ID NO: 43088 - RNA, 23 nt, Artificial Sequence
  Synthetic
gaaccccgugacacuauauauac

SEQ ID NO: 43089 - RNA, 24 nt, Artificial Sequence
  Synthetic
ggaaccccgugacacuauauauac

SEQ ID NO: 43090 - RNA, 18 nt, Artificial Sequence
  Synthetic
cccugacccuauauauac

SEQ ID NO: 43091 - RNA, 19 nt, Artificial Sequence
  Synthetic
ccccugacccuauauauac

SEQ ID NO: 43092 - RNA, 20 nt, Artificial Sequence
  Synthetic
cccccugacccuauauauac

SEQ ID NO: 43093 - RNA, 21 nt, Artificial Sequence
  Synthetic
acccccugacccuauauauac

SEQ ID NO: 43094 - RNA, 22 nt, Artificial Sequence
  Synthetic
aacccccugacccuauauauac

SEQ ID NO: 43095 - RNA, 23 nt, Artificial Sequence
  Synthetic
gaacccccugacccuauauauac

SEQ ID NO: 43096 - RNA, 24 nt, Artificial Sequence
  Synthetic
ggaacccccugacccuauauauac

SEQ ID NO: 43097 - RNA, 18 nt, Artificial Sequence
  Synthetic
acuauauauacagggacc

SEQ ID NO: 43098 - RNA, 19 nt, Artificial Sequence
  Synthetic
cacuauauauacagggacc

SEQ ID NO: 43099 - RNA, 20 nt, Artificial Sequence
  Synthetic
acacuauauauacagggacc

SEQ ID NO: 43100 - RNA, 21 nt, Artificial Sequence
  Synthetic
gacacuauauauacagggacc

SEQ ID NO: 43101 - RNA, 22 nt, Artificial Sequence
  Synthetic
ugacacuauauauacagggacc

SEQ ID NO: 43102 - RNA, 23 nt, Artificial Sequence
  Synthetic
gugacacuauauauacagggacc

SEQ ID NO: 43103 - RNA, 24 nt, Artificial Sequence
  Synthetic
cgugacacuauauauacagggacc

SEQ ID NO: 43104 - RNA, 18 nt, Artificial Sequence
  Synthetic
cgccuacguugcgacccc

SEQ ID NO: 43105 - RNA, 19 nt, Artificial Sequence
  Synthetic
ccgccuacguugcgacccc

SEQ ID NO: 43106 - RNA, 20 nt, Artificial Sequence
  Synthetic
cccgccuacguugcgacccc

SEQ ID NO: 43107 - RNA, 21 nt, Artificial Sequence
  Synthetic
ccccgccuacguugcgacccc

SEQ ID NO: 43108 - RNA, 22 nt, Artificial Sequence
  Synthetic
gccccgccuacguugcgacccc

SEQ ID NO: 43109 - RNA, 23 nt, Artificial Sequence
  Synthetic
agccccgccuacguugcgacccc

SEQ ID NO: 43110 - RNA, 24 nt, Artificial Sequence
  Synthetic
aagccccgccuacguugcgacccc

SEQ ID NO: 43111 - RNA, 18 nt, Artificial Sequence
  Synthetic
cagccgcauacgaccccc

SEQ ID NO: 43112 - RNA, 19 nt, Artificial Sequence
  Synthetic
ccagccgcauacgaccccc

SEQ ID NO: 43113 - RNA, 20 nt, Artificial Sequence
  Synthetic
uccagccgcauacgaccccc

SEQ ID NO: 43114 - RNA, 21 nt, Artificial Sequence
  Synthetic
cuccagccgcauacgaccccc

SEQ ID NO: 43115 - RNA, 22 nt, Artificial Sequence
  Synthetic
ccuccagccgcauacgaccccc

SEQ ID NO: 43116 - RNA, 23 nt, Artificial Sequence
  Synthetic
cccuccagccgcauacgaccccc

SEQ ID NO: 43117 - RNA, 24 nt, Artificial Sequence
  Synthetic
acccuccagccgcauacgaccccc

SEQ ID NO: 43118 - RNA, 18 nt, Artificial Sequence
  Synthetic
gccuacguugcgaccccc

SEQ ID NO: 43119 - RNA, 19 nt, Artificial Sequence
  Synthetic
cgccuacguugcgaccccc

SEQ ID NO: 43120 - RNA, 20 nt, Artificial Sequence
  Synthetic
ccgccuacguugcgaccccc

SEQ ID NO: 43121 - RNA, 21 nt, Artificial Sequence
  Synthetic
cccgccuacguugcgaccccc

SEQ ID NO: 43122 - RNA, 22 nt, Artificial Sequence
  Synthetic
ccccgccuacguugcgaccccc

SEQ ID NO: 43123 - RNA, 23 nt, Artificial Sequence
  Synthetic
gccccgccuacguugcgaccccc

SEQ ID NO: 43124 - RNA, 24 nt, Artificial Sequence
  Synthetic
agccccgccuacguugcgaccccc

SEQ ID NO: 43125 - RNA, 18 nt, Artificial Sequence
  Synthetic
cggugggccugccucccc

SEQ ID NO: 43126 - RNA, 19 nt, Artificial Sequence
  Synthetic
gcggugggccugccucccc

SEQ ID NO: 43127 - RNA, 20 nt, Artificial Sequence
  Synthetic
cgcggugggccugccucccc

SEQ ID NO: 43128 - RNA, 21 nt, Artificial Sequence
  Synthetic
ccgcggugggccugccucccc

SEQ ID NO: 43129 - RNA, 22 nt, Artificial Sequence
  Synthetic
cccgcggugggccugccucccc

SEQ ID NO: 43130 - RNA, 23 nt, Artificial Sequence
  Synthetic
ccccgcggugggccugccucccc

SEQ ID NO: 43131 - RNA, 24 nt, Artificial Sequence
  Synthetic
gccccgcggugggccugccucccc

SEQ ID NO: 43132 - RNA, 18 nt, Artificial Sequence
  Synthetic
ggcgccggguuggucccc

SEQ ID NO: 43133 - RNA, 19 nt, Artificial Sequence
  Synthetic
gggcgccggguuggucccc

SEQ ID NO: 43134 - RNA, 20 nt, Artificial Sequence
  Synthetic
ggggcgccggguuggucccc

SEQ ID NO: 43135 - RNA, 21 nt, Artificial Sequence
  Synthetic
gggggcgccggguuggucccc

SEQ ID NO: 43136 - RNA, 22 nt, Artificial Sequence
  Synthetic
ugggggcgccggguuggucccc

SEQ ID NO: 43137 - RNA, 23 nt, Artificial Sequence
  Synthetic
uugggggcgccggguuggucccc

SEQ ID NO: 43138 - RNA, 24 nt, Artificial Sequence
  Synthetic
uuugggggcgccggguuggucccc

SEQ ID NO: 43139 - RNA, 18 nt, Artificial Sequence
  Synthetic
cgggaaggcgggaagccc

SEQ ID NO: 43140 - RNA, 19 nt, Artificial Sequence
  Synthetic
ucgggaaggcgggaagccc

SEQ ID NO: 43141 - RNA, 20 nt, Artificial Sequence
  Synthetic
uucgggaaggcgggaagccc

SEQ ID NO: 43142 - RNA, 21 nt, Artificial Sequence
  Synthetic
cuucgggaaggcgggaagccc

SEQ ID NO: 43143 - RNA, 22 nt, Artificial Sequence
  Synthetic
ucuucgggaaggcgggaagccc

SEQ ID NO: 43144 - RNA, 23 nt, Artificial Sequence
  Synthetic
uucuucgggaaggcgggaagccc

SEQ ID NO: 43145 - RNA, 24 nt, Artificial Sequence
  Synthetic
uuucuucgggaaggcgggaagccc

SEQ ID NO: 43146 - RNA, 18 nt, Artificial Sequence
  Synthetic
ccccauggagccccgccc

SEQ ID NO: 43147 - RNA, 19 nt, Artificial Sequence
  Synthetic
cccccauggagccccgccc

SEQ ID NO: 43148 - RNA, 20 nt, Artificial Sequence
  Synthetic
acccccauggagccccgccc

SEQ ID NO: 43149 - RNA, 21 nt, Artificial Sequence
  Synthetic
gacccccauggagccccgccc

SEQ ID NO: 43150 - RNA, 22 nt, Artificial Sequence
  Synthetic
cgacccccauggagccccgccc

SEQ ID NO: 43151 - RNA, 23 nt, Artificial Sequence
  Synthetic
acgacccccauggagccccgccc

SEQ ID NO: 43152 - RNA, 24 nt, Artificial Sequence
  Synthetic
uacgacccccauggagccccgccc

SEQ ID NO: 43153 - RNA, 18 nt, Artificial Sequence
  Synthetic
ccgcgcguaaccacuccc

SEQ ID NO: 43154 - RNA, 19 nt, Artificial Sequence
  Synthetic
gccgcgcguaaccacuccc

SEQ ID NO: 43155 - RNA, 20 nt, Artificial Sequence
  Synthetic
cgccgcgcguaaccacuccc

SEQ ID NO: 43156 - RNA, 21 nt, Artificial Sequence
  Synthetic
gcgccgcgcguaaccacuccc

SEQ ID NO: 43157 - RNA, 22 nt, Artificial Sequence
  Synthetic
cgcgccgcgcguaaccacuccc

SEQ ID NO: 43158 - RNA, 23 nt, Artificial Sequence
  Synthetic
ccgcgccgcgcguaaccacuccc

SEQ ID NO: 43159 - RNA, 24 nt, Artificial Sequence
  Synthetic
cccgcgccgcgcguaaccacuccc

SEQ ID NO: 43160 - RNA, 18 nt, Artificial Sequence
  Synthetic
gcggugggccugccuccc

SEQ ID NO: 43161 - RNA, 19 nt, Artificial Sequence
  Synthetic
cgcggugggccugccuccc

SEQ ID NO: 43162 - RNA, 20 nt, Artificial Sequence
  Synthetic
ccgcggugggccugccuccc

SEQ ID NO: 43163 - RNA, 21 nt, Artificial Sequence
  Synthetic
cccgcggugggccugccuccc

SEQ ID NO: 43164 - RNA, 22 nt, Artificial Sequence
  Synthetic
ccccgcggugggccugccuccc

SEQ ID NO: 43165 - RNA, 23 nt, Artificial Sequence
  Synthetic
gccccgcggugggccugccuccc

SEQ ID NO: 43166 - RNA, 24 nt, Artificial Sequence
  Synthetic
cgccccgcggugggccugccuccc

SEQ ID NO: 43167 - RNA, 18 nt, Artificial Sequence
  Synthetic
ugaacccgcauugguccc

SEQ ID NO: 43168 - RNA, 19 nt, Artificial Sequence
  Synthetic
augaacccgcauugguccc

SEQ ID NO: 43169 - RNA, 20 nt, Artificial Sequence
  Synthetic
aaugaacccgcauugguccc

SEQ ID NO: 43170 - RNA, 21 nt, Artificial Sequence
  Synthetic
caaugaacccgcauugguccc

SEQ ID NO: 43171 - RNA, 22 nt, Artificial Sequence
  Synthetic
ucaaugaacccgcauugguccc

SEQ ID NO: 43172 - RNA, 23 nt, Artificial Sequence
  Synthetic
cucaaugaacccgcauugguccc

SEQ ID NO: 43173 - RNA, 24 nt, Artificial Sequence
  Synthetic
gcucaaugaacccgcauugguccc

SEQ ID NO: 43174 - RNA, 18 nt, Artificial Sequence
  Synthetic
gggcgccggguugguccc

SEQ ID NO: 43175 - RNA, 19 nt, Artificial Sequence
  Synthetic
ggggcgccggguugguccc

SEQ ID NO: 43176 - RNA, 20 nt, Artificial Sequence
  Synthetic
gggggcgccggguugguccc

SEQ ID NO: 43177 - RNA, 21 nt, Artificial Sequence
  Synthetic
ugggggcgccggguugguccc

SEQ ID NO: 43178 - RNA, 22 nt, Artificial Sequence
  Synthetic
uugggggcgccggguugguccc

SEQ ID NO: 43179 - RNA, 23 nt, Artificial Sequence
  Synthetic
uuugggggcgccggguugguccc

SEQ ID NO: 43180 - RNA, 24 nt, Artificial Sequence
  Synthetic
cuuugggggcgccggguugguccc

SEQ ID NO: 43181 - RNA, 18 nt, Artificial Sequence
  Synthetic
ucgggaaggcgggaagcc

SEQ ID NO: 43182 - RNA, 19 nt, Artificial Sequence
  Synthetic
uucgggaaggcgggaagcc

SEQ ID NO: 43183 - RNA, 20 nt, Artificial Sequence
  Synthetic
cuucgggaaggcgggaagcc

SEQ ID NO: 43184 - RNA, 21 nt, Artificial Sequence
  Synthetic
ucuucgggaaggcgggaagcc

SEQ ID NO: 43185 - RNA, 22 nt, Artificial Sequence
  Synthetic
uucuucgggaaggcgggaagcc

SEQ ID NO: 43186 - RNA, 23 nt, Artificial Sequence
  Synthetic
uuucuucgggaaggcgggaagcc

SEQ ID NO: 43187 - RNA, 24 nt, Artificial Sequence
  Synthetic
guuucuucgggaaggcgggaagcc

SEQ ID NO: 43188 - RNA, 18 nt, Artificial Sequence
  Synthetic
cccccauggagccccgcc

SEQ ID NO: 43189 - RNA, 19 nt, Artificial Sequence
  Synthetic
acccccauggagccccgcc

SEQ ID NO: 43190 - RNA, 20 nt, Artificial Sequence
  Synthetic
gacccccauggagccccgcc

SEQ ID NO: 43191 - RNA, 21 nt, Artificial Sequence
  Synthetic
cgacccccauggagccccgcc

SEQ ID NO: 43192 - RNA, 22 nt, Artificial Sequence
  Synthetic
acgacccccauggagccccgcc

SEQ ID NO: 43193 - RNA, 23 nt, Artificial Sequence
  Synthetic
uacgacccccauggagccccgcc

SEQ ID NO: 43194 - RNA, 24 nt, Artificial Sequence
  Synthetic
auacgacccccauggagccccgcc

SEQ ID NO: 43195 - RNA, 18 nt, Artificial Sequence
  Synthetic
ggggcgccggguuggucc

SEQ ID NO: 43196 - RNA, 19 nt, Artificial Sequence
  Synthetic
gggggcgccggguuggucc

SEQ ID NO: 43197 - RNA, 20 nt, Artificial Sequence
  Synthetic
ugggggcgccggguuggucc

SEQ ID NO: 43198 - RNA, 21 nt, Artificial Sequence
  Synthetic
uugggggcgccggguuggucc

SEQ ID NO: 43199 - RNA, 22 nt, Artificial Sequence
  Synthetic
uuugggggcgccggguuggucc

SEQ ID NO: 43200 - RNA, 23 nt, Artificial Sequence
  Synthetic
cuuugggggcgccggguuggucc

SEQ ID NO: 43201 - RNA, 24 nt, Artificial Sequence
  Synthetic
ucuuugggggcgccggguuggucc

SEQ ID NO: 43202 - RNA, 18 nt, Artificial Sequence
  Synthetic
cugagggccgcccccagc

SEQ ID NO: 43203 - RNA, 19 nt, Artificial Sequence
  Synthetic
ccugagggccgcccccagc

SEQ ID NO: 43204 - RNA, 20 nt, Artificial Sequence
  Synthetic
gccugagggccgcccccagc

SEQ ID NO: 43205 - RNA, 21 nt, Artificial Sequence
  Synthetic
ggccugagggccgcccccagc

SEQ ID NO: 43206 - RNA, 22 nt, Artificial Sequence
  Synthetic
cggccugagggccgcccccagc

SEQ ID NO: 43207 - RNA, 23 nt, Artificial Sequence
  Synthetic
ccggccugagggccgcccccagc

SEQ ID NO: 43208 - RNA, 24 nt, Artificial Sequence
  Synthetic
gccggccugagggccgcccccagc

SEQ ID NO: 43209 - RNA, 18 nt, Artificial Sequence
  Synthetic
uuuggggaggggaaaggc

SEQ ID NO: 43210 - RNA, 19 nt, Artificial Sequence
  Synthetic
cuuuggggaggggaaaggc

SEQ ID NO: 43211 - RNA, 20 nt, Artificial Sequence
  Synthetic
ccuuuggggaggggaaaggc

SEQ ID NO: 43212 - RNA, 21 nt, Artificial Sequence
  Synthetic
cccuuuggggaggggaaaggc

SEQ ID NO: 43213 - RNA, 22 nt, Artificial Sequence
  Synthetic
ccccuuuggggaggggaaaggc

SEQ ID NO: 43214 - RNA, 23 nt, Artificial Sequence
  Synthetic
gccccuuuggggaggggaaaggc

SEQ ID NO: 43215 - RNA, 24 nt, Artificial Sequence
  Synthetic
cgccccuuuggggaggggaaaggc

SEQ ID NO: 43216 - RNA, 18 nt, Artificial Sequence
  Synthetic
gaguuucuucgggaaggc

SEQ ID NO: 43217 - RNA, 19 nt, Artificial Sequence
  Synthetic
ugaguuucuucgggaaggc

SEQ ID NO: 43218 - RNA, 20 nt, Artificial Sequence
  Synthetic
augaguuucuucgggaaggc

SEQ ID NO: 43219 - RNA, 21 nt, Artificial Sequence
  Synthetic
aaugaguuucuucgggaaggc

SEQ ID NO: 43220 - RNA, 22 nt, Artificial Sequence
  Synthetic
uaaugaguuucuucgggaaggc

SEQ ID NO: 43221 - RNA, 23 nt, Artificial Sequence
  Synthetic
guaaugaguuucuucgggaaggc

SEQ ID NO: 43222 - RNA, 24 nt, Artificial Sequence
  Synthetic
gguaaugaguuucuucgggaaggc

SEQ ID NO: 43223 - RNA, 18 nt, Artificial Sequence
  Synthetic
gagcgaguacccgccggc

SEQ ID NO: 43224 - RNA, 19 nt, Artificial Sequence
  Synthetic
ggagcgaguacccgccggc

SEQ ID NO: 43225 - RNA, 20 nt, Artificial Sequence
  Synthetic
cggagcgaguacccgccggc

SEQ ID NO: 43226 - RNA, 21 nt, Artificial Sequence
  Synthetic
ccggagcgaguacccgccggc

SEQ ID NO: 43227 - RNA, 22 nt, Artificial Sequence
  Synthetic
cccggagcgaguacccgccggc

SEQ ID NO: 43228 - RNA, 23 nt, Artificial Sequence
  Synthetic
ccccggagcgaguacccgccggc

SEQ ID NO: 43229 - RNA, 24 nt, Artificial Sequence
  Synthetic
gccccggagcgaguacccgccggc

SEQ ID NO: 43230 - RNA, 18 nt, Artificial Sequence
  Synthetic
agccccuguugcgucggc

SEQ ID NO: 43231 - RNA, 19 nt, Artificial Sequence
  Synthetic
aagccccuguugcgucggc

SEQ ID NO: 43232 - RNA, 20 nt, Artificial Sequence
  Synthetic
caagccccuguugcgucggc

SEQ ID NO: 43233 - RNA, 21 nt, Artificial Sequence
  Synthetic
ccaagccccuguugcgucggc

SEQ ID NO: 43234 - RNA, 22 nt, Artificial Sequence
  Synthetic
gccaagccccuguugcgucggc

SEQ ID NO: 43235 - RNA, 23 nt, Artificial Sequence
  Synthetic
ggccaagccccuguugcgucggc

SEQ ID NO: 43236 - RNA, 24 nt, Artificial Sequence
  Synthetic
aggccaagccccuguugcgucggc

SEQ ID NO: 43237 - RNA, 18 nt, Artificial Sequence
  Synthetic
ggcgccauguuagggggc

SEQ ID NO: 43238 - RNA, 19 nt, Artificial Sequence
  Synthetic
gggcgccauguuagggggc

SEQ ID NO: 43239 - RNA, 20 nt, Artificial Sequence
  Synthetic
ggggcgccauguuagggggc

SEQ ID NO: 43240 - RNA, 21 nt, Artificial Sequence
  Synthetic
uggggcgccauguuagggggc

SEQ ID NO: 43241 - RNA, 22 nt, Artificial Sequence
  Synthetic
uuggggcgccauguuagggggc

SEQ ID NO: 43242 - RNA, 23 nt, Artificial Sequence
  Synthetic
guuggggcgccauguuagggggc

SEQ ID NO: 43243 - RNA, 24 nt, Artificial Sequence
  Synthetic
uguuggggcgccauguuagggggc

SEQ ID NO: 43244 - RNA, 18 nt, Artificial Sequence
  Synthetic
ggguugggcccccaaauc

SEQ ID NO: 43245 - RNA, 19 nt, Artificial Sequence
  Synthetic
cggguugggcccccaaauc

SEQ ID NO: 43246 - RNA, 20 nt, Artificial Sequence
  Synthetic
ccggguugggcccccaaauc

SEQ ID NO: 43247 - RNA, 21 nt, Artificial Sequence
  Synthetic
accggguugggcccccaaauc

SEQ ID NO: 43248 - RNA, 22 nt, Artificial Sequence
  Synthetic
caccggguugggcccccaaauc

SEQ ID NO: 43249 - RNA, 23 nt, Artificial Sequence
  Synthetic
acaccggguugggcccccaaauc

SEQ ID NO: 43250 - RNA, 24 nt, Artificial Sequence
  Synthetic
gacaccggguugggcccccaaauc

SEQ ID NO: 43251 - RNA, 18 nt, Artificial Sequence
  Synthetic
ggggccgggcgccauguc

SEQ ID NO: 43252 - RNA, 19 nt, Artificial Sequence
  Synthetic
aggggccgggcgccauguc

SEQ ID NO: 43253 - RNA, 20 nt, Artificial Sequence
  Synthetic
gaggggccgggcgccauguc

SEQ ID NO: 43254 - RNA, 21 nt, Artificial Sequence
  Synthetic
ugaggggccgggcgccauguc

SEQ ID NO: 43255 - RNA, 22 nt, Artificial Sequence
  Synthetic
gugaggggccgggcgccauguc

SEQ ID NO: 43256 - RNA, 23 nt, Artificial Sequence
  Synthetic
ggugaggggccgggcgccauguc

SEQ ID NO: 43257 - RNA, 24 nt, Artificial Sequence
  Synthetic
aggugaggggccgggcgccauguc

SEQ ID NO: 43258 - RNA, 18 nt, Artificial Sequence
  Synthetic
augguaaugaguuucuuc

SEQ ID NO: 43259 - RNA, 19 nt, Artificial Sequence
  Synthetic
uaugguaaugaguuucuuc

SEQ ID NO: 43260 - RNA, 20 nt, Artificial Sequence
  Synthetic
guaugguaaugaguuucuuc

SEQ ID NO: 43261 - RNA, 21 nt, Artificial Sequence
  Synthetic
gguaugguaaugaguuucuuc

SEQ ID NO: 43262 - RNA, 22 nt, Artificial Sequence
  Synthetic
ggguaugguaaugaguuucuuc

SEQ ID NO: 43263 - RNA, 23 nt, Artificial Sequence
  Synthetic
cggguaugguaaugaguuucuuc

SEQ ID NO: 43264 - RNA, 24 nt, Artificial Sequence
  Synthetic
ccggguaugguaaugaguuucuuc

SEQ ID NO: 43265 - RNA, 18 nt, Artificial Sequence
  Synthetic
augaguuucuucgggaag

SEQ ID NO: 43266 - RNA, 19 nt, Artificial Sequence
  Synthetic
aaugaguuucuucgggaag

SEQ ID NO: 43267 - RNA, 20 nt, Artificial Sequence
  Synthetic
uaaugaguuucuucgggaag

SEQ ID NO: 43268 - RNA, 21 nt, Artificial Sequence
  Synthetic
guaaugaguuucuucgggaag

SEQ ID NO: 43269 - RNA, 22 nt, Artificial Sequence
  Synthetic
gguaaugaguuucuucgggaag

SEQ ID NO: 43270 - RNA, 23 nt, Artificial Sequence
  Synthetic
ugguaaugaguuucuucgggaag

SEQ ID NO: 43271 - RNA, 24 nt, Artificial Sequence
  Synthetic
augguaaugaguuucuucgggaag

SEQ ID NO: 43272 - RNA, 18 nt, Artificial Sequence
  Synthetic
ggccgcccccagcgcgag

SEQ ID NO: 43273 - RNA, 19 nt, Artificial Sequence
  Synthetic
gggccgcccccagcgcgag

SEQ ID NO: 43274 - RNA, 20 nt, Artificial Sequence
  Synthetic
agggccgcccccagcgcgag

SEQ ID NO: 43275 - RNA, 21 nt, Artificial Sequence
  Synthetic
gagggccgcccccagcgcgag

SEQ ID NO: 43276 - RNA, 22 nt, Artificial Sequence
  Synthetic
ugagggccgcccccagcgcgag

SEQ ID NO: 43277 - RNA, 23 nt, Artificial Sequence
  Synthetic
cugagggccgcccccagcgcgag

SEQ ID NO: 43278 - RNA, 24 nt, Artificial Sequence
  Synthetic
ccugagggccgcccccagcgcgag

SEQ ID NO: 43279 - RNA, 18 nt, Artificial Sequence
  Synthetic
cccacucauacacgggag

SEQ ID NO: 43280 - RNA, 19 nt, Artificial Sequence
  Synthetic
ccccacucauacacgggag

SEQ ID NO: 43281 - RNA, 20 nt, Artificial Sequence
  Synthetic
cccccacucauacacgggag

SEQ ID NO: 43282 - RNA, 21 nt, Artificial Sequence
  Synthetic
acccccacucauacacgggag

SEQ ID NO: 43283 - RNA, 22 nt, Artificial Sequence
  Synthetic
gacccccacucauacacgggag

SEQ ID NO: 43284 - RNA, 23 nt, Artificial Sequence
  Synthetic
ggacccccacucauacacgggag

SEQ ID NO: 43285 - RNA, 24 nt, Artificial Sequence
  Synthetic
gggacccccacucauacacgggag

SEQ ID NO: 43286 - RNA, 18 nt, Artificial Sequence
  Synthetic
ugccgccccuuuggggag

SEQ ID NO: 43287 - RNA, 19 nt, Artificial Sequence
  Synthetic
cugccgccccuuuggggag

SEQ ID NO: 43288 - RNA, 20 nt, Artificial Sequence
  Synthetic
acugccgccccuuuggggag

SEQ ID NO: 43289 - RNA, 21 nt, Artificial Sequence
  Synthetic
cacugccgccccuuuggggag

SEQ ID NO: 43290 - RNA, 22 nt, Artificial Sequence
  Synthetic
ucacugccgccccuuuggggag

SEQ ID NO: 43291 - RNA, 23 nt, Artificial Sequence
  Synthetic
gucacugccgccccuuuggggag

SEQ ID NO: 43292 - RNA, 24 nt, Artificial Sequence
  Synthetic
cgucacugccgccccuuuggggag

SEQ ID NO: 43293 - RNA, 18 nt, Artificial Sequence
  Synthetic
ggacggggccgccccgcg

SEQ ID NO: 43294 - RNA, 19 nt, Artificial Sequence
  Synthetic
gggacggggccgccccgcg

SEQ ID NO: 43295 - RNA, 20 nt, Artificial Sequence
  Synthetic
ggggacggggccgccccgcg

SEQ ID NO: 43296 - RNA, 21 nt, Artificial Sequence
  Synthetic
cggggacggggccgccccgcg

SEQ ID NO: 43297 - RNA, 22 nt, Artificial Sequence
  Synthetic
ccggggacggggccgccccgcg

SEQ ID NO: 43298 - RNA, 23 nt, Artificial Sequence
  Synthetic
cccggggacggggccgccccgcg

SEQ ID NO: 43299 - RNA, 24 nt, Artificial Sequence
  Synthetic
ccccggggacggggccgccccgcg

SEQ ID NO: 43300 - RNA, 18 nt, Artificial Sequence
  Synthetic
gcgccauguuagggggcg

SEQ ID NO: 43301 - RNA, 19 nt, Artificial Sequence
  Synthetic
ggcgccauguuagggggcg

SEQ ID NO: 43302 - RNA, 20 nt, Artificial Sequence
  Synthetic
gggcgccauguuagggggcg

SEQ ID NO: 43303 - RNA, 21 nt, Artificial Sequence
  Synthetic
ggggcgccauguuagggggcg

SEQ ID NO: 43304 - RNA, 22 nt, Artificial Sequence
  Synthetic
uggggcgccauguuagggggcg

SEQ ID NO: 43305 - RNA, 23 nt, Artificial Sequence
  Synthetic
uuggggcgccauguuagggggcg

SEQ ID NO: 43306 - RNA, 24 nt, Artificial Sequence
  Synthetic
guuggggcgccauguuagggggcg

SEQ ID NO: 43307 - RNA, 18 nt, Artificial Sequence
  Synthetic
caagccccuguugcgucg

SEQ ID NO: 43308 - RNA, 19 nt, Artificial Sequence
  Synthetic
ccaagccccuguugcgucg

SEQ ID NO: 43309 - RNA, 20 nt, Artificial Sequence
  Synthetic
gccaagccccuguugcgucg

SEQ ID NO: 43310 - RNA, 21 nt, Artificial Sequence
  Synthetic
ggccaagccccuguugcgucg

SEQ ID NO: 43311 - RNA, 22 nt, Artificial Sequence
  Synthetic
aggccaagccccuguugcgucg

SEQ ID NO: 43312 - RNA, 23 nt, Artificial Sequence
  Synthetic
caggccaagccccuguugcgucg

SEQ ID NO: 43313 - RNA, 24 nt, Artificial Sequence
  Synthetic
gcaggccaagccccuguugcgucg

SEQ ID NO: 43314 - RNA, 18 nt, Artificial Sequence
  Synthetic
ugaguuucuucgggaagg

SEQ ID NO: 43315 - RNA, 19 nt, Artificial Sequence
  Synthetic
augaguuucuucgggaagg

SEQ ID NO: 43316 - RNA, 20 nt, Artificial Sequence
  Synthetic
aaugaguuucuucgggaagg

SEQ ID NO: 43317 - RNA, 21 nt, Artificial Sequence
  Synthetic
uaaugaguuucuucgggaagg

SEQ ID NO: 43318 - RNA, 22 nt, Artificial Sequence
  Synthetic
guaaugaguuucuucgggaagg

SEQ ID NO: 43319 - RNA, 23 nt, Artificial Sequence
  Synthetic
gguaaugaguuucuucgggaagg

SEQ ID NO: 43320 - RNA, 24 nt, Artificial Sequence
  Synthetic
ugguaaugaguuucuucgggaagg

SEQ ID NO: 43321 - RNA, 18 nt, Artificial Sequence
  Synthetic
ccccuguugcgucggcgg

SEQ ID NO: 43322 - RNA, 19 nt, Artificial Sequence
  Synthetic
gccccuguugcgucggcgg

SEQ ID NO: 43323 - RNA, 20 nt, Artificial Sequence
  Synthetic
agccccuguugcgucggcgg

SEQ ID NO: 43324 - RNA, 21 nt, Artificial Sequence
  Synthetic
aagccccuguugcgucggcgg

SEQ ID NO: 43325 - RNA, 22 nt, Artificial Sequence
  Synthetic
caagccccuguugcgucggcgg

SEQ ID NO: 43326 - RNA, 23 nt, Artificial Sequence
  Synthetic
ccaagccccuguugcgucggcgg

SEQ ID NO: 43327 - RNA, 24 nt, Artificial Sequence
  Synthetic
gccaagccccuguugcgucggcgg

SEQ ID NO: 43328 - RNA, 18 nt, Artificial Sequence
  Synthetic
aagccccuguugcgucgg

SEQ ID NO: 43329 - RNA, 19 nt, Artificial Sequence
  Synthetic
caagccccuguugcgucgg

SEQ ID NO: 43330 - RNA, 20 nt, Artificial Sequence
  Synthetic
ccaagccccuguugcgucgg

SEQ ID NO: 43331 - RNA, 21 nt, Artificial Sequence
  Synthetic
gccaagccccuguugcgucgg

SEQ ID NO: 43332 - RNA, 22 nt, Artificial Sequence
  Synthetic
ggccaagccccuguugcgucgg

SEQ ID NO: 43333 - RNA, 23 nt, Artificial Sequence
  Synthetic
aggccaagccccuguugcgucgg

SEQ ID NO: 43334 - RNA, 24 nt, Artificial Sequence
  Synthetic
caggccaagccccuguugcgucgg

SEQ ID NO: 43335 - RNA, 18 nt, Artificial Sequence
  Synthetic
ucuuugggggacaccggg

SEQ ID NO: 43336 - RNA, 19 nt, Artificial Sequence
  Synthetic
uucuuugggggacaccggg

SEQ ID NO: 43337 - RNA, 20 nt, Artificial Sequence
  Synthetic
guucuuugggggacaccggg

SEQ ID NO: 43338 - RNA, 21 nt, Artificial Sequence
  Synthetic
gguucuuugggggacaccggg

SEQ ID NO: 43339 - RNA, 22 nt, Artificial Sequence
  Synthetic
ggguucuuugggggacaccggg

SEQ ID NO: 43340 - RNA, 23 nt, Artificial Sequence
  Synthetic
gggguucuuugggggacaccggg

SEQ ID NO: 43341 - RNA, 24 nt, Artificial Sequence
  Synthetic
ugggguucuuugggggacaccggg

SEQ ID NO: 43342 - RNA, 18 nt, Artificial Sequence
  Synthetic
cccuguugcgucggcggg

SEQ ID NO: 43343 - RNA, 19 nt, Artificial Sequence
  Synthetic
ccccuguugcgucggcggg

SEQ ID NO: 43344 - RNA, 20 nt, Artificial Sequence
  Synthetic
gccccuguugcgucggcggg

SEQ ID NO: 43345 - RNA, 21 nt, Artificial Sequence
  Synthetic
agccccuguugcgucggcggg

SEQ ID NO: 43346 - RNA, 22 nt, Artificial Sequence
  Synthetic
aagccccuguugcgucggcggg

SEQ ID NO: 43347 - RNA, 23 nt, Artificial Sequence
  Synthetic
caagccccuguugcgucggcggg

SEQ ID NO: 43348 - RNA, 24 nt, Artificial Sequence
  Synthetic
ccaagccccuguugcgucggcggg

SEQ ID NO: 43349 - RNA, 18 nt, Artificial Sequence
  Synthetic
ccagcgcgaggugagggg

SEQ ID NO: 43350 - RNA, 19 nt, Artificial Sequence
  Synthetic
cccagcgcgaggugagggg

SEQ ID NO: 43351 - RNA, 20 nt, Artificial Sequence
  Synthetic
ccccagcgcgaggugagggg

SEQ ID NO: 43352 - RNA, 21 nt, Artificial Sequence
  Synthetic
cccccagcgcgaggugagggg

SEQ ID NO: 43353 - RNA, 22 nt, Artificial Sequence
  Synthetic
gcccccagcgcgaggugagggg

SEQ ID NO: 43354 - RNA, 23 nt, Artificial Sequence
  Synthetic
cgcccccagcgcgaggugagggg

SEQ ID NO: 43355 - RNA, 24 nt, Artificial Sequence
  Synthetic
ccgcccccagcgcgaggugagggg

SEQ ID NO: 43356 - RNA, 18 nt, Artificial Sequence
  Synthetic
ccggguugguccccgggg

SEQ ID NO: 43357 - RNA, 19 nt, Artificial Sequence
  Synthetic
gccggguugguccccgggg

SEQ ID NO: 43358 - RNA, 20 nt, Artificial Sequence
  Synthetic
cgccggguugguccccgggg

SEQ ID NO: 43359 - RNA, 21 nt, Artificial Sequence
  Synthetic
gcgccggguugguccccgggg

SEQ ID NO: 43360 - RNA, 22 nt, Artificial Sequence
  Synthetic
ggcgccggguugguccccgggg

SEQ ID NO: 43361 - RNA, 23 nt, Artificial Sequence
  Synthetic
gggcgccggguugguccccgggg

SEQ ID NO: 43362 - RNA, 24 nt, Artificial Sequence
  Synthetic
ggggcgccggguugguccccgggg

SEQ ID NO: 43363 - RNA, 18 nt, Artificial Sequence
  Synthetic
gggcccccaaaucggggg

SEQ ID NO: 43364 - RNA, 19 nt, Artificial Sequence
  Synthetic
ugggcccccaaaucggggg

SEQ ID NO: 43365 - RNA, 20 nt, Artificial Sequence
  Synthetic
uugggcccccaaaucggggg

SEQ ID NO: 43366 - RNA, 21 nt, Artificial Sequence
  Synthetic
guugggcccccaaaucggggg

SEQ ID NO: 43367 - RNA, 22 nt, Artificial Sequence
  Synthetic
gguugggcccccaaaucggggg

SEQ ID NO: 43368 - RNA, 23 nt, Artificial Sequence
  Synthetic
ggguugggcccccaaaucggggg

SEQ ID NO: 43369 - RNA, 24 nt, Artificial Sequence
  Synthetic
cggguugggcccccaaaucggggg

SEQ ID NO: 43370 - RNA, 18 nt, Artificial Sequence
  Synthetic
acugccgccccuuugggg

SEQ ID NO: 43371 - RNA, 19 nt, Artificial Sequence
  Synthetic
cacugccgccccuuugggg

SEQ ID NO: 43372 - RNA, 20 nt, Artificial Sequence
  Synthetic
ucacugccgccccuuugggg

SEQ ID NO: 43373 - RNA, 21 nt, Artificial Sequence
  Synthetic
gucacugccgccccuuugggg

SEQ ID NO: 43374 - RNA, 22 nt, Artificial Sequence
  Synthetic
cgucacugccgccccuuugggg

SEQ ID NO: 43375 - RNA, 23 nt, Artificial Sequence
  Synthetic
ucgucacugccgccccuuugggg

SEQ ID NO: 43376 - RNA, 24 nt, Artificial Sequence
  Synthetic
aucgucacugccgccccuuugggg

SEQ ID NO: 43377 - RNA, 18 nt, Artificial Sequence
  Synthetic
cacugccgccccuuuggg

SEQ ID NO: 43378 - RNA, 19 nt, Artificial Sequence
  Synthetic
ucacugccgccccuuuggg

SEQ ID NO: 43379 - RNA, 20 nt, Artificial Sequence
  Synthetic
gucacugccgccccuuuggg

SEQ ID NO: 43380 - RNA, 21 nt, Artificial Sequence
  Synthetic
cgucacugccgccccuuuggg

SEQ ID NO: 43381 - RNA, 22 nt, Artificial Sequence
  Synthetic
ucgucacugccgccccuuuggg

SEQ ID NO: 43382 - RNA, 23 nt, Artificial Sequence
  Synthetic
aucgucacugccgccccuuuggg

SEQ ID NO: 43383 - RNA, 24 nt, Artificial Sequence
  Synthetic
aaucgucacugccgccccuuuggg

SEQ ID NO: 43384 - RNA, 18 nt, Artificial Sequence
  Synthetic
ugcuaauugcuuuuuugg

SEQ ID NO: 43385 - RNA, 19 nt, Artificial Sequence
  Synthetic
augcuaauugcuuuuuugg

SEQ ID NO: 43386 - RNA, 20 nt, Artificial Sequence
  Synthetic
uaugcuaauugcuuuuuugg

SEQ ID NO: 43387 - RNA, 21 nt, Artificial Sequence
  Synthetic
uuaugcuaauugcuuuuuugg

SEQ ID NO: 43388 - RNA, 22 nt, Artificial Sequence
  Synthetic
guuaugcuaauugcuuuuuugg

SEQ ID NO: 43389 - RNA, 23 nt, Artificial Sequence
  Synthetic
gguuaugcuaauugcuuuuuugg

SEQ ID NO: 43390 - RNA, 24 nt, Artificial Sequence
  Synthetic
ggguuaugcuaauugcuuuuuugg

SEQ ID NO: 43391 - RNA, 18 nt, Artificial Sequence
  Synthetic
cuggaaccggccgccaug

SEQ ID NO: 43392 - RNA, 19 nt, Artificial Sequence
  Synthetic
acuggaaccggccgccaug

SEQ ID NO: 43393 - RNA, 20 nt, Artificial Sequence
  Synthetic
cacuggaaccggccgccaug

SEQ ID NO: 43394 - RNA, 21 nt, Artificial Sequence
  Synthetic
acacuggaaccggccgccaug

SEQ ID NO: 43395 - RNA, 22 nt, Artificial Sequence
  Synthetic
uacacuggaaccggccgccaug

SEQ ID NO: 43396 - RNA, 23 nt, Artificial Sequence
  Synthetic
uuacacuggaaccggccgccaug

SEQ ID NO: 43397 - RNA, 24 nt, Artificial Sequence
  Synthetic
cuuacacuggaaccggccgccaug

SEQ ID NO: 43398 - RNA, 18 nt, Artificial Sequence
  Synthetic
cgggagccgggcgccaug

SEQ ID NO: 43399 - RNA, 19 nt, Artificial Sequence
  Synthetic
acgggagccgggcgccaug

SEQ ID NO: 43400 - RNA, 20 nt, Artificial Sequence
  Synthetic
cacgggagccgggcgccaug

SEQ ID NO: 43401 - RNA, 21 nt, Artificial Sequence
  Synthetic
acacgggagccgggcgccaug

SEQ ID NO: 43402 - RNA, 22 nt, Artificial Sequence
  Synthetic
uacacgggagccgggcgccaug

SEQ ID NO: 43403 - RNA, 23 nt, Artificial Sequence
  Synthetic
auacacgggagccgggcgccaug

SEQ ID NO: 43404 - RNA, 24 nt, Artificial Sequence
  Synthetic
cauacacgggagccgggcgccaug

SEQ ID NO: 43405 - RNA, 18 nt, Artificial Sequence
  Synthetic
auauuggggggcgccaug

SEQ ID NO: 43406 - RNA, 19 nt, Artificial Sequence
  Synthetic
cauauuggggggcgccaug

SEQ ID NO: 43407 - RNA, 20 nt, Artificial Sequence
  Synthetic
ccauauuggggggcgccaug

SEQ ID NO: 43408 - RNA, 21 nt, Artificial Sequence
  Synthetic
gccauauuggggggcgccaug

SEQ ID NO: 43409 - RNA, 22 nt, Artificial Sequence
  Synthetic
cgccauauuggggggcgccaug

SEQ ID NO: 43410 - RNA, 23 nt, Artificial Sequence
  Synthetic
gcgccauauuggggggcgccaug

SEQ ID NO: 43411 - RNA, 24 nt, Artificial Sequence
  Synthetic
ggcgccauauuggggggcgccaug

SEQ ID NO: 43412 - RNA, 18 nt, Artificial Sequence
  Synthetic
gggaccggggucgcccug

SEQ ID NO: 43413 - RNA, 19 nt, Artificial Sequence
  Synthetic
agggaccggggucgcccug

SEQ ID NO: 43414 - RNA, 20 nt, Artificial Sequence
  Synthetic
cagggaccggggucgcccug

SEQ ID NO: 43415 - RNA, 21 nt, Artificial Sequence
  Synthetic
acagggaccggggucgcccug

SEQ ID NO: 43416 - RNA, 22 nt, Artificial Sequence
  Synthetic
uacagggaccggggucgcccug

SEQ ID NO: 43417 - RNA, 23 nt, Artificial Sequence
  Synthetic
auacagggaccggggucgcccug

SEQ ID NO: 43418 - RNA, 24 nt, Artificial Sequence
  Synthetic
uauacagggaccggggucgcccug

SEQ ID NO: 43419 - RNA, 18 nt, Artificial Sequence
  Synthetic
cgcccccagcgcgaggug

SEQ ID NO: 43420 - RNA, 19 nt, Artificial Sequence
  Synthetic
ccgcccccagcgcgaggug

SEQ ID NO: 43421 - RNA, 20 nt, Artificial Sequence
  Synthetic
gccgcccccagcgcgaggug

SEQ ID NO: 43422 - RNA, 21 nt, Artificial Sequence
  Synthetic
ggccgcccccagcgcgaggug

SEQ ID NO: 43423 - RNA, 22 nt, Artificial Sequence
  Synthetic
gggccgcccccagcgcgaggug

SEQ ID NO: 43424 - RNA, 23 nt, Artificial Sequence
  Synthetic
agggccgcccccagcgcgaggug

SEQ ID NO: 43425 - RNA, 24 nt, Artificial Sequence
  Synthetic
gagggccgcccccagcgcgaggug

SEQ ID NO: 43426 - RNA, 18 nt, Artificial Sequence
  Synthetic
gcgccauguuagggggug

SEQ ID NO: 43427 - RNA, 19 nt, Artificial Sequence
  Synthetic
ggcgccauguuagggggug

SEQ ID NO: 43428 - RNA, 20 nt, Artificial Sequence
  Synthetic
gggcgccauguuagggggug

SEQ ID NO: 43429 - RNA, 21 nt, Artificial Sequence
  Synthetic
ggggcgccauguuagggggug

SEQ ID NO: 43430 - RNA, 22 nt, Artificial Sequence
  Synthetic
gggggcgccauguuagggggug

SEQ ID NO: 43431 - RNA, 23 nt, Artificial Sequence
  Synthetic
cgggggcgccauguuagggggug

SEQ ID NO: 43432 - RNA, 24 nt, Artificial Sequence
  Synthetic
ccgggggcgccauguuagggggug

SEQ ID NO: 43433 - RNA, 18 nt, Artificial Sequence
  Synthetic
ugggacgcgcggccauug

SEQ ID NO: 43434 - RNA, 19 nt, Artificial Sequence
  Synthetic
cugggacgcgcggccauug

SEQ ID NO: 43435 - RNA, 20 nt, Artificial Sequence
  Synthetic
ccugggacgcgcggccauug

SEQ ID NO: 43436 - RNA, 21 nt, Artificial Sequence
  Synthetic
cccugggacgcgcggccauug

SEQ ID NO: 43437 - RNA, 22 nt, Artificial Sequence
  Synthetic
ccccugggacgcgcggccauug

SEQ ID NO: 43438 - RNA, 23 nt, Artificial Sequence
  Synthetic
uccccugggacgcgcggccauug

SEQ ID NO: 43439 - RNA, 24 nt, Artificial Sequence
  Synthetic
cuccccugggacgcgcggccauug

SEQ ID NO: 43440 - RNA, 18 nt, Artificial Sequence
  Synthetic
uuggggggcgccauauug

SEQ ID NO: 43441 - RNA, 19 nt, Artificial Sequence
  Synthetic
auuggggggcgccauauug

SEQ ID NO: 43442 - RNA, 20 nt, Artificial Sequence
  Synthetic
uauuggggggcgccauauug

SEQ ID NO: 43443 - RNA, 21 nt, Artificial Sequence
  Synthetic
auauuggggggcgccauauug

SEQ ID NO: 43444 - RNA, 22 nt, Artificial Sequence
  Synthetic
cauauuggggggcgccauauug

SEQ ID NO: 43445 - RNA, 23 nt, Artificial Sequence
  Synthetic
ccauauuggggggcgccauauug

SEQ ID NO: 43446 - RNA, 24 nt, Artificial Sequence
  Synthetic
gccauauuggggggcgccauauug

SEQ ID NO: 43447 - RNA, 18 nt, Artificial Sequence
  Synthetic
gucuggggcgccauauug

SEQ ID NO: 43448 - RNA, 19 nt, Artificial Sequence
  Synthetic
ugucuggggcgccauauug

SEQ ID NO: 43449 - RNA, 20 nt, Artificial Sequence
  Synthetic
augucuggggcgccauauug

SEQ ID NO: 43450 - RNA, 21 nt, Artificial Sequence
  Synthetic
caugucuggggcgccauauug

SEQ ID NO: 43451 - RNA, 22 nt, Artificial Sequence
  Synthetic
ccaugucuggggcgccauauug

SEQ ID NO: 43452 - RNA, 23 nt, Artificial Sequence
  Synthetic
gccaugucuggggcgccauauug

SEQ ID NO: 43453 - RNA, 24 nt, Artificial Sequence
  Synthetic
cgccaugucuggggcgccauauug

SEQ ID NO: 43454 - RNA, 18 nt, Artificial Sequence
  Synthetic
gaaccggccgccauguug

SEQ ID NO: 43455 - RNA, 19 nt, Artificial Sequence
  Synthetic
ggaaccggccgccauguug

SEQ ID NO: 43456 - RNA, 20 nt, Artificial Sequence
  Synthetic
uggaaccggccgccauguug

SEQ ID NO: 43457 - RNA, 21 nt, Artificial Sequence
  Synthetic
cuggaaccggccgccauguug

SEQ ID NO: 43458 - RNA, 22 nt, Artificial Sequence
  Synthetic
acuggaaccggccgccauguug

SEQ ID NO: 43459 - RNA, 23 nt, Artificial Sequence
  Synthetic
cacuggaaccggccgccauguug

SEQ ID NO: 43460 - RNA, 24 nt, Artificial Sequence
  Synthetic
acacuggaaccggccgccauguug

SEQ ID NO: 43461 - RNA, 18 nt, Artificial Sequence
  Synthetic
uuggggggcgccauguug

SEQ ID NO: 43462 - RNA, 19 nt, Artificial Sequence
  Synthetic
auuggggggcgccauguug

SEQ ID NO: 43463 - RNA, 20 nt, Artificial Sequence
  Synthetic
uauuggggggcgccauguug

SEQ ID NO: 43464 - RNA, 21 nt, Artificial Sequence
  Synthetic
auauuggggggcgccauguug

SEQ ID NO: 43465 - RNA, 22 nt, Artificial Sequence
  Synthetic
cauauuggggggcgccauguug

SEQ ID NO: 43466 - RNA, 23 nt, Artificial Sequence
  Synthetic
ccauauuggggggcgccauguug

SEQ ID NO: 43467 - RNA, 24 nt, Artificial Sequence
  Synthetic
gccauauuggggggcgccauguug

SEQ ID NO: 43468 - RNA, 18 nt, Artificial Sequence
  Synthetic
gucacugccgccccuuug

SEQ ID NO: 43469 - RNA, 19 nt, Artificial Sequence
  Synthetic
cgucacugccgccccuuug

SEQ ID NO: 43470 - RNA, 20 nt, Artificial Sequence
  Synthetic
ucgucacugccgccccuuug

SEQ ID NO: 43471 - RNA, 21 nt, Artificial Sequence
  Synthetic
aucgucacugccgccccuuug

SEQ ID NO: 43472 - RNA, 22 nt, Artificial Sequence
  Synthetic
aaucgucacugccgccccuuug

SEQ ID NO: 43473 - RNA, 23 nt, Artificial Sequence
  Synthetic
gaaucgucacugccgccccuuug

SEQ ID NO: 43474 - RNA, 24 nt, Artificial Sequence
  Synthetic
ggaaucgucacugccgccccuuug

SEQ ID NO: 43475 - RNA, 18 nt, Artificial Sequence
  Synthetic
ugcuaaugggguucuuug

SEQ ID NO: 43476 - RNA, 19 nt, Artificial Sequence
  Synthetic
augcuaaugggguucuuug

SEQ ID NO: 43477 - RNA, 20 nt, Artificial Sequence
  Synthetic
caugcuaaugggguucuuug

SEQ ID NO: 43478 - RNA, 21 nt, Artificial Sequence
  Synthetic
gcaugcuaaugggguucuuug

SEQ ID NO: 43479 - RNA, 22 nt, Artificial Sequence
  Synthetic
ggcaugcuaaugggguucuuug

SEQ ID NO: 43480 - RNA, 23 nt, Artificial Sequence
  Synthetic
gggcaugcuaaugggguucuuug

SEQ ID NO: 43481 - RNA, 24 nt, Artificial Sequence
  Synthetic
ggggcaugcuaaugggguucuuug

SEQ ID NO: 43482 - RNA, 18 nt, Artificial Sequence
  Synthetic
augcuaauugcuuuuuug

SEQ ID NO: 43483 - RNA, 19 nt, Artificial Sequence
  Synthetic
uaugcuaauugcuuuuuug

SEQ ID NO: 43484 - RNA, 20 nt, Artificial Sequence
  Synthetic
uuaugcuaauugcuuuuuug

SEQ ID NO: 43485 - RNA, 21 nt, Artificial Sequence
  Synthetic
guuaugcuaauugcuuuuuug

SEQ ID NO: 43486 - RNA, 22 nt, Artificial Sequence
  Synthetic
gguuaugcuaauugcuuuuuug

SEQ ID NO: 43487 - RNA, 23 nt, Artificial Sequence
  Synthetic
ggguuaugcuaauugcuuuuuug

SEQ ID NO: 43488 - RNA, 24 nt, Artificial Sequence
  Synthetic
cggguuaugcuaauugcuuuuuug

SEQ ID NO: 43489 - RNA, 18 nt, Artificial Sequence
  Synthetic
cggguugggcccccaaau

SEQ ID NO: 43490 - RNA, 19 nt, Artificial Sequence
  Synthetic
ccggguugggcccccaaau

SEQ ID NO: 43491 - RNA, 20 nt, Artificial Sequence
  Synthetic
accggguugggcccccaaau

SEQ ID NO: 43492 - RNA, 21 nt, Artificial Sequence
  Synthetic
caccggguugggcccccaaau

SEQ ID NO: 43493 - RNA, 22 nt, Artificial Sequence
  Synthetic
acaccggguugggcccccaaau

SEQ ID NO: 43494 - RNA, 23 nt, Artificial Sequence
  Synthetic
gacaccggguugggcccccaaau

SEQ ID NO: 43495 - RNA, 24 nt, Artificial Sequence
  Synthetic
ggacaccggguugggcccccaaau

SEQ ID NO: 43496 - RNA, 18 nt, Artificial Sequence
  Synthetic
ccugggacgcgcggccau

SEQ ID NO: 43497 - RNA, 19 nt, Artificial Sequence
  Synthetic
cccugggacgcgcggccau

SEQ ID NO: 43498 - RNA, 20 nt, Artificial Sequence
  Synthetic
ccccugggacgcgcggccau

SEQ ID NO: 43499 - RNA, 21 nt, Artificial Sequence
  Synthetic
uccccugggacgcgcggccau

SEQ ID NO: 43500 - RNA, 22 nt, Artificial Sequence
  Synthetic
cuccccugggacgcgcggccau

SEQ ID NO: 43501 - RNA, 23 nt, Artificial Sequence
  Synthetic
ccuccccugggacgcgcggccau

SEQ ID NO: 43502 - RNA, 24 nt, Artificial Sequence
  Synthetic
gccuccccugggacgcgcggccau

SEQ ID NO: 43503 - RNA, 18 nt, Artificial Sequence
  Synthetic
uauuggggggcgccauau

SEQ ID NO: 43504 - RNA, 19 nt, Artificial Sequence
  Synthetic
auauuggggggcgccauau

SEQ ID NO: 43505 - RNA, 20 nt, Artificial Sequence
  Synthetic
cauauuggggggcgccauau

SEQ ID NO: 43506 - RNA, 21 nt, Artificial Sequence
  Synthetic
ccauauuggggggcgccauau

SEQ ID NO: 43507 - RNA, 22 nt, Artificial Sequence
  Synthetic
gccauauuggggggcgccauau

SEQ ID NO: 43508 - RNA, 23 nt, Artificial Sequence
  Synthetic
cgccauauuggggggcgccauau

SEQ ID NO: 43509 - RNA, 24 nt, Artificial Sequence
  Synthetic
gcgccauauuggggggcgccauau

SEQ ID NO: 43510 - RNA, 18 nt, Artificial Sequence
  Synthetic
augucuggggcgccauau

SEQ ID NO: 43511 - RNA, 19 nt, Artificial Sequence
  Synthetic
caugucuggggcgccauau

SEQ ID NO: 43512 - RNA, 20 nt, Artificial Sequence
  Synthetic
ccaugucuggggcgccauau

SEQ ID NO: 43513 - RNA, 21 nt, Artificial Sequence
  Synthetic
gccaugucuggggcgccauau

SEQ ID NO: 43514 - RNA, 22 nt, Artificial Sequence
  Synthetic
cgccaugucuggggcgccauau

SEQ ID NO: 43515 - RNA, 23 nt, Artificial Sequence
  Synthetic
gcgccaugucuggggcgccauau

SEQ ID NO: 43516 - RNA, 24 nt, Artificial Sequence
  Synthetic
ggcgccaugucuggggcgccauau

SEQ ID NO: 43517 - RNA, 18 nt, Artificial Sequence
  Synthetic
cauuugcaccucggcacu

SEQ ID NO: 43518 - RNA, 19 nt, Artificial Sequence
  Synthetic
gcauuugcaccucggcacu

SEQ ID NO: 43519 - RNA, 20 nt, Artificial Sequence
  Synthetic
cgcauuugcaccucggcacu

SEQ ID NO: 43520 - RNA, 18 nt, Artificial Sequence
  Synthetic
aucgucacugccgccccu

SEQ ID NO: 43521 - RNA, 19 nt, Artificial Sequence
  Synthetic
aaucgucacugccgccccu

SEQ ID NO: 43522 - RNA, 20 nt, Artificial Sequence
  Synthetic
gaaucgucacugccgccccu

SEQ ID NO: 43523 - RNA, 21 nt, Artificial Sequence
  Synthetic
ggaaucgucacugccgccccu

SEQ ID NO: 43524 - RNA, 22 nt, Artificial Sequence
  Synthetic
gggaaucgucacugccgccccu

SEQ ID NO: 43525 - RNA, 23 nt, Artificial Sequence
  Synthetic
ggggaaucgucacugccgccccu

SEQ ID NO: 43526 - RNA, 24 nt, Artificial Sequence
  Synthetic
gggggaaucgucacugccgccccu

SEQ ID NO: 43527 - RNA, 18 nt, Artificial Sequence
  Synthetic
gcgaguacccgccggccu

SEQ ID NO: 43528 - RNA, 19 nt, Artificial Sequence
  Synthetic
agcgaguacccgccggccu

SEQ ID NO: 43529 - RNA, 20 nt, Artificial Sequence
  Synthetic
gagcgaguacccgccggccu

SEQ ID NO: 43530 - RNA, 21 nt, Artificial Sequence
  Synthetic
ggagcgaguacccgccggccu

SEQ ID NO: 43531 - RNA, 22 nt, Artificial Sequence
  Synthetic
cggagcgaguacccgccggccu

SEQ ID NO: 43532 - RNA, 23 nt, Artificial Sequence
  Synthetic
ccggagcgaguacccgccggccu

SEQ ID NO: 43533 - RNA, 24 nt, Artificial Sequence
  Synthetic
cccggagcgaguacccgccggccu

SEQ ID NO: 43534 - RNA, 18 nt, Artificial Sequence
  Synthetic
gcaugcuaaugauauucu

SEQ ID NO: 43535 - RNA, 19 nt, Artificial Sequence
  Synthetic
ugcaugcuaaugauauucu

SEQ ID NO: 43536 - RNA, 20 nt, Artificial Sequence
  Synthetic
gugcaugcuaaugauauucu

SEQ ID NO: 43537 - RNA, 21 nt, Artificial Sequence
  Synthetic
cgugcaugcuaaugauauucu

SEQ ID NO: 43538 - RNA, 22 nt, Artificial Sequence
  Synthetic
ccgugcaugcuaaugauauucu

SEQ ID NO: 43539 - RNA, 23 nt, Artificial Sequence
  Synthetic
gccgugcaugcuaaugauauucu

SEQ ID NO: 43540 - RNA, 24 nt, Artificial Sequence
  Synthetic
ggccgugcaugcuaaugauauucu

SEQ ID NO: 43541 - RNA, 18 nt, Artificial Sequence
  Synthetic
gcaugcuaaugggguucu

SEQ ID NO: 43542 - RNA, 19 nt, Artificial Sequence
  Synthetic
ggcaugcuaaugggguucu

SEQ ID NO: 43543 - RNA, 20 nt, Artificial Sequence
  Synthetic
gggcaugcuaaugggguucu

SEQ ID NO: 43544 - RNA, 21 nt, Artificial Sequence
  Synthetic
ggggcaugcuaaugggguucu

SEQ ID NO: 43545 - RNA, 22 nt, Artificial Sequence
  Synthetic
aggggcaugcuaaugggguucu

SEQ ID NO: 43546 - RNA, 23 nt, Artificial Sequence
  Synthetic
gaggggcaugcuaaugggguucu

SEQ ID NO: 43547 - RNA, 24 nt, Artificial Sequence
  Synthetic
ggaggggcaugcuaaugggguucu

SEQ ID NO: 43548 - RNA, 18 nt, Artificial Sequence
  Synthetic
guaugguaaugaguuucu

SEQ ID NO: 43549 - RNA, 19 nt, Artificial Sequence
  Synthetic
gguaugguaaugaguuucu

SEQ ID NO: 43550 - RNA, 20 nt, Artificial Sequence
  Synthetic
ggguaugguaaugaguuucu

SEQ ID NO: 43551 - RNA, 21 nt, Artificial Sequence
  Synthetic
cggguaugguaaugaguuucu

SEQ ID NO: 43552 - RNA, 22 nt, Artificial Sequence
  Synthetic
ccggguaugguaaugaguuucu

SEQ ID NO: 43553 - RNA, 23 nt, Artificial Sequence
  Synthetic
uccggguaugguaaugaguuucu

SEQ ID NO: 43554 - RNA, 24 nt, Artificial Sequence
  Synthetic
uuccggguaugguaaugaguuucu

SEQ ID NO: 43555 - RNA, 18 nt, Artificial Sequence
  Synthetic
ccgcccccagcgcgaggu

SEQ ID NO: 43556 - RNA, 19 nt, Artificial Sequence
  Synthetic
gccgcccccagcgcgaggu

SEQ ID NO: 43557 - RNA, 20 nt, Artificial Sequence
  Synthetic
ggccgcccccagcgcgaggu

SEQ ID NO: 43558 - RNA, 21 nt, Artificial Sequence
  Synthetic
gggccgcccccagcgcgaggu

SEQ ID NO: 43559 - RNA, 22 nt, Artificial Sequence
  Synthetic
agggccgcccccagcgcgaggu

SEQ ID NO: 43560 - RNA, 23 nt, Artificial Sequence
  Synthetic
gagggccgcccccagcgcgaggu

SEQ ID NO: 43561 - RNA, 24 nt, Artificial Sequence
  Synthetic
ugagggccgcccccagcgcgaggu

SEQ ID NO: 43562 - RNA, 18 nt, Artificial Sequence
  Synthetic
ggcgccauguuagggggu

SEQ ID NO: 43563 - RNA, 19 nt, Artificial Sequence
  Synthetic
gggcgccauguuagggggu

SEQ ID NO: 43564 - RNA, 20 nt, Artificial Sequence
  Synthetic
ggggcgccauguuagggggu

SEQ ID NO: 43565 - RNA, 21 nt, Artificial Sequence
  Synthetic
gggggcgccauguuagggggu

SEQ ID NO: 43566 - RNA, 22 nt, Artificial Sequence
  Synthetic
cgggggcgccauguuagggggu

SEQ ID NO: 43567 - RNA, 23 nt, Artificial Sequence
  Synthetic
ccgggggcgccauguuagggggu

SEQ ID NO: 43568 - RNA, 24 nt, Artificial Sequence
  Synthetic
accgggggcgccauguuagggggu

SEQ ID NO: 43569 - RNA, 18 nt, Artificial Sequence
  Synthetic
uggaaccggccgccaugu

SEQ ID NO: 43570 - RNA, 19 nt, Artificial Sequence
  Synthetic
cuggaaccggccgccaugu

SEQ ID NO: 43571 - RNA, 20 nt, Artificial Sequence
  Synthetic
acuggaaccggccgccaugu

SEQ ID NO: 43572 - RNA, 21 nt, Artificial Sequence
  Synthetic
cacuggaaccggccgccaugu

SEQ ID NO: 43573 - RNA, 22 nt, Artificial Sequence
  Synthetic
acacuggaaccggccgccaugu

SEQ ID NO: 43574 - RNA, 23 nt, Artificial Sequence
  Synthetic
uacacuggaaccggccgccaugu

SEQ ID NO: 43575 - RNA, 24 nt, Artificial Sequence
  Synthetic
uuacacuggaaccggccgccaugu

SEQ ID NO: 43576 - RNA, 18 nt, Artificial Sequence
  Synthetic
gggagccgggcgccaugu

SEQ ID NO: 43577 - RNA, 19 nt, Artificial Sequence
  Synthetic
cgggagccgggcgccaugu

SEQ ID NO: 43578 - RNA, 20 nt, Artificial Sequence
  Synthetic
acgggagccgggcgccaugu

SEQ ID NO: 43579 - RNA, 21 nt, Artificial Sequence
  Synthetic
cacgggagccgggcgccaugu

SEQ ID NO: 43580 - RNA, 22 nt, Artificial Sequence
  Synthetic
acacgggagccgggcgccaugu

SEQ ID NO: 43581 - RNA, 23 nt, Artificial Sequence
  Synthetic
uacacgggagccgggcgccaugu

SEQ ID NO: 43582 - RNA, 24 nt, Artificial Sequence
  Synthetic
auacacgggagccgggcgccaugu

SEQ ID NO: 43583 - RNA, 18 nt, Artificial Sequence
  Synthetic
aggggccgggcgccaugu

SEQ ID NO: 43584 - RNA, 19 nt, Artificial Sequence
  Synthetic
gaggggccgggcgccaugu

SEQ ID NO: 43585 - RNA, 20 nt, Artificial Sequence
  Synthetic
ugaggggccgggcgccaugu

SEQ ID NO: 43586 - RNA, 21 nt, Artificial Sequence
  Synthetic
gugaggggccgggcgccaugu

SEQ ID NO: 43587 - RNA, 22 nt, Artificial Sequence
  Synthetic
ggugaggggccgggcgccaugu

SEQ ID NO: 43588 - RNA, 23 nt, Artificial Sequence
  Synthetic
aggugaggggccgggcgccaugu

SEQ ID NO: 43589 - RNA, 24 nt, Artificial Sequence
  Synthetic
gaggugaggggccgggcgccaugu

SEQ ID NO: 43590 - RNA, 18 nt, Artificial Sequence
  Synthetic
ggaccgggggcgccaugu

SEQ ID NO: 43591 - RNA, 19 nt, Artificial Sequence
  Synthetic
gggaccgggggcgccaugu

SEQ ID NO: 43592 - RNA, 20 nt, Artificial Sequence
  Synthetic
agggaccgggggcgccaugu

SEQ ID NO: 43593 - RNA, 21 nt, Artificial Sequence
  Synthetic
cagggaccgggggcgccaugu

SEQ ID NO: 43594 - RNA, 22 nt, Artificial Sequence
  Synthetic
acagggaccgggggcgccaugu

SEQ ID NO: 43595 - RNA, 23 nt, Artificial Sequence
  Synthetic
uacagggaccgggggcgccaugu

SEQ ID NO: 43596 - RNA, 24 nt, Artificial Sequence
  Synthetic
auacagggaccgggggcgccaugu

SEQ ID NO: 43597 - RNA, 18 nt, Artificial Sequence
  Synthetic
uauuggggggcgccaugu

SEQ ID NO: 43598 - RNA, 19 nt, Artificial Sequence
  Synthetic
auauuggggggcgccaugu

SEQ ID NO: 43599 - RNA, 20 nt, Artificial Sequence
  Synthetic
cauauuggggggcgccaugu

SEQ ID NO: 43600 - RNA, 21 nt, Artificial Sequence
  Synthetic
ccauauuggggggcgccaugu

SEQ ID NO: 43601 - RNA, 22 nt, Artificial Sequence
  Synthetic
gccauauuggggggcgccaugu

SEQ ID NO: 43602 - RNA, 23 nt, Artificial Sequence
  Synthetic
cgccauauuggggggcgccaugu

SEQ ID NO: 43603 - RNA, 24 nt, Artificial Sequence
  Synthetic
gcgccauauuggggggcgccaugu

SEQ ID NO: 43604 - RNA, 18 nt, Artificial Sequence
  Synthetic
cauguuggggcgccaugu

SEQ ID NO: 43605 - RNA, 19 nt, Artificial Sequence
  Synthetic
ccauguuggggcgccaugu

SEQ ID NO: 43606 - RNA, 20 nt, Artificial Sequence
  Synthetic
gccauguuggggcgccaugu

SEQ ID NO: 43607 - RNA, 21 nt, Artificial Sequence
  Synthetic
cgccauguuggggcgccaugu

SEQ ID NO: 43608 - RNA, 22 nt, Artificial Sequence
  Synthetic
gcgccauguuggggcgccaugu

SEQ ID NO: 43609 - RNA, 23 nt, Artificial Sequence
  Synthetic
ggcgccauguuggggcgccaugu

SEQ ID NO: 43610 - RNA, 24 nt, Artificial Sequence
  Synthetic
gggcgccauguuggggcgccaugu

SEQ ID NO: 43611 - RNA, 18 nt, Artificial Sequence
  Synthetic
ggaccggggucgcccugu

SEQ ID NO: 43612 - RNA, 19 nt, Artificial Sequence
  Synthetic
gggaccggggucgcccugu

SEQ ID NO: 43613 - RNA, 20 nt, Artificial Sequence
  Synthetic
agggaccggggucgcccugu

SEQ ID NO: 43614 - RNA, 21 nt, Artificial Sequence
  Synthetic
cagggaccggggucgcccugu

SEQ ID NO: 43615 - RNA, 22 nt, Artificial Sequence
  Synthetic
acagggaccggggucgcccugu

SEQ ID NO: 43616 - RNA, 23 nt, Artificial Sequence
  Synthetic
uacagggaccggggucgcccugu

SEQ ID NO: 43617 - RNA, 24 nt, Artificial Sequence
  Synthetic
auacagggaccggggucgcccugu

SEQ ID NO: 43618 - RNA, 18 nt, Artificial Sequence
  Synthetic
cugggacgcgcggccauu

SEQ ID NO: 43619 - RNA, 19 nt, Artificial Sequence
  Synthetic
ccugggacgcgcggccauu

SEQ ID NO: 43620 - RNA, 20 nt, Artificial Sequence
  Synthetic
cccugggacgcgcggccauu

SEQ ID NO: 43621 - RNA, 21 nt, Artificial Sequence
  Synthetic
ccccugggacgcgcggccauu

SEQ ID NO: 43622 - RNA, 22 nt, Artificial Sequence
  Synthetic
uccccugggacgcgcggccauu

SEQ ID NO: 43623 - RNA, 23 nt, Artificial Sequence
  Synthetic
cuccccugggacgcgcggccauu

SEQ ID NO: 43624 - RNA, 24 nt, Artificial Sequence
  Synthetic
ccuccccugggacgcgcggccauu

SEQ ID NO: 43625 - RNA, 18 nt, Artificial Sequence
  Synthetic
auuggggggcgccauauu

SEQ ID NO: 43626 - RNA, 19 nt, Artificial Sequence
  Synthetic
uauuggggggcgccauauu

SEQ ID NO: 43627 - RNA, 20 nt, Artificial Sequence
  Synthetic
auauuggggggcgccauauu

SEQ ID NO: 43628 - RNA, 21 nt, Artificial Sequence
  Synthetic
cauauuggggggcgccauauu

SEQ ID NO: 43629 - RNA, 22 nt, Artificial Sequence
  Synthetic
ccauauuggggggcgccauauu

SEQ ID NO: 43630 - RNA, 23 nt, Artificial Sequence
  Synthetic
gccauauuggggggcgccauauu

SEQ ID NO: 43631 - RNA, 24 nt, Artificial Sequence
  Synthetic
cgccauauuggggggcgccauauu

SEQ ID NO: 43632 - RNA, 18 nt, Artificial Sequence
  Synthetic
ugucuggggcgccauauu

SEQ ID NO: 43633 - RNA, 19 nt, Artificial Sequence
  Synthetic
augucuggggcgccauauu

SEQ ID NO: 43634 - RNA, 20 nt, Artificial Sequence
  Synthetic
caugucuggggcgccauauu

SEQ ID NO: 43635 - RNA, 21 nt, Artificial Sequence
  Synthetic
ccaugucuggggcgccauauu

SEQ ID NO: 43636 - RNA, 22 nt, Artificial Sequence
  Synthetic
gccaugucuggggcgccauauu

SEQ ID NO: 43637 - RNA, 23 nt, Artificial Sequence
  Synthetic
cgccaugucuggggcgccauauu

SEQ ID NO: 43638 - RNA, 24 nt, Artificial Sequence
  Synthetic
gcgccaugucuggggcgccauauu

SEQ ID NO: 43639 - RNA, 18 nt, Artificial Sequence
  Synthetic
ucgucacugccgccccuu

SEQ ID NO: 43640 - RNA, 19 nt, Artificial Sequence
  Synthetic
aucgucacugccgccccuu

SEQ ID NO: 43641 - RNA, 20 nt, Artificial Sequence
  Synthetic
aaucgucacugccgccccuu

SEQ ID NO: 43642 - RNA, 21 nt, Artificial Sequence
  Synthetic
gaaucgucacugccgccccuu

SEQ ID NO: 43643 - RNA, 22 nt, Artificial Sequence
  Synthetic
ggaaucgucacugccgccccuu

SEQ ID NO: 43644 - RNA, 23 nt, Artificial Sequence
  Synthetic
gggaaucgucacugccgccccuu

SEQ ID NO: 43645 - RNA, 24 nt, Artificial Sequence
  Synthetic
ggggaaucgucacugccgccccuu

SEQ ID NO: 43646 - RNA, 18 nt, Artificial Sequence
  Synthetic
caugcuaaugauauucuu

SEQ ID NO: 43647 - RNA, 19 nt, Artificial Sequence
  Synthetic
gcaugcuaaugauauucuu

SEQ ID NO: 43648 - RNA, 20 nt, Artificial Sequence
  Synthetic
ugcaugcuaaugauauucuu

SEQ ID NO: 43649 - RNA, 21 nt, Artificial Sequence
  Synthetic
gugcaugcuaaugauauucuu

SEQ ID NO: 43650 - RNA, 22 nt, Artificial Sequence
  Synthetic
cgugcaugcuaaugauauucuu

SEQ ID NO: 43651 - RNA, 23 nt, Artificial Sequence
  Synthetic
ccgugcaugcuaaugauauucuu

SEQ ID NO: 43652 - RNA, 24 nt, Artificial Sequence
  Synthetic
gccgugcaugcuaaugauauucuu

SEQ ID NO: 43653 - RNA, 18 nt, Artificial Sequence
  Synthetic
caugcuaaugggguucuu

SEQ ID NO: 43654 - RNA, 19 nt, Artificial Sequence
  Synthetic
gcaugcuaaugggguucuu

SEQ ID NO: 43655 - RNA, 20 nt, Artificial Sequence
  Synthetic
ggcaugcuaaugggguucuu

SEQ ID NO: 43656 - RNA, 21 nt, Artificial Sequence
  Synthetic
gggcaugcuaaugggguucuu

SEQ ID NO: 43657 - RNA, 22 nt, Artificial Sequence
  Synthetic
ggggcaugcuaaugggguucuu

SEQ ID NO: 43658 - RNA, 23 nt, Artificial Sequence
  Synthetic
aggggcaugcuaaugggguucuu

SEQ ID NO: 43659 - RNA, 24 nt, Artificial Sequence
  Synthetic
gaggggcaugcuaaugggguucuu

SEQ ID NO: 43660 - RNA, 18 nt, Artificial Sequence
  Synthetic
uaugguaaugaguuucuu

SEQ ID NO: 43661 - RNA, 19 nt, Artificial Sequence
  Synthetic
guaugguaaugaguuucuu

SEQ ID NO: 43662 - RNA, 20 nt, Artificial Sequence
  Synthetic
gguaugguaaugaguuucuu

SEQ ID NO: 43663 - RNA, 21 nt, Artificial Sequence
  Synthetic
ggguaugguaaugaguuucuu

SEQ ID NO: 43664 - RNA, 22 nt, Artificial Sequence
  Synthetic
cggguaugguaaugaguuucuu

SEQ ID NO: 43665 - RNA, 23 nt, Artificial Sequence
  Synthetic
ccggguaugguaaugaguuucuu

SEQ ID NO: 43666 - RNA, 24 nt, Artificial Sequence
  Synthetic
uccggguaugguaaugaguuucuu

SEQ ID NO: 43667 - RNA, 18 nt, Artificial Sequence
  Synthetic
ggaaccggccgccauguu

SEQ ID NO: 43668 - RNA, 19 nt, Artificial Sequence
  Synthetic
uggaaccggccgccauguu

SEQ ID NO: 43669 - RNA, 20 nt, Artificial Sequence
  Synthetic
cuggaaccggccgccauguu

SEQ ID NO: 43670 - RNA, 21 nt, Artificial Sequence
  Synthetic
acuggaaccggccgccauguu

SEQ ID NO: 43671 - RNA, 22 nt, Artificial Sequence
  Synthetic
cacuggaaccggccgccauguu

SEQ ID NO: 43672 - RNA, 23 nt, Artificial Sequence
  Synthetic
acacuggaaccggccgccauguu

SEQ ID NO: 43673 - RNA, 24 nt, Artificial Sequence
  Synthetic
uacacuggaaccggccgccauguu

SEQ ID NO: 43674 - RNA, 18 nt, Artificial Sequence
  Synthetic
gaccgggggcgccauguu

SEQ ID NO: 43675 - RNA, 19 nt, Artificial Sequence
  Synthetic
ggaccgggggcgccauguu

SEQ ID NO: 43676 - RNA, 20 nt, Artificial Sequence
  Synthetic
gggaccgggggcgccauguu

SEQ ID NO: 43677 - RNA, 21 nt, Artificial Sequence
  Synthetic
agggaccgggggcgccauguu

SEQ ID NO: 43678 - RNA, 22 nt, Artificial Sequence
  Synthetic
cagggaccgggggcgccauguu

SEQ ID NO: 43679 - RNA, 23 nt, Artificial Sequence
  Synthetic
acagggaccgggggcgccauguu

SEQ ID NO: 43680 - RNA, 24 nt, Artificial Sequence
  Synthetic
uacagggaccgggggcgccauguu

SEQ ID NO: 43681 - RNA, 18 nt, Artificial Sequence
  Synthetic
auuggggggcgccauguu

SEQ ID NO: 43682 - RNA, 19 nt, Artificial Sequence
  Synthetic
uauuggggggcgccauguu

SEQ ID NO: 43683 - RNA, 20 nt, Artificial Sequence
  Synthetic
auauuggggggcgccauguu

SEQ ID NO: 43684 - RNA, 21 nt, Artificial Sequence
  Synthetic
cauauuggggggcgccauguu

SEQ ID NO: 43685 - RNA, 22 nt, Artificial Sequence
  Synthetic
ccauauuggggggcgccauguu

SEQ ID NO: 43686 - RNA, 23 nt, Artificial Sequence
  Synthetic
gccauauuggggggcgccauguu

SEQ ID NO: 43687 - RNA, 24 nt, Artificial Sequence
  Synthetic
cgccauauuggggggcgccauguu

SEQ ID NO: 43688 - RNA, 18 nt, Artificial Sequence
  Synthetic
auguuggggcgccauguu

SEQ ID NO: 43689 - RNA, 19 nt, Artificial Sequence
  Synthetic
cauguuggggcgccauguu

SEQ ID NO: 43690 - RNA, 20 nt, Artificial Sequence
  Synthetic
ccauguuggggcgccauguu

SEQ ID NO: 43691 - RNA, 21 nt, Artificial Sequence
  Synthetic
gccauguuggggcgccauguu

SEQ ID NO: 43692 - RNA, 22 nt, Artificial Sequence
  Synthetic
cgccauguuggggcgccauguu

SEQ ID NO: 43693 - RNA, 23 nt, Artificial Sequence
  Synthetic
gcgccauguuggggcgccauguu

SEQ ID NO: 43694 - RNA, 24 nt, Artificial Sequence
  Synthetic
ggcgccauguuggggcgccauguu

SEQ ID NO: 43695 - RNA, 18 nt, Artificial Sequence
  Synthetic
cgucacugccgccccuuu

SEQ ID NO: 43696 - RNA, 19 nt, Artificial Sequence
  Synthetic
ucgucacugccgccccuuu

SEQ ID NO: 43697 - RNA, 20 nt, Artificial Sequence
  Synthetic
aucgucacugccgccccuuu

SEQ ID NO: 43698 - RNA, 21 nt, Artificial Sequence
  Synthetic
aaucgucacugccgccccuuu

SEQ ID NO: 43699 - RNA, 22 nt, Artificial Sequence
  Synthetic
gaaucgucacugccgccccuuu

SEQ ID NO: 43700 - RNA, 23 nt, Artificial Sequence
  Synthetic
ggaaucgucacugccgccccuuu

SEQ ID NO: 43701 - RNA, 24 nt, Artificial Sequence
  Synthetic
gggaaucgucacugccgccccuuu

SEQ ID NO: 43702 - RNA, 18 nt, Artificial Sequence
  Synthetic
augcuaaugauauucuuu

SEQ ID NO: 43703 - RNA, 19 nt, Artificial Sequence
  Synthetic
caugcuaaugauauucuuu

SEQ ID NO: 43704 - RNA, 20 nt, Artificial Sequence
  Synthetic
gcaugcuaaugauauucuuu

SEQ ID NO: 43705 - RNA, 21 nt, Artificial Sequence
  Synthetic
ugcaugcuaaugauauucuuu

SEQ ID NO: 43706 - RNA, 22 nt, Artificial Sequence
  Synthetic
gugcaugcuaaugauauucuuu

SEQ ID NO: 43707 - RNA, 23 nt, Artificial Sequence
  Synthetic
cgugcaugcuaaugauauucuuu

SEQ ID NO: 43708 - RNA, 24 nt, Artificial Sequence
  Synthetic
ccgugcaugcuaaugauauucuuu

SEQ ID NO: 43709 - RNA, 18 nt, Artificial Sequence
  Synthetic
augcuaaugggguucuuu

SEQ ID NO: 43710 - RNA, 19 nt, Artificial Sequence
  Synthetic
caugcuaaugggguucuuu

SEQ ID NO: 43711 - RNA, 20 nt, Artificial Sequence
  Synthetic
gcaugcuaaugggguucuuu

SEQ ID NO: 43712 - RNA, 21 nt, Artificial Sequence
  Synthetic
ggcaugcuaaugggguucuuu

SEQ ID NO: 43713 - RNA, 22 nt, Artificial Sequence
  Synthetic
gggcaugcuaaugggguucuuu

SEQ ID NO: 43714 - RNA, 23 nt, Artificial Sequence
  Synthetic
ggggcaugcuaaugggguucuuu

SEQ ID NO: 43715 - RNA, 24 nt, Artificial Sequence
  Synthetic
aggggcaugcuaaugggguucuuu

SEQ ID NO: 43716 - RNA, 21 nt, Artificial Sequence
  Synthetic
gccucggaagaggggggagaa

SEQ ID NO: 43717 - RNA, 22 nt, Artificial Sequence
  Synthetic
ggccucggaagaggggggagaa

SEQ ID NO: 43718 - RNA, 18 nt, Artificial Sequence
  Synthetic
gucucuguguaugaguca

SEQ ID NO: 43719 - RNA, 20 nt, Artificial Sequence
  Synthetic
gugucucuguguaugaguca

SEQ ID NO: 43720 - RNA, 22 nt, Artificial Sequence
  Synthetic
gcgugucucuguguaugaguca

SEQ ID NO: 43721 - RNA, 23 nt, Artificial Sequence
  Synthetic
ggcgugucucuguguaugaguca

SEQ ID NO: 43722 - RNA, 24 nt, Artificial Sequence
  Synthetic
gggcgugucucuguguaugaguca

SEQ ID NO: 43723 - RNA, 20 nt, Artificial Sequence
  Synthetic
gccucggguguaacguuaga

SEQ ID NO: 43724 - RNA, 23 nt, Artificial Sequence
  Synthetic
gccgccucggguguaacguuaga

SEQ ID NO: 43725 - RNA, 24 nt, Artificial Sequence
  Synthetic
ggccgccucggguguaacguuaga

SEQ ID NO: 43726 - RNA, 18 nt, Artificial Sequence
  Synthetic
ggccggggccgcccauua

SEQ ID NO: 43727 - RNA, 20 nt, Artificial Sequence
  Synthetic
gcggccggggccgcccauua

SEQ ID NO: 43728 - RNA, 24 nt, Artificial Sequence
  Synthetic
gauuucccgcgucaaucagcaccc

SEQ ID NO: 43729 - RNA, 19 nt, Artificial Sequence
  Synthetic
gcggaagacccaggccgcc

SEQ ID NO: 43730 - RNA, 24 nt, Artificial Sequence
  Synthetic
gcuccgcggaagacccaggccgcc

SEQ ID NO: 43731 - RNA, 22 nt, Artificial Sequence
  Synthetic
gcccuccagacgcaccggaguc

SEQ ID NO: 43732 - RNA, 20 nt, Artificial Sequence
  Synthetic
gcuaaggggaaaaaaggggg

SEQ ID NO: 43733 - RNA, 21 nt, Artificial Sequence
  Synthetic
ggcuaaggggaaaaaaggggg

SEQ ID NO: 43734 - RNA, 22 nt, Artificial Sequence
  Synthetic
gggcuaaggggaaaaaaggggg

SEQ ID NO: 43735 - RNA, 24 nt, Artificial Sequence
  Synthetic
gcgggcuaaggggaaaaaaggggg

SEQ ID NO: 43736 - RNA, 18 nt, Artificial Sequence
  Synthetic
gggcggguaagaaugggg

SEQ ID NO: 43737 - RNA, 19 nt, Artificial Sequence
  Synthetic
ggggcggguaagaaugggg

SEQ ID NO: 43738 - RNA, 20 nt, Artificial Sequence
  Synthetic
gggggcggguaagaaugggg

SEQ ID NO: 43739 - RNA, 21 nt, Artificial Sequence
  Synthetic
ggggggcggguaagaaugggg

SEQ ID NO: 43740 - RNA, 18 nt, Artificial Sequence
  Synthetic
guggucuggguccguccu

SEQ ID NO: 43741 - RNA, 19 nt, Artificial Sequence
  Synthetic
gguggucuggguccguccu

SEQ ID NO: 43742 - RNA, 19 nt, Artificial Sequence
  Synthetic
gcgaccccgggcccugcgu

SEQ ID NO: 43743 - RNA, 20 nt, Artificial Sequence
  Synthetic
ggcgaccccgggcccugcgu

SEQ ID NO: 43744 - RNA, 19 nt, Artificial Sequence
  Synthetic
gaguaaggggggccugcgu

SEQ ID NO: 43745 - RNA, 21 nt, Artificial Sequence
  Synthetic
gugaguaaggggggccugcgu

SEQ ID NO: 43746 - RNA, 23 nt, Artificial Sequence
  Synthetic
gugugaguaaggggggccugcgu

SEQ ID NO: 43747 - RNA, 18 nt, Artificial Sequence
  Synthetic
gaaaaaaggggggcgggu

SEQ ID NO: 43748 - RNA, 19 nt, Artificial Sequence
  Synthetic
ggaaaaaaggggggcgggu

SEQ ID NO: 43749 - RNA, 20 nt, Artificial Sequence
  Synthetic
gggaaaaaaggggggcgggu

SEQ ID NO: 43750 - RNA, 21 nt, Artificial Sequence
  Synthetic
ggggaaaaaaggggggcgggu

SEQ ID NO: 43751 - RNA, 19 nt, Artificial Sequence
  Synthetic
gucugcaaccaaagguggu

SEQ ID NO: 43752 - RNA, 20 nt, Artificial Sequence
  Synthetic
ggucugcaaccaaagguggu

SEQ ID NO: 43753 - RNA, 21 nt, Artificial Sequence
  Synthetic
gggucugcaaccaaagguggu

SEQ ID NO: 43754 - RNA, 22 nt, Artificial Sequence
  Synthetic
ggggucugcaaccaaagguggu

SEQ ID NO: 43755 - RNA, 18 nt, Artificial Sequence
  Synthetic
gggggcgugucucugugu

SEQ ID NO: 43756 - RNA, 20 nt, Artificial Sequence
  Synthetic
gugggggcgugucucugugu

SEQ ID NO: 43757 - RNA, 23 nt, Artificial Sequence
  Synthetic
guugugggggcgugucucugugu

SEQ ID NO: 43758 - RNA, 18 nt, Artificial Sequence
  Synthetic
gggccauguguauguguu

SEQ ID NO: 43759 - RNA, 19 nt, Artificial Sequence
  Synthetic
ggggccauguguauguguu

SEQ ID NO: 43760 - RNA, 24 nt, Artificial Sequence
  Synthetic
gucuaacguuacacccgaggcggc

SEQ ID NO: 43761 - RNA, 18 nt, Artificial Sequence
  Synthetic
gggcccggcccauugggc

SEQ ID NO: 43762 - RNA, 19 nt, Artificial Sequence
  Synthetic
ggggcccggcccauugggc

SEQ ID NO: 43763 - RNA, 18 nt, Artificial Sequence
  Synthetic
gggggagagggggaacuc

SEQ ID NO: 43764 - RNA, 19 nt, Artificial Sequence
  Synthetic
ggggggagagggggaacuc

SEQ ID NO: 43765 - RNA, 20 nt, Artificial Sequence
  Synthetic
gggggggagagggggaacuc

SEQ ID NO: 43766 - RNA, 21 nt, Artificial Sequence
  Synthetic
ggggggggagagggggaacuc

SEQ ID NO: 43767 - RNA, 22 nt, Artificial Sequence
  Synthetic
gggggggggagagggggaacuc

SEQ ID NO: 43768 - RNA, 24 nt, Artificial Sequence
  Synthetic
gcgggggggggagagggggaacuc

SEQ ID NO: 43769 - RNA, 18 nt, Artificial Sequence
  Synthetic
gggagaagagggaagaag

SEQ ID NO: 43770 - RNA, 20 nt, Artificial Sequence
  Synthetic
gcgggagaagagggaagaag

SEQ ID NO: 43771 - RNA, 21 nt, Artificial Sequence
  Synthetic
ggcgggagaagagggaagaag

SEQ ID NO: 43772 - RNA, 22 nt, Artificial Sequence
  Synthetic
gggcgggagaagagggaagaag

SEQ ID NO: 43773 - RNA, 24 nt, Artificial Sequence
  Synthetic
gagggcgggagaagagggaagaag

SEQ ID NO: 43774 - RNA, 20 nt, Artificial Sequence
  Synthetic
gcccggccaaccagcguccg

SEQ ID NO: 43775 - RNA, 21 nt, Artificial Sequence
  Synthetic
ggcccggccaaccagcguccg

SEQ ID NO: 43776 - RNA, 22 nt, Artificial Sequence
  Synthetic
gggcccggccaaccagcguccg

SEQ ID NO: 43777 - RNA, 23 nt, Artificial Sequence
  Synthetic
ggggcccggccaaccagcguccg

SEQ ID NO: 43778 - RNA, 20 nt, Artificial Sequence
  Synthetic
gaccgggcucgguuccggcg

SEQ ID NO: 43779 - RNA, 23 nt, Artificial Sequence
  Synthetic
gccgaccgggcucgguuccggcg

SEQ ID NO: 43780 - RNA, 24 nt, Artificial Sequence
  Synthetic
ggccgaccgggcucgguuccggcg

SEQ ID NO: 43781 - RNA, 20 nt, Artificial Sequence
  Synthetic
gaagagggaagaagaggggu

SEQ ID NO: 43782 - RNA, 22 nt, Artificial Sequence
  Synthetic
gagaagagggaagaagaggggu

SEQ ID NO: 43783 - RNA, 23 nt, Artificial Sequence
  Synthetic
ggagaagagggaagaagaggggu

SEQ ID NO: 43784 - RNA, 24 nt, Artificial Sequence
  Synthetic
gggagaagagggaagaagaggggu

SEQ ID NO: 43785 - RNA, 18 nt, Artificial Sequence
  Synthetic
ucggaagaggggggagaa

SEQ ID NO: 43786 - RNA, 19 nt, Artificial Sequence
  Synthetic
cucggaagaggggggagaa

SEQ ID NO: 43787 - RNA, 20 nt, Artificial Sequence
  Synthetic
ccucggaagaggggggagaa

SEQ ID NO: 43788 - RNA, 23 nt, Artificial Sequence
  Synthetic
uggccucggaagaggggggagaa

SEQ ID NO: 43789 - RNA, 24 nt, Artificial Sequence
  Synthetic
cuggccucggaagaggggggagaa

SEQ ID NO: 43790 - RNA, 19 nt, Artificial Sequence
  Synthetic
ugucucuguguaugaguca

SEQ ID NO: 43791 - RNA, 21 nt, Artificial Sequence
  Synthetic
cgugucucuguguaugaguca

SEQ ID NO: 43792 - RNA, 18 nt, Artificial Sequence
  Synthetic
cucggguguaacguuaga

SEQ ID NO: 43793 - RNA, 19 nt, Artificial Sequence
  Synthetic
ccucggguguaacguuaga

SEQ ID NO: 43794 - RNA, 21 nt, Artificial Sequence
  Synthetic
cgccucggguguaacguuaga

SEQ ID NO: 43795 - RNA, 22 nt, Artificial Sequence
  Synthetic
ccgccucggguguaacguuaga

SEQ ID NO: 43796 - RNA, 19 nt, Artificial Sequence
  Synthetic
cggccggggccgcccauua

SEQ ID NO: 43797 - RNA, 18 nt, Artificial Sequence
  Synthetic
cccgcccuccagacgcac

SEQ ID NO: 43798 - RNA, 19 nt, Artificial Sequence
  Synthetic
ucccgcccuccagacgcac

SEQ ID NO: 43799 - RNA, 20 nt, Artificial Sequence
  Synthetic
cucccgcccuccagacgcac

SEQ ID NO: 43800 - RNA, 21 nt, Artificial Sequence
  Synthetic
ucucccgcccuccagacgcac

SEQ ID NO: 43801 - RNA, 22 nt, Artificial Sequence
  Synthetic
uucucccgcccuccagacgcac

SEQ ID NO: 43802 - RNA, 23 nt, Artificial Sequence
  Synthetic
cuucucccgcccuccagacgcac

SEQ ID NO: 43803 - RNA, 24 nt, Artificial Sequence
  Synthetic
ucuucucccgcccuccagacgcac

SEQ ID NO: 43804 - RNA, 18 nt, Artificial Sequence
  Synthetic
ccgcgucaaucagcaccc

SEQ ID NO: 43805 - RNA, 19 nt, Artificial Sequence
  Synthetic
cccgcgucaaucagcaccc

SEQ ID NO: 43806 - RNA, 20 nt, Artificial Sequence
  Synthetic
ucccgcgucaaucagcaccc

SEQ ID NO: 43807 - RNA, 21 nt, Artificial Sequence
  Synthetic
uucccgcgucaaucagcaccc

SEQ ID NO: 43808 - RNA, 22 nt, Artificial Sequence
  Synthetic
uuucccgcgucaaucagcaccc

SEQ ID NO: 43809 - RNA, 23 nt, Artificial Sequence
  Synthetic
auuucccgcgucaaucagcaccc

SEQ ID NO: 43810 - RNA, 18 nt, Artificial Sequence
  Synthetic
cggaagacccaggccgcc

SEQ ID NO: 43811 - RNA, 20 nt, Artificial Sequence
  Synthetic
cgcggaagacccaggccgcc

SEQ ID NO: 43812 - RNA, 21 nt, Artificial Sequence
  Synthetic
ccgcggaagacccaggccgcc

SEQ ID NO: 43813 - RNA, 22 nt, Artificial Sequence
  Synthetic
uccgcggaagacccaggccgcc

SEQ ID NO: 43814 - RNA, 23 nt, Artificial Sequence
  Synthetic
cuccgcggaagacccaggccgcc

SEQ ID NO: 43815 - RNA, 18 nt, Artificial Sequence
  Synthetic
uccagacgcaccggaguc

SEQ ID NO: 43816 - RNA, 19 nt, Artificial Sequence
  Synthetic
cuccagacgcaccggaguc

SEQ ID NO: 43817 - RNA, 20 nt, Artificial Sequence
  Synthetic
ccuccagacgcaccggaguc

SEQ ID NO: 43818 - RNA, 21 nt, Artificial Sequence
  Synthetic
cccuccagacgcaccggaguc

SEQ ID NO: 43819 - RNA, 23 nt, Artificial Sequence
  Synthetic
cgcccuccagacgcaccggaguc

SEQ ID NO: 43820 - RNA, 24 nt, Artificial Sequence
  Synthetic
ccgcccuccagacgcaccggaguc

SEQ ID NO: 43821 - RNA, 18 nt, Artificial Sequence
  Synthetic
uaaggggaaaaaaggggg

SEQ ID NO: 43822 - RNA, 19 nt, Artificial Sequence
  Synthetic
cuaaggggaaaaaaggggg

SEQ ID NO: 43823 - RNA, 23 nt, Artificial Sequence
  Synthetic
cgggcuaaggggaaaaaaggggg

SEQ ID NO: 43824 - RNA, 22 nt, Artificial Sequence
  Synthetic
aggggggcggguaagaaugggg

SEQ ID NO: 43825 - RNA, 23 nt, Artificial Sequence
  Synthetic
aaggggggcggguaagaaugggg

SEQ ID NO: 43826 - RNA, 24 nt, Artificial Sequence
  Synthetic
aaaggggggcggguaagaaugggg

SEQ ID NO: 43827 - RNA, 20 nt, Artificial Sequence
  Synthetic
agguggucuggguccguccu

SEQ ID NO: 43828 - RNA, 21 nt, Artificial Sequence
  Synthetic
aagguggucuggguccguccu

SEQ ID NO: 43829 - RNA, 22 nt, Artificial Sequence
  Synthetic
aaagguggucuggguccguccu

SEQ ID NO: 43830 - RNA, 23 nt, Artificial Sequence
  Synthetic
caaagguggucuggguccguccu

SEQ ID NO: 43831 - RNA, 24 nt, Artificial Sequence
  Synthetic
ccaaagguggucuggguccguccu

SEQ ID NO: 43832 - RNA, 18 nt, Artificial Sequence
  Synthetic
ccaccccccuagaugcgu

SEQ ID NO: 43833 - RNA, 19 nt, Artificial Sequence
  Synthetic
cccaccccccuagaugcgu

SEQ ID NO: 43834 - RNA, 20 nt, Artificial Sequence
  Synthetic
ccccaccccccuagaugcgu

SEQ ID NO: 43835 - RNA, 21 nt, Artificial Sequence
  Synthetic
uccccaccccccuagaugcgu

SEQ ID NO: 43836 - RNA, 22 nt, Artificial Sequence
  Synthetic
cuccccaccccccuagaugcgu

SEQ ID NO: 43837 - RNA, 23 nt, Artificial Sequence
  Synthetic
ccuccccaccccccuagaugcgu

SEQ ID NO: 43838 - RNA, 24 nt, Artificial Sequence
  Synthetic
uccuccccaccccccuagaugcgu

SEQ ID NO: 43839 - RNA, 18 nt, Artificial Sequence
  Synthetic
cgaccccgggcccugcgu

SEQ ID NO: 43840 - RNA, 21 nt, Artificial Sequence
  Synthetic
cggcgaccccgggcccugcgu

SEQ ID NO: 43841 - RNA, 22 nt, Artificial Sequence
  Synthetic
acggcgaccccgggcccugcgu

SEQ ID NO: 43842 - RNA, 23 nt, Artificial Sequence
  Synthetic
cacggcgaccccgggcccugcgu

SEQ ID NO: 43843 - RNA, 24 nt, Artificial Sequence
  Synthetic
ccacggcgaccccgggcccugcgu

SEQ ID NO: 43844 - RNA, 18 nt, Artificial Sequence
  Synthetic
aguaaggggggccugcgu

SEQ ID NO: 43845 - RNA, 20 nt, Artificial Sequence
  Synthetic
ugaguaaggggggccugcgu

SEQ ID NO: 43846 - RNA, 22 nt, Artificial Sequence
  Synthetic
ugugaguaaggggggccugcgu

SEQ ID NO: 43847 - RNA, 24 nt, Artificial Sequence
  Synthetic
cgugugaguaaggggggccugcgu

SEQ ID NO: 43848 - RNA, 22 nt, Artificial Sequence
  Synthetic
aggggaaaaaaggggggcgggu

SEQ ID NO: 43849 - RNA, 23 nt, Artificial Sequence
  Synthetic
aaggggaaaaaaggggggcgggu

SEQ ID NO: 43850 - RNA, 24 nt, Artificial Sequence
  Synthetic
uaaggggaaaaaaggggggcgggu

SEQ ID NO: 43851 - RNA, 18 nt, Artificial Sequence
  Synthetic
ucugcaaccaaagguggu

SEQ ID NO: 43852 - RNA, 23 nt, Artificial Sequence
  Synthetic
aggggucugcaaccaaagguggu

SEQ ID NO: 43853 - RNA, 24 nt, Artificial Sequence
  Synthetic
aaggggucugcaaccaaagguggu

SEQ ID NO: 43854 - RNA, 19 nt, Artificial Sequence
  Synthetic
ugggggcgugucucugugu

SEQ ID NO: 43855 - RNA, 21 nt, Artificial Sequence
  Synthetic
ugugggggcgugucucugugu

SEQ ID NO: 43856 - RNA, 22 nt, Artificial Sequence
  Synthetic
uugugggggcgugucucugugu

SEQ ID NO: 43857 - RNA, 24 nt, Artificial Sequence
  Synthetic
uguugugggggcgugucucugugu

SEQ ID NO: 43858 - RNA, 20 nt, Artificial Sequence
  Synthetic
aggggccauguguauguguu

SEQ ID NO: 43859 - RNA, 21 nt, Artificial Sequence
  Synthetic
aaggggccauguguauguguu

SEQ ID NO: 43860 - RNA, 22 nt, Artificial Sequence
  Synthetic
aaaggggccauguguauguguu

SEQ ID NO: 43861 - RNA, 23 nt, Artificial Sequence
  Synthetic
caaaggggccauguguauguguu

SEQ ID NO: 43862 - RNA, 24 nt, Artificial Sequence
  Synthetic
ucaaaggggccauguguauguguu

SEQ ID NO: 43863 - RNA, 18 nt, Artificial Sequence
  Synthetic
caacaaacacacaaggac

SEQ ID NO: 43864 - RNA, 19 nt, Artificial Sequence
  Synthetic
acaacaaacacacaaggac

SEQ ID NO: 43865 - RNA, 20 nt, Artificial Sequence
  Synthetic
cacaacaaacacacaaggac

SEQ ID NO: 43866 - RNA, 21 nt, Artificial Sequence
  Synthetic
ccacaacaaacacacaaggac

SEQ ID NO: 43867 - RNA, 22 nt, Artificial Sequence
  Synthetic
cccacaacaaacacacaaggac

SEQ ID NO: 43868 - RNA, 23 nt, Artificial Sequence
  Synthetic
ccccacaacaaacacacaaggac

SEQ ID NO: 43869 - RNA, 24 nt, Artificial Sequence
  Synthetic
cccccacaacaaacacacaaggac

SEQ ID NO: 43870 - RNA, 18 nt, Artificial Sequence
  Synthetic
uuuuccccuuagcccgcc

SEQ ID NO: 43871 - RNA, 19 nt, Artificial Sequence
  Synthetic
uuuuuccccuuagcccgcc

SEQ ID NO: 43872 - RNA, 20 nt, Artificial Sequence
  Synthetic
uuuuuuccccuuagcccgcc

SEQ ID NO: 43873 - RNA, 21 nt, Artificial Sequence
  Synthetic
cuuuuuuccccuuagcccgcc

SEQ ID NO: 43874 - RNA, 22 nt, Artificial Sequence
  Synthetic
ccuuuuuuccccuuagcccgcc

SEQ ID NO: 43875 - RNA, 23 nt, Artificial Sequence
  Synthetic
cccuuuuuuccccuuagcccgcc

SEQ ID NO: 43876 - RNA, 24 nt, Artificial Sequence
  Synthetic
ccccuuuuuuccccuuagcccgcc

SEQ ID NO: 43877 - RNA, 18 nt, Artificial Sequence
  Synthetic
ugacucagacgcagggcc

SEQ ID NO: 43878 - RNA, 19 nt, Artificial Sequence
  Synthetic
uugacucagacgcagggcc

SEQ ID NO: 43879 - RNA, 20 nt, Artificial Sequence
  Synthetic
uuugacucagacgcagggcc

SEQ ID NO: 43880 - RNA, 21 nt, Artificial Sequence
  Synthetic
cuuugacucagacgcagggcc

SEQ ID NO: 43881 - RNA, 22 nt, Artificial Sequence
  Synthetic
ccuuugacucagacgcagggcc

SEQ ID NO: 43882 - RNA, 23 nt, Artificial Sequence
  Synthetic
cccuuugacucagacgcagggcc

SEQ ID NO: 43883 - RNA, 24 nt, Artificial Sequence
  Synthetic
ccccuuugacucagacgcagggcc

SEQ ID NO: 43884 - RNA, 18 nt, Artificial Sequence
  Synthetic
cguuacacccgaggcggc

SEQ ID NO: 43885 - RNA, 19 nt, Artificial Sequence
  Synthetic
acguuacacccgaggcggc

SEQ ID NO: 43886 - RNA, 20 nt, Artificial Sequence
  Synthetic
aacguuacacccgaggcggc

SEQ ID NO: 43887 - RNA, 21 nt, Artificial Sequence
  Synthetic
uaacguuacacccgaggcggc

SEQ ID NO: 43888 - RNA, 22 nt, Artificial Sequence
  Synthetic
cuaacguuacacccgaggcggc

SEQ ID NO: 43889 - RNA, 23 nt, Artificial Sequence
  Synthetic
ucuaacguuacacccgaggcggc

SEQ ID NO: 43890 - RNA, 20 nt, Artificial Sequence
  Synthetic
cggggcccggcccauugggc

SEQ ID NO: 43891 - RNA, 21 nt, Artificial Sequence
  Synthetic
ucggggcccggcccauugggc

SEQ ID NO: 43892 - RNA, 22 nt, Artificial Sequence
  Synthetic
uucggggcccggcccauugggc

SEQ ID NO: 43893 - RNA, 23 nt, Artificial Sequence
  Synthetic
cuucggggcccggcccauugggc

SEQ ID NO: 43894 - RNA, 24 nt, Artificial Sequence
  Synthetic
ucuucggggcccggcccauugggc

SEQ ID NO: 43895 - RNA, 23 nt, Artificial Sequence
  Synthetic
cgggggggggagagggggaacuc

SEQ ID NO: 43896 - RNA, 19 nt, Artificial Sequence
  Synthetic
cgggagaagagggaagaag

SEQ ID NO: 43897 - RNA, 23 nt, Artificial Sequence
  Synthetic
agggcgggagaagagggaagaag

SEQ ID NO: 43898 - RNA, 18 nt, Artificial Sequence
  Synthetic
uuacucacacgcaucuag

SEQ ID NO: 43899 - RNA, 19 nt, Artificial Sequence
  Synthetic
cuuacucacacgcaucuag

SEQ ID NO: 43900 - RNA, 20 nt, Artificial Sequence
  Synthetic
ccuuacucacacgcaucuag

SEQ ID NO: 43901 - RNA, 21 nt, Artificial Sequence
  Synthetic
cccuuacucacacgcaucuag

SEQ ID NO: 43902 - RNA, 22 nt, Artificial Sequence
  Synthetic
ccccuuacucacacgcaucuag

SEQ ID NO: 43903 - RNA, 23 nt, Artificial Sequence
  Synthetic
cccccuuacucacacgcaucuag

SEQ ID NO: 43904 - RNA, 24 nt, Artificial Sequence
  Synthetic
ccccccuuacucacacgcaucuag

SEQ ID NO: 43905 - RNA, 18 nt, Artificial Sequence
  Synthetic
ccggccaaccagcguccg

SEQ ID NO: 43906 - RNA, 19 nt, Artificial Sequence
  Synthetic
cccggccaaccagcguccg

SEQ ID NO: 43907 - RNA, 24 nt, Artificial Sequence
  Synthetic
cggggcccggccaaccagcguccg

SEQ ID NO: 43908 - RNA, 18 nt, Artificial Sequence
  Synthetic
ccgggcucgguuccggcg

SEQ ID NO: 43909 - RNA, 19 nt, Artificial Sequence
  Synthetic
accgggcucgguuccggcg

SEQ ID NO: 43910 - RNA, 21 nt, Artificial Sequence
  Synthetic
cgaccgggcucgguuccggcg

SEQ ID NO: 43911 - RNA, 22 nt, Artificial Sequence
  Synthetic
ccgaccgggcucgguuccggcg

SEQ ID NO: 43912 - RNA, 18 nt, Artificial Sequence
  Synthetic
agagggaagaagaggggu

SEQ ID NO: 43913 - RNA, 19 nt, Artificial Sequence
  Synthetic
aagagggaagaagaggggu

SEQ ID NO: 43914 - RNA, 21 nt, Artificial Sequence
  Synthetic
agaagagggaagaagaggggu

SEQ ID NO: 43915 - RNA, 18 nt, Artificial Sequence
  Synthetic
uuagcccgccccggaugu

SEQ ID NO: 43916 - RNA, 19 nt, Artificial Sequence
  Synthetic
cuuagcccgccccggaugu

SEQ ID NO: 43917 - RNA, 20 nt, Artificial Sequence
  Synthetic
ccuuagcccgccccggaugu

SEQ ID NO: 43918 - RNA, 21 nt, Artificial Sequence
  Synthetic
cccuuagcccgccccggaugu

SEQ ID NO: 43919 - RNA, 22 nt, Artificial Sequence
  Synthetic
ccccuuagcccgccccggaugu

SEQ ID NO: 43920 - RNA, 23 nt, Artificial Sequence
  Synthetic
uccccuuagcccgccccggaugu

SEQ ID NO: 43921 - RNA, 24 nt, Artificial Sequence
  Synthetic
uuccccuuagcccgccccggaugu

SEQ ID NO: 43922 - RNA, 18 nt, Artificial Sequence
  Synthetic
cgggcuaaggggaaaaaa

SEQ ID NO: 43923 - RNA, 19 nt, Artificial Sequence
  Synthetic
gcgggcuaaggggaaaaaa

SEQ ID NO: 43924 - RNA, 20 nt, Artificial Sequence
  Synthetic
ggcgggcuaaggggaaaaaa

SEQ ID NO: 43925 - RNA, 21 nt, Artificial Sequence
  Synthetic
gggcgggcuaaggggaaaaaa

SEQ ID NO: 43926 - RNA, 22 nt, Artificial Sequence
  Synthetic
ggggcgggcuaaggggaaaaaa

SEQ ID NO: 43927 - RNA, 23 nt, Artificial Sequence
  Synthetic
cggggcgggcuaaggggaaaaaa

SEQ ID NO: 43928 - RNA, 24 nt, Artificial Sequence
  Synthetic
ccggggcgggcuaaggggaaaaaa

SEQ ID NO: 43929 - RNA, 18 nt, Artificial Sequence
  Synthetic
gcgggcuaaggggaaaaa

SEQ ID NO: 43930 - RNA, 19 nt, Artificial Sequence
  Synthetic
ggcgggcuaaggggaaaaa

SEQ ID NO: 43931 - RNA, 20 nt, Artificial Sequence
  Synthetic
gggcgggcuaaggggaaaaa

SEQ ID NO: 43932 - RNA, 21 nt, Artificial Sequence
  Synthetic
ggggcgggcuaaggggaaaaa

SEQ ID NO: 43933 - RNA, 22 nt, Artificial Sequence
  Synthetic
cggggcgggcuaaggggaaaaa

SEQ ID NO: 43934 - RNA, 23 nt, Artificial Sequence
  Synthetic
ccggggcgggcuaaggggaaaaa

SEQ ID NO: 43935 - RNA, 24 nt, Artificial Sequence
  Synthetic
uccggggcgggcuaaggggaaaaa

SEQ ID NO: 43936 - RNA, 18 nt, Artificial Sequence
  Synthetic
ggcgggcuaaggggaaaa

SEQ ID NO: 43937 - RNA, 19 nt, Artificial Sequence
  Synthetic
gggcgggcuaaggggaaaa

SEQ ID NO: 43938 - RNA, 20 nt, Artificial Sequence
  Synthetic
ggggcgggcuaaggggaaaa

SEQ ID NO: 43939 - RNA, 21 nt, Artificial Sequence
  Synthetic
cggggcgggcuaaggggaaaa

SEQ ID NO: 43940 - RNA, 22 nt, Artificial Sequence
  Synthetic
ccggggcgggcuaaggggaaaa

SEQ ID NO: 43941 - RNA, 23 nt, Artificial Sequence
  Synthetic
uccggggcgggcuaaggggaaaa

SEQ ID NO: 43942 - RNA, 24 nt, Artificial Sequence
  Synthetic
auccggggcgggcuaaggggaaaa

SEQ ID NO: 43943 - RNA, 18 nt, Artificial Sequence
  Synthetic
gcccugcgucugagucaa

SEQ ID NO: 43944 - RNA, 19 nt, Artificial Sequence
  Synthetic
ggcccugcgucugagucaa

SEQ ID NO: 43945 - RNA, 20 nt, Artificial Sequence
  Synthetic
gggcccugcgucugagucaa

SEQ ID NO: 43946 - RNA, 21 nt, Artificial Sequence
  Synthetic
cgggcccugcgucugagucaa

SEQ ID NO: 43947 - RNA, 22 nt, Artificial Sequence
  Synthetic
ccgggcccugcgucugagucaa

SEQ ID NO: 43948 - RNA, 23 nt, Artificial Sequence
  Synthetic
cccgggcccugcgucugagucaa

SEQ ID NO: 43949 - RNA, 24 nt, Artificial Sequence
  Synthetic
ccccgggcccugcgucugagucaa

SEQ ID NO: 43950 - RNA, 18 nt, Artificial Sequence
  Synthetic
aaggggggcggguaagaa

SEQ ID NO: 43951 - RNA, 19 nt, Artificial Sequence
  Synthetic
aaaggggggcggguaagaa

SEQ ID NO: 43952 - RNA, 20 nt, Artificial Sequence
  Synthetic
aaaaggggggcggguaagaa

SEQ ID NO: 43953 - RNA, 21 nt, Artificial Sequence
  Synthetic
aaaaaggggggcggguaagaa

SEQ ID NO: 43954 - RNA, 22 nt, Artificial Sequence
  Synthetic
aaaaaaggggggcggguaagaa

SEQ ID NO: 43955 - RNA, 23 nt, Artificial Sequence
  Synthetic
gaaaaaaggggggcggguaagaa

SEQ ID NO: 43956 - RNA, 24 nt, Artificial Sequence
  Synthetic
ggaaaaaaggggggcggguaagaa

SEQ ID NO: 43957 - RNA, 18 nt, Artificial Sequence
  Synthetic
cgccacccggcgccggaa

SEQ ID NO: 43958 - RNA, 19 nt, Artificial Sequence
  Synthetic
ccgccacccggcgccggaa

SEQ ID NO: 43959 - RNA, 20 nt, Artificial Sequence
  Synthetic
uccgccacccggcgccggaa

SEQ ID NO: 43960 - RNA, 21 nt, Artificial Sequence
  Synthetic
cuccgccacccggcgccggaa

SEQ ID NO: 43961 - RNA, 22 nt, Artificial Sequence
  Synthetic
ccuccgccacccggcgccggaa

SEQ ID NO: 43962 - RNA, 23 nt, Artificial Sequence
  Synthetic
gccuccgccacccggcgccggaa

SEQ ID NO: 43963 - RNA, 24 nt, Artificial Sequence
  Synthetic
ggccuccgccacccggcgccggaa

SEQ ID NO: 43964 - RNA, 18 nt, Artificial Sequence
  Synthetic
ccccugcuggccucggaa

SEQ ID NO: 43965 - RNA, 19 nt, Artificial Sequence
  Synthetic
cccccugcuggccucggaa

SEQ ID NO: 43966 - RNA, 20 nt, Artificial Sequence
  Synthetic
ccccccugcuggccucggaa

SEQ ID NO: 43967 - RNA, 21 nt, Artificial Sequence
  Synthetic
gccccccugcuggccucggaa

SEQ ID NO: 43968 - RNA, 22 nt, Artificial Sequence
  Synthetic
ugccccccugcuggccucggaa

SEQ ID NO: 43969 - RNA, 23 nt, Artificial Sequence
  Synthetic
cugccccccugcuggccucggaa

SEQ ID NO: 43970 - RNA, 24 nt, Artificial Sequence
  Synthetic
ccugccccccugcuggccucggaa

SEQ ID NO: 43971 - RNA, 18 nt, Artificial Sequence
  Synthetic
uaauuaccauaccgggaa

SEQ ID NO: 43972 - RNA, 19 nt, Artificial Sequence
  Synthetic
cuaauuaccauaccgggaa

SEQ ID NO: 43973 - RNA, 20 nt, Artificial Sequence
  Synthetic
ucuaauuaccauaccgggaa

SEQ ID NO: 43974 - RNA, 21 nt, Artificial Sequence
  Synthetic
uucuaauuaccauaccgggaa

SEQ ID NO: 43975 - RNA, 22 nt, Artificial Sequence
  Synthetic
uuucuaauuaccauaccgggaa

SEQ ID NO: 43976 - RNA, 23 nt, Artificial Sequence
  Synthetic
guuucuaauuaccauaccgggaa

SEQ ID NO: 43977 - RNA, 24 nt, Artificial Sequence
  Synthetic
aguuucuaauuaccauaccgggaa

SEQ ID NO: 43978 - RNA, 19 nt, Artificial Sequence
  Synthetic
uuaauuaccauaccgggaa

SEQ ID NO: 43979 - RNA, 20 nt, Artificial Sequence
  Synthetic
uuuaauuaccauaccgggaa

SEQ ID NO: 43980 - RNA, 21 nt, Artificial Sequence
  Synthetic
uuuuaauuaccauaccgggaa

SEQ ID NO: 43981 - RNA, 22 nt, Artificial Sequence
  Synthetic
uuuuuaauuaccauaccgggaa

SEQ ID NO: 43982 - RNA, 23 nt, Artificial Sequence
  Synthetic
guuuuuaauuaccauaccgggaa

SEQ ID NO: 43983 - RNA, 24 nt, Artificial Sequence
  Synthetic
aguuuuuaauuaccauaccgggaa

SEQ ID NO: 43984 - RNA, 18 nt, Artificial Sequence
  Synthetic
acauccggggcgggcuaa

SEQ ID NO: 43985 - RNA, 19 nt, Artificial Sequence
  Synthetic
gacauccggggcgggcuaa

SEQ ID NO: 43986 - RNA, 20 nt, Artificial Sequence
  Synthetic
agacauccggggcgggcuaa

SEQ ID NO: 43987 - RNA, 21 nt, Artificial Sequence
  Synthetic
cagacauccggggcgggcuaa

SEQ ID NO: 43988 - RNA, 22 nt, Artificial Sequence
  Synthetic
ccagacauccggggcgggcuaa

SEQ ID NO: 43989 - RNA, 23 nt, Artificial Sequence
  Synthetic
cccagacauccggggcgggcuaa

SEQ ID NO: 43990 - RNA, 24 nt, Artificial Sequence
  Synthetic
acccagacauccggggcgggcuaa

SEQ ID NO: 43991 - RNA, 18 nt, Artificial Sequence
  Synthetic
cuagaugcgugugaguaa

SEQ ID NO: 43992 - RNA, 19 nt, Artificial Sequence
  Synthetic
ccuagaugcgugugaguaa

SEQ ID NO: 43993 - RNA, 20 nt, Artificial Sequence
  Synthetic
cccuagaugcgugugaguaa

SEQ ID NO: 43994 - RNA, 21 nt, Artificial Sequence
  Synthetic
ccccuagaugcgugugaguaa

SEQ ID NO: 43995 - RNA, 22 nt, Artificial Sequence
  Synthetic
cccccuagaugcgugugaguaa

SEQ ID NO: 43996 - RNA, 23 nt, Artificial Sequence
  Synthetic
ccccccuagaugcgugugaguaa

SEQ ID NO: 43997 - RNA, 24 nt, Artificial Sequence
  Synthetic
accccccuagaugcgugugaguaa

SEQ ID NO: 43998 - RNA, 18 nt, Artificial Sequence
  Synthetic
ggcgguaacucccgccca

SEQ ID NO: 43999 - RNA, 19 nt, Artificial Sequence
  Synthetic
gggcgguaacucccgccca

SEQ ID NO: 44000 - RNA, 20 nt, Artificial Sequence
  Synthetic
ugggcgguaacucccgccca

SEQ ID NO: 44001 - RNA, 21 nt, Artificial Sequence
  Synthetic
uugggcgguaacucccgccca

SEQ ID NO: 44002 - RNA, 22 nt, Artificial Sequence
  Synthetic
auugggcgguaacucccgccca

SEQ ID NO: 44003 - RNA, 23 nt, Artificial Sequence
  Synthetic
cauugggcgguaacucccgccca

SEQ ID NO: 44004 - RNA, 24 nt, Artificial Sequence
  Synthetic
ccauugggcgguaacucccgccca

SEQ ID NO: 44005 - RNA, 18 nt, Artificial Sequence
  Synthetic
agugggcggcccggccca

SEQ ID NO: 44006 - RNA, 19 nt, Artificial Sequence
  Synthetic
aagugggcggcccggccca

SEQ ID NO: 44007 - RNA, 20 nt, Artificial Sequence
  Synthetic
gaagugggcggcccggccca

SEQ ID NO: 44008 - RNA, 21 nt, Artificial Sequence
  Synthetic
ggaagugggcggcccggccca

SEQ ID NO: 44009 - RNA, 22 nt, Artificial Sequence
  Synthetic
gggaagugggcggcccggccca

SEQ ID NO: 44010 - RNA, 23 nt, Artificial Sequence
  Synthetic
cgggaagugggcggcccggccca

SEQ ID NO: 44011 - RNA, 24 nt, Artificial Sequence
  Synthetic
ccgggaagugggcggcccggccca

SEQ ID NO: 44012 - RNA, 18 nt, Artificial Sequence
  Synthetic
ucccgcccuccagacgca

SEQ ID NO: 44013 - RNA, 19 nt, Artificial Sequence
  Synthetic
cucccgcccuccagacgca

SEQ ID NO: 44014 - RNA, 20 nt, Artificial Sequence
  Synthetic
ucucccgcccuccagacgca

SEQ ID NO: 44015 - RNA, 21 nt, Artificial Sequence
  Synthetic
uucucccgcccuccagacgca

SEQ ID NO: 44016 - RNA, 22 nt, Artificial Sequence
  Synthetic
cuucucccgcccuccagacgca

SEQ ID NO: 44017 - RNA, 23 nt, Artificial Sequence
  Synthetic
ucuucucccgcccuccagacgca

SEQ ID NO: 44018 - RNA, 24 nt, Artificial Sequence
  Synthetic
cucuucucccgcccuccagacgca

SEQ ID NO: 44019 - RNA, 18 nt, Artificial Sequence
  Synthetic
gggccugcguaugaguca

SEQ ID NO: 44020 - RNA, 19 nt, Artificial Sequence
  Synthetic
ggggccugcguaugaguca

SEQ ID NO: 44021 - RNA, 20 nt, Artificial Sequence
  Synthetic
gggggccugcguaugaguca

SEQ ID NO: 44022 - RNA, 21 nt, Artificial Sequence
  Synthetic
ggggggccugcguaugaguca

SEQ ID NO: 44023 - RNA, 22 nt, Artificial Sequence
  Synthetic
aggggggccugcguaugaguca

SEQ ID NO: 44024 - RNA, 23 nt, Artificial Sequence
  Synthetic
aaggggggccugcguaugaguca

SEQ ID NO: 44025 - RNA, 24 nt, Artificial Sequence
  Synthetic
uaaggggggccugcguaugaguca

SEQ ID NO: 44026 - RNA, 18 nt, Artificial Sequence
  Synthetic
ggcccugcgucugaguca

SEQ ID NO: 44027 - RNA, 19 nt, Artificial Sequence
  Synthetic
gggcccugcgucugaguca

SEQ ID NO: 44028 - RNA, 20 nt, Artificial Sequence
  Synthetic
cgggcccugcgucugaguca

SEQ ID NO: 44029 - RNA, 21 nt, Artificial Sequence
  Synthetic
ccgggcccugcgucugaguca

SEQ ID NO: 44030 - RNA, 22 nt, Artificial Sequence
  Synthetic
cccgggcccugcgucugaguca

SEQ ID NO: 44031 - RNA, 23 nt, Artificial Sequence
  Synthetic
ccccgggcccugcgucugaguca

SEQ ID NO: 44032 - RNA, 24 nt, Artificial Sequence
  Synthetic
accccgggcccugcgucugaguca

SEQ ID NO: 44033 - RNA, 18 nt, Artificial Sequence
  Synthetic
ccugcuggccucggaaga

SEQ ID NO: 44034 - RNA, 19 nt, Artificial Sequence
  Synthetic
cccugcuggccucggaaga

SEQ ID NO: 44035 - RNA, 20 nt, Artificial Sequence
  Synthetic
ccccugcuggccucggaaga

SEQ ID NO: 44036 - RNA, 21 nt, Artificial Sequence
  Synthetic
cccccugcuggccucggaaga

SEQ ID NO: 44037 - RNA, 22 nt, Artificial Sequence
  Synthetic
ccccccugcuggccucggaaga

SEQ ID NO: 44038 - RNA, 23 nt, Artificial Sequence
  Synthetic
gccccccugcuggccucggaaga

SEQ ID NO: 44039 - RNA, 24 nt, Artificial Sequence
  Synthetic
ugccccccugcuggccucggaaga

SEQ ID NO: 44040 - RNA, 18 nt, Artificial Sequence
  Synthetic
aaaggggggcggguaaga

SEQ ID NO: 44041 - RNA, 19 nt, Artificial Sequence
  Synthetic
aaaaggggggcggguaaga

SEQ ID NO: 44042 - RNA, 20 nt, Artificial Sequence
  Synthetic
aaaaaggggggcggguaaga

SEQ ID NO: 44043 - RNA, 21 nt, Artificial Sequence
  Synthetic
aaaaaaggggggcggguaaga

SEQ ID NO: 44044 - RNA, 22 nt, Artificial Sequence
  Synthetic
gaaaaaaggggggcggguaaga

SEQ ID NO: 44045 - RNA, 23 nt, Artificial Sequence
  Synthetic
ggaaaaaaggggggcggguaaga

SEQ ID NO: 44046 - RNA, 24 nt, Artificial Sequence
  Synthetic
gggaaaaaaggggggcggguaaga

SEQ ID NO: 44047 - RNA, 18 nt, Artificial Sequence
  Synthetic
cucggaagaggggggaga

SEQ ID NO: 44048 - RNA, 19 nt, Artificial Sequence
  Synthetic
ccucggaagaggggggaga

SEQ ID NO: 44049 - RNA, 20 nt, Artificial Sequence
  Synthetic
gccucggaagaggggggaga

SEQ ID NO: 44050 - RNA, 21 nt, Artificial Sequence
  Synthetic
ggccucggaagaggggggaga

SEQ ID NO: 44051 - RNA, 22 nt, Artificial Sequence
  Synthetic
uggccucggaagaggggggaga

SEQ ID NO: 44052 - RNA, 23 nt, Artificial Sequence
  Synthetic
cuggccucggaagaggggggaga

SEQ ID NO: 44053 - RNA, 24 nt, Artificial Sequence
  Synthetic
gcuggccucggaagaggggggaga

SEQ ID NO: 44054 - RNA, 18 nt, Artificial Sequence
  Synthetic
gaguuucuaauuaccaua

SEQ ID NO: 44055 - RNA, 19 nt, Artificial Sequence
  Synthetic
ugaguuucuaauuaccaua

SEQ ID NO: 44056 - RNA, 20 nt, Artificial Sequence
  Synthetic
augaguuucuaauuaccaua

SEQ ID NO: 44057 - RNA, 21 nt, Artificial Sequence
  Synthetic
aaugaguuucuaauuaccaua

SEQ ID NO: 44058 - RNA, 22 nt, Artificial Sequence
  Synthetic
uaaugaguuucuaauuaccaua

SEQ ID NO: 44059 - RNA, 23 nt, Artificial Sequence
  Synthetic
uuaaugaguuucuaauuaccaua

SEQ ID NO: 44060 - RNA, 24 nt, Artificial Sequence
  Synthetic
auuaaugaguuucuaauuaccaua

SEQ ID NO: 44061 - RNA, 18 nt, Artificial Sequence
  Synthetic
aaguuuuuaauuaccaua

SEQ ID NO: 44062 - RNA, 19 nt, Artificial Sequence
  Synthetic
caaguuuuuaauuaccaua

SEQ ID NO: 44063 - RNA, 20 nt, Artificial Sequence
  Synthetic
gcaaguuuuuaauuaccaua

SEQ ID NO: 44064 - RNA, 21 nt, Artificial Sequence
  Synthetic
ugcaaguuuuuaauuaccaua

SEQ ID NO: 44065 - RNA, 22 nt, Artificial Sequence
  Synthetic
uugcaaguuuuuaauuaccaua

SEQ ID NO: 44066 - RNA, 23 nt, Artificial Sequence
  Synthetic
cuugcaaguuuuuaauuaccaua

SEQ ID NO: 44067 - RNA, 24 nt, Artificial Sequence
  Synthetic
ucuugcaaguuuuuaauuaccaua

SEQ ID NO: 44068 - RNA, 18 nt, Artificial Sequence
  Synthetic
gacauccggggcgggcua

SEQ ID NO: 44069 - RNA, 19 nt, Artificial Sequence
  Synthetic
agacauccggggcgggcua

SEQ ID NO: 44070 - RNA, 20 nt, Artificial Sequence
  Synthetic
cagacauccggggcgggcua

SEQ ID NO: 44071 - RNA, 21 nt, Artificial Sequence
  Synthetic
ccagacauccggggcgggcua

SEQ ID NO: 44072 - RNA, 22 nt, Artificial Sequence
  Synthetic
cccagacauccggggcgggcua

SEQ ID NO: 44073 - RNA, 23 nt, Artificial Sequence
  Synthetic
acccagacauccggggcgggcua

SEQ ID NO: 44074 - RNA, 24 nt, Artificial Sequence
  Synthetic
cacccagacauccggggcgggcua

SEQ ID NO: 44075 - RNA, 18 nt, Artificial Sequence
  Synthetic
ccuagaugcgugugagua

SEQ ID NO: 44076 - RNA, 19 nt, Artificial Sequence
  Synthetic
cccuagaugcgugugagua

SEQ ID NO: 44077 - RNA, 20 nt, Artificial Sequence
  Synthetic
ccccuagaugcgugugagua

SEQ ID NO: 44078 - RNA, 21 nt, Artificial Sequence
  Synthetic
cccccuagaugcgugugagua

SEQ ID NO: 44079 - RNA, 22 nt, Artificial Sequence
  Synthetic
ccccccuagaugcgugugagua

SEQ ID NO: 44080 - RNA, 23 nt, Artificial Sequence
  Synthetic
accccccuagaugcgugugagua

SEQ ID NO: 44081 - RNA, 24 nt, Artificial Sequence
  Synthetic
caccccccuagaugcgugugagua

SEQ ID NO: 44082 - RNA, 18 nt, Artificial Sequence
  Synthetic
aguuucuaauuaccauac

SEQ ID NO: 44083 - RNA, 19 nt, Artificial Sequence
  Synthetic
gaguuucuaauuaccauac

SEQ ID NO: 44084 - RNA, 20 nt, Artificial Sequence
  Synthetic
ugaguuucuaauuaccauac

SEQ ID NO: 44085 - RNA, 21 nt, Artificial Sequence
  Synthetic
augaguuucuaauuaccauac

SEQ ID NO: 44086 - RNA, 22 nt, Artificial Sequence
  Synthetic
aaugaguuucuaauuaccauac

SEQ ID NO: 44087 - RNA, 23 nt, Artificial Sequence
  Synthetic
uaaugaguuucuaauuaccauac

SEQ ID NO: 44088 - RNA, 24 nt, Artificial Sequence
  Synthetic
uuaaugaguuucuaauuaccauac

SEQ ID NO: 44089 - RNA, 18 nt, Artificial Sequence
  Synthetic
aguuuuuaauuaccauac

SEQ ID NO: 44090 - RNA, 19 nt, Artificial Sequence
  Synthetic
aaguuuuuaauuaccauac

SEQ ID NO: 44091 - RNA, 20 nt, Artificial Sequence
  Synthetic
caaguuuuuaauuaccauac

SEQ ID NO: 44092 - RNA, 21 nt, Artificial Sequence
  Synthetic
gcaaguuuuuaauuaccauac

SEQ ID NO: 44093 - RNA, 22 nt, Artificial Sequence
  Synthetic
ugcaaguuuuuaauuaccauac

SEQ ID NO: 44094 - RNA, 23 nt, Artificial Sequence
  Synthetic
uugcaaguuuuuaauuaccauac

SEQ ID NO: 44095 - RNA, 24 nt, Artificial Sequence
  Synthetic
cuugcaaguuuuuaauuaccauac

SEQ ID NO: 44096 - RNA, 18 nt, Artificial Sequence
  Synthetic
gggggucccacggcgacc

SEQ ID NO: 44097 - RNA, 19 nt, Artificial Sequence
  Synthetic
agggggucccacggcgacc

SEQ ID NO: 44098 - RNA, 20 nt, Artificial Sequence
  Synthetic
cagggggucccacggcgacc

SEQ ID NO: 44099 - RNA, 21 nt, Artificial Sequence
  Synthetic
ucagggggucccacggcgacc

SEQ ID NO: 44100 - RNA, 22 nt, Artificial Sequence
  Synthetic
gucagggggucccacggcgacc

SEQ ID NO: 44101 - RNA, 23 nt, Artificial Sequence
  Synthetic
agucagggggucccacggcgacc

SEQ ID NO: 44102 - RNA, 24 nt, Artificial Sequence
  Synthetic
gagucagggggucccacggcgacc

SEQ ID NO: 44103 - RNA, 18 nt, Artificial Sequence
  Synthetic
guuucuaauuaccauacc

SEQ ID NO: 44104 - RNA, 19 nt, Artificial Sequence
  Synthetic
aguuucuaauuaccauacc

SEQ ID NO: 44105 - RNA, 20 nt, Artificial Sequence
  Synthetic
gaguuucuaauuaccauacc

SEQ ID NO: 44106 - RNA, 21 nt, Artificial Sequence
  Synthetic
ugaguuucuaauuaccauacc

SEQ ID NO: 44107 - RNA, 22 nt, Artificial Sequence
  Synthetic
augaguuucuaauuaccauacc

SEQ ID NO: 44108 - RNA, 23 nt, Artificial Sequence
  Synthetic
aaugaguuucuaauuaccauacc

SEQ ID NO: 44109 - RNA, 24 nt, Artificial Sequence
  Synthetic
uaaugaguuucuaauuaccauacc

SEQ ID NO: 44110 - RNA, 18 nt, Artificial Sequence
  Synthetic
guuuuuaauuaccauacc

SEQ ID NO: 44111 - RNA, 19 nt, Artificial Sequence
  Synthetic
aguuuuuaauuaccauacc

SEQ ID NO: 44112 - RNA, 20 nt, Artificial Sequence
  Synthetic
aaguuuuuaauuaccauacc

SEQ ID NO: 44113 - RNA, 21 nt, Artificial Sequence
  Synthetic
caaguuuuuaauuaccauacc

SEQ ID NO: 44114 - RNA, 22 nt, Artificial Sequence
  Synthetic
gcaaguuuuuaauuaccauacc

SEQ ID NO: 44115 - RNA, 23 nt, Artificial Sequence
  Synthetic
ugcaaguuuuuaauuaccauacc

SEQ ID NO: 44116 - RNA, 24 nt, Artificial Sequence
  Synthetic
uugcaaguuuuuaauuaccauacc

SEQ ID NO: 44117 - RNA, 18 nt, Artificial Sequence
  Synthetic
gauuggccagucccgccc

SEQ ID NO: 44118 - RNA, 19 nt, Artificial Sequence
  Synthetic
cgauuggccagucccgccc

SEQ ID NO: 44119 - RNA, 20 nt, Artificial Sequence
  Synthetic
ccgauuggccagucccgccc

SEQ ID NO: 44120 - RNA, 21 nt, Artificial Sequence
  Synthetic
gccgauuggccagucccgccc

SEQ ID NO: 44121 - RNA, 22 nt, Artificial Sequence
  Synthetic
cgccgauuggccagucccgccc

SEQ ID NO: 44122 - RNA, 23 nt, Artificial Sequence
  Synthetic
ccgccgauuggccagucccgccc

SEQ ID NO: 44123 - RNA, 24 nt, Artificial Sequence
  Synthetic
gccgccgauuggccagucccgccc

SEQ ID NO: 44124 - RNA, 18 nt, Artificial Sequence
  Synthetic
cggcccgcucgcgggccc

SEQ ID NO: 44125 - RNA, 19 nt, Artificial Sequence
  Synthetic
ucggcccgcucgcgggccc

SEQ ID NO: 44126 - RNA, 20 nt, Artificial Sequence
  Synthetic
gucggcccgcucgcgggccc

SEQ ID NO: 44127 - RNA, 21 nt, Artificial Sequence
  Synthetic
ggucggcccgcucgcgggccc

SEQ ID NO: 44128 - RNA, 22 nt, Artificial Sequence
  Synthetic
cggucggcccgcucgcgggccc

SEQ ID NO: 44129 - RNA, 23 nt, Artificial Sequence
  Synthetic
ccggucggcccgcucgcgggccc

SEQ ID NO: 44130 - RNA, 24 nt, Artificial Sequence
  Synthetic
cccggucggcccgcucgcgggccc

SEQ ID NO: 44131 - RNA, 18 nt, Artificial Sequence
  Synthetic
gcuuggugcggagcuccc

SEQ ID NO: 44132 - RNA, 19 nt, Artificial Sequence
  Synthetic
ggcuuggugcggagcuccc

SEQ ID NO: 44133 - RNA, 20 nt, Artificial Sequence
  Synthetic
cggcuuggugcggagcuccc

SEQ ID NO: 44134 - RNA, 21 nt, Artificial Sequence
  Synthetic
gcggcuuggugcggagcuccc

SEQ ID NO: 44135 - RNA, 22 nt, Artificial Sequence
  Synthetic
agcggcuuggugcggagcuccc

SEQ ID NO: 44136 - RNA, 23 nt, Artificial Sequence
  Synthetic
gagcggcuuggugcggagcuccc

SEQ ID NO: 44137 - RNA, 24 nt, Artificial Sequence
  Synthetic
agagcggcuuggugcggagcuccc

SEQ ID NO: 44138 - RNA, 18 nt, Artificial Sequence
  Synthetic
agggcccgggcacgggcc

SEQ ID NO: 44139 - RNA, 19 nt, Artificial Sequence
  Synthetic
cagggcccgggcacgggcc

SEQ ID NO: 44140 - RNA, 20 nt, Artificial Sequence
  Synthetic
ccagggcccgggcacgggcc

SEQ ID NO: 44141 - RNA, 21 nt, Artificial Sequence
  Synthetic
gccagggcccgggcacgggcc

SEQ ID NO: 44142 - RNA, 22 nt, Artificial Sequence
  Synthetic
ggccagggcccgggcacgggcc

SEQ ID NO: 44143 - RNA, 23 nt, Artificial Sequence
  Synthetic
gggccagggcccgggcacgggcc

SEQ ID NO: 44144 - RNA, 24 nt, Artificial Sequence
  Synthetic
cgggccagggcccgggcacgggcc

SEQ ID NO: 44145 - RNA, 18 nt, Artificial Sequence
  Synthetic
cgcccaaugggccgggcc

SEQ ID NO: 44146 - RNA, 19 nt, Artificial Sequence
  Synthetic
ccgcccaaugggccgggcc

SEQ ID NO: 44147 - RNA, 20 nt, Artificial Sequence
  Synthetic
cccgcccaaugggccgggcc

SEQ ID NO: 44148 - RNA, 21 nt, Artificial Sequence
  Synthetic
ucccgcccaaugggccgggcc

SEQ ID NO: 44149 - RNA, 22 nt, Artificial Sequence
  Synthetic
cucccgcccaaugggccgggcc

SEQ ID NO: 44150 - RNA, 23 nt, Artificial Sequence
  Synthetic
acucccgcccaaugggccgggcc

SEQ ID NO: 44151 - RNA, 24 nt, Artificial Sequence
  Synthetic
aacucccgcccaaugggccgggcc

SEQ ID NO: 44152 - RNA, 18 nt, Artificial Sequence
  Synthetic
ccugccccccugcuggcc

SEQ ID NO: 44153 - RNA, 19 nt, Artificial Sequence
  Synthetic
uccugccccccugcuggcc

SEQ ID NO: 44154 - RNA, 20 nt, Artificial Sequence
  Synthetic
guccugccccccugcuggcc

SEQ ID NO: 44155 - RNA, 21 nt, Artificial Sequence
  Synthetic
aguccugccccccugcuggcc

SEQ ID NO: 44156 - RNA, 22 nt, Artificial Sequence
  Synthetic
aaguccugccccccugcuggcc

SEQ ID NO: 44157 - RNA, 23 nt, Artificial Sequence
  Synthetic
aaaguccugccccccugcuggcc

SEQ ID NO: 44158 - RNA, 24 nt, Artificial Sequence
  Synthetic
caaaguccugccccccugcuggcc

SEQ ID NO: 44159 - RNA, 18 nt, Artificial Sequence
  Synthetic
ggcuuggugcggagcucc

SEQ ID NO: 44160 - RNA, 19 nt, Artificial Sequence
  Synthetic
cggcuuggugcggagcucc

SEQ ID NO: 44161 - RNA, 20 nt, Artificial Sequence
  Synthetic
gcggcuuggugcggagcucc

SEQ ID NO: 44162 - RNA, 21 nt, Artificial Sequence
  Synthetic
agcggcuuggugcggagcucc

SEQ ID NO: 44163 - RNA, 22 nt, Artificial Sequence
  Synthetic
gagcggcuuggugcggagcucc

SEQ ID NO: 44164 - RNA, 23 nt, Artificial Sequence
  Synthetic
agagcggcuuggugcggagcucc

SEQ ID NO: 44165 - RNA, 24 nt, Artificial Sequence
  Synthetic
gagagcggcuuggugcggagcucc

SEQ ID NO: 44166 - RNA, 18 nt, Artificial Sequence
  Synthetic
ggagcucccgggagcucc

SEQ ID NO: 44167 - RNA, 19 nt, Artificial Sequence
  Synthetic
cggagcucccgggagcucc

SEQ ID NO: 44168 - RNA, 20 nt, Artificial Sequence
  Synthetic
gcggagcucccgggagcucc

SEQ ID NO: 44169 - RNA, 21 nt, Artificial Sequence
  Synthetic
ugcggagcucccgggagcucc

SEQ ID NO: 44170 - RNA, 22 nt, Artificial Sequence
  Synthetic
gugcggagcucccgggagcucc

SEQ ID NO: 44171 - RNA, 23 nt, Artificial Sequence
  Synthetic
ggugcggagcucccgggagcucc

SEQ ID NO: 44172 - RNA, 24 nt, Artificial Sequence
  Synthetic
uggugcggagcucccgggagcucc

SEQ ID NO: 44173 - RNA, 18 nt, Artificial Sequence
  Synthetic
guucgccgggccggcucc

SEQ ID NO: 44174 - RNA, 19 nt, Artificial Sequence
  Synthetic
aguucgccgggccggcucc

SEQ ID NO: 44175 - RNA, 20 nt, Artificial Sequence
  Synthetic
gaguucgccgggccggcucc

SEQ ID NO: 44176 - RNA, 21 nt, Artificial Sequence
  Synthetic
cgaguucgccgggccggcucc

SEQ ID NO: 44177 - RNA, 22 nt, Artificial Sequence
  Synthetic
ccgaguucgccgggccggcucc

SEQ ID NO: 44178 - RNA, 23 nt, Artificial Sequence
  Synthetic
accgaguucgccgggccggcucc

SEQ ID NO: 44179 - RNA, 24 nt, Artificial Sequence
  Synthetic
gaccgaguucgccgggccggcucc

SEQ ID NO: 44180 - RNA, 18 nt, Artificial Sequence
  Synthetic
gccuccgccacccggcgc

SEQ ID NO: 44181 - RNA, 19 nt, Artificial Sequence
  Synthetic
ggccuccgccacccggcgc

SEQ ID NO: 44182 - RNA, 20 nt, Artificial Sequence
  Synthetic
cggccuccgccacccggcgc

SEQ ID NO: 44183 - RNA, 21 nt, Artificial Sequence
  Synthetic
ucggccuccgccacccggcgc

SEQ ID NO: 44184 - RNA, 22 nt, Artificial Sequence
  Synthetic
cucggccuccgccacccggcgc

SEQ ID NO: 44185 - RNA, 23 nt, Artificial Sequence
  Synthetic
ccucggccuccgccacccggcgc

SEQ ID NO: 44186 - RNA, 24 nt, Artificial Sequence
  Synthetic
gccucggccuccgccacccggcgc

SEQ ID NO: 44187 - RNA, 18 nt, Artificial Sequence
  Synthetic
ggcuccgcgggccagggc

SEQ ID NO: 44188 - RNA, 19 nt, Artificial Sequence
  Synthetic
cggcuccgcgggccagggc

SEQ ID NO: 44189 - RNA, 20 nt, Artificial Sequence
  Synthetic
ccggcuccgcgggccagggc

SEQ ID NO: 44190 - RNA, 21 nt, Artificial Sequence
  Synthetic
gccggcuccgcgggccagggc

SEQ ID NO: 44191 - RNA, 22 nt, Artificial Sequence
  Synthetic
ggccggcuccgcgggccagggc

SEQ ID NO: 44192 - RNA, 23 nt, Artificial Sequence
  Synthetic
gggccggcuccgcgggccagggc

SEQ ID NO: 44193 - RNA, 24 nt, Artificial Sequence
  Synthetic
cgggccggcuccgcgggccagggc

SEQ ID NO: 44194 - RNA, 18 nt, Artificial Sequence
  Synthetic
gcgggccagggcccgggc

SEQ ID NO: 44195 - RNA, 19 nt, Artificial Sequence
  Synthetic
cgcgggccagggcccgggc

SEQ ID NO: 44196 - RNA, 20 nt, Artificial Sequence
  Synthetic
ccgcgggccagggcccgggc

SEQ ID NO: 44197 - RNA, 21 nt, Artificial Sequence
  Synthetic
uccgcgggccagggcccgggc

SEQ ID NO: 44198 - RNA, 22 nt, Artificial Sequence
  Synthetic
cuccgcgggccagggcccgggc

SEQ ID NO: 44199 - RNA, 23 nt, Artificial Sequence
  Synthetic
gcuccgcgggccagggcccgggc

SEQ ID NO: 44200 - RNA, 24 nt, Artificial Sequence
  Synthetic
ggcuccgcgggccagggcccgggc

SEQ ID NO: 44201 - RNA, 18 nt, Artificial Sequence
  Synthetic
cgggccggcuccgcgggc

SEQ ID NO: 44202 - RNA, 19 nt, Artificial Sequence
  Synthetic
ccgggccggcuccgcgggc

SEQ ID NO: 44203 - RNA, 20 nt, Artificial Sequence
  Synthetic
gccgggccggcuccgcgggc

SEQ ID NO: 44204 - RNA, 21 nt, Artificial Sequence
  Synthetic
cgccgggccggcuccgcgggc

SEQ ID NO: 44205 - RNA, 22 nt, Artificial Sequence
  Synthetic
ucgccgggccggcuccgcgggc

SEQ ID NO: 44206 - RNA, 23 nt, Artificial Sequence
  Synthetic
uucgccgggccggcuccgcgggc

SEQ ID NO: 44207 - RNA, 24 nt, Artificial Sequence
  Synthetic
guucgccgggccggcuccgcgggc

SEQ ID NO: 44208 - RNA, 18 nt, Artificial Sequence
  Synthetic
gggaaacacccagacauc

SEQ ID NO: 44209 - RNA, 19 nt, Artificial Sequence
  Synthetic
agggaaacacccagacauc

SEQ ID NO: 44210 - RNA, 20 nt, Artificial Sequence
  Synthetic
cagggaaacacccagacauc

SEQ ID NO: 44211 - RNA, 18 nt, Artificial Sequence
  Synthetic
cggcuuggugcggagcuc

SEQ ID NO: 44212 - RNA, 19 nt, Artificial Sequence
  Synthetic
gcggcuuggugcggagcuc

SEQ ID NO: 44213 - RNA, 20 nt, Artificial Sequence
  Synthetic
agcggcuuggugcggagcuc

SEQ ID NO: 44214 - RNA, 21 nt, Artificial Sequence
  Synthetic
gagcggcuuggugcggagcuc

SEQ ID NO: 44215 - RNA, 22 nt, Artificial Sequence
  Synthetic
agagcggcuuggugcggagcuc

SEQ ID NO: 44216 - RNA, 23 nt, Artificial Sequence
  Synthetic
gagagcggcuuggugcggagcuc

SEQ ID NO: 44217 - RNA, 24 nt, Artificial Sequence
  Synthetic
ggagagcggcuuggugcggagcuc

SEQ ID NO: 44218 - RNA, 18 nt, Artificial Sequence
  Synthetic
agcccggucggcccgcuc

SEQ ID NO: 44219 - RNA, 19 nt, Artificial Sequence
  Synthetic
gagcccggucggcccgcuc

SEQ ID NO: 44220 - RNA, 20 nt, Artificial Sequence
  Synthetic
cgagcccggucggcccgcuc

SEQ ID NO: 44221 - RNA, 21 nt, Artificial Sequence
  Synthetic
ccgagcccggucggcccgcuc

SEQ ID NO: 44222 - RNA, 22 nt, Artificial Sequence
  Synthetic
accgagcccggucggcccgcuc

SEQ ID NO: 44223 - RNA, 23 nt, Artificial Sequence
  Synthetic
aaccgagcccggucggcccgcuc

SEQ ID NO: 44224 - RNA, 24 nt, Artificial Sequence
  Synthetic
gaaccgagcccggucggcccgcuc

SEQ ID NO: 44225 - RNA, 18 nt, Artificial Sequence
  Synthetic
cuccugccaucgucucuc

SEQ ID NO: 44226 - RNA, 19 nt, Artificial Sequence
  Synthetic
gcuccugccaucgucucuc

SEQ ID NO: 44227 - RNA, 20 nt, Artificial Sequence
  Synthetic
ggcuccugccaucgucucuc

SEQ ID NO: 44228 - RNA, 21 nt, Artificial Sequence
  Synthetic
cggcuccugccaucgucucuc

SEQ ID NO: 44229 - RNA, 22 nt, Artificial Sequence
  Synthetic
gcggcuccugccaucgucucuc

SEQ ID NO: 44230 - RNA, 23 nt, Artificial Sequence
  Synthetic
cgcggcuccugccaucgucucuc

SEQ ID NO: 44231 - RNA, 24 nt, Artificial Sequence
  Synthetic
gcgcggcuccugccaucgucucuc

SEQ ID NO: 44232 - RNA, 18 nt, Artificial Sequence
  Synthetic
ugucucuguguaugaguc

SEQ ID NO: 44233 - RNA, 19 nt, Artificial Sequence
  Synthetic
gugucucuguguaugaguc

SEQ ID NO: 44234 - RNA, 20 nt, Artificial Sequence
  Synthetic
cgugucucuguguaugaguc

SEQ ID NO: 44235 - RNA, 21 nt, Artificial Sequence
  Synthetic
gcgugucucuguguaugaguc

SEQ ID NO: 44236 - RNA, 22 nt, Artificial Sequence
  Synthetic
ggcgugucucuguguaugaguc

SEQ ID NO: 44237 - RNA, 23 nt, Artificial Sequence
  Synthetic
gggcgugucucuguguaugaguc

SEQ ID NO: 44238 - RNA, 24 nt, Artificial Sequence
  Synthetic
ggggcgugucucuguguaugaguc

SEQ ID NO: 44239 - RNA, 18 nt, Artificial Sequence
  Synthetic
gggcuaaggggaaaaaag

SEQ ID NO: 44240 - RNA, 19 nt, Artificial Sequence
  Synthetic
cgggcuaaggggaaaaaag

SEQ ID NO: 44241 - RNA, 20 nt, Artificial Sequence
  Synthetic
gcgggcuaaggggaaaaaag

SEQ ID NO: 44242 - RNA, 21 nt, Artificial Sequence
  Synthetic
ggcgggcuaaggggaaaaaag

SEQ ID NO: 44243 - RNA, 22 nt, Artificial Sequence
  Synthetic
gggcgggcuaaggggaaaaaag

SEQ ID NO: 44244 - RNA, 23 nt, Artificial Sequence
  Synthetic
ggggcgggcuaaggggaaaaaag

SEQ ID NO: 44245 - RNA, 24 nt, Artificial Sequence
  Synthetic
cggggcgggcuaaggggaaaaaag

SEQ ID NO: 44246 - RNA, 18 nt, Artificial Sequence
  Synthetic
cccugcuggccucggaag

SEQ ID NO: 44247 - RNA, 19 nt, Artificial Sequence
  Synthetic
ccccugcuggccucggaag

SEQ ID NO: 44248 - RNA, 20 nt, Artificial Sequence
  Synthetic
cccccugcuggccucggaag

SEQ ID NO: 44249 - RNA, 21 nt, Artificial Sequence
  Synthetic
ccccccugcuggccucggaag

SEQ ID NO: 44250 - RNA, 22 nt, Artificial Sequence
  Synthetic
gccccccugcuggccucggaag

SEQ ID NO: 44251 - RNA, 23 nt, Artificial Sequence
  Synthetic
ugccccccugcuggccucggaag

SEQ ID NO: 44252 - RNA, 24 nt, Artificial Sequence
  Synthetic
cugccccccugcuggccucggaag

SEQ ID NO: 44253 - RNA, 18 nt, Artificial Sequence
  Synthetic
aauuaccauaccgggaag

SEQ ID NO: 44254 - RNA, 19 nt, Artificial Sequence
  Synthetic
uaauuaccauaccgggaag

SEQ ID NO: 44255 - RNA, 20 nt, Artificial Sequence
  Synthetic
cuaauuaccauaccgggaag

SEQ ID NO: 44256 - RNA, 21 nt, Artificial Sequence
  Synthetic
ucuaauuaccauaccgggaag

SEQ ID NO: 44257 - RNA, 22 nt, Artificial Sequence
  Synthetic
uucuaauuaccauaccgggaag

SEQ ID NO: 44258 - RNA, 23 nt, Artificial Sequence
  Synthetic
uuucuaauuaccauaccgggaag

SEQ ID NO: 44259 - RNA, 24 nt, Artificial Sequence
  Synthetic
guuucuaauuaccauaccgggaag

SEQ ID NO: 44260 - RNA, 18 nt, Artificial Sequence
  Synthetic
cauccggggcgggcuaag

SEQ ID NO: 44261 - RNA, 19 nt, Artificial Sequence
  Synthetic
acauccggggcgggcuaag

SEQ ID NO: 44262 - RNA, 20 nt, Artificial Sequence
  Synthetic
gacauccggggcgggcuaag

SEQ ID NO: 44263 - RNA, 21 nt, Artificial Sequence
  Synthetic
agacauccggggcgggcuaag

SEQ ID NO: 44264 - RNA, 22 nt, Artificial Sequence
  Synthetic
cagacauccggggcgggcuaag

SEQ ID NO: 44265 - RNA, 23 nt, Artificial Sequence
  Synthetic
ccagacauccggggcgggcuaag

SEQ ID NO: 44266 - RNA, 24 nt, Artificial Sequence
  Synthetic
cccagacauccggggcgggcuaag

SEQ ID NO: 44267 - RNA, 18 nt, Artificial Sequence
  Synthetic
uagaugcgugugaguaag

SEQ ID NO: 44268 - RNA, 19 nt, Artificial Sequence
  Synthetic
cuagaugcgugugaguaag

SEQ ID NO: 44269 - RNA, 20 nt, Artificial Sequence
  Synthetic
ccuagaugcgugugaguaag

SEQ ID NO: 44270 - RNA, 21 nt, Artificial Sequence
  Synthetic
cccuagaugcgugugaguaag

SEQ ID NO: 44271 - RNA, 22 nt, Artificial Sequence
  Synthetic
ccccuagaugcgugugaguaag

SEQ ID NO: 44272 - RNA, 23 nt, Artificial Sequence
  Synthetic
cccccuagaugcgugugaguaag

SEQ ID NO: 44273 - RNA, 24 nt, Artificial Sequence
  Synthetic
ccccccuagaugcgugugaguaag

SEQ ID NO: 44274 - RNA, 18 nt, Artificial Sequence
  Synthetic
ggccugcguaugagucag

SEQ ID NO: 44275 - RNA, 19 nt, Artificial Sequence
  Synthetic
gggccugcguaugagucag

SEQ ID NO: 44276 - RNA, 20 nt, Artificial Sequence
  Synthetic
ggggccugcguaugagucag

SEQ ID NO: 44277 - RNA, 21 nt, Artificial Sequence
  Synthetic
gggggccugcguaugagucag

SEQ ID NO: 44278 - RNA, 22 nt, Artificial Sequence
  Synthetic
ggggggccugcguaugagucag

SEQ ID NO: 44279 - RNA, 23 nt, Artificial Sequence
  Synthetic
aggggggccugcguaugagucag

SEQ ID NO: 44280 - RNA, 24 nt, Artificial Sequence
  Synthetic
aaggggggccugcguaugagucag

SEQ ID NO: 44281 - RNA, 18 nt, Artificial Sequence
  Synthetic
cugcuggccucggaagag

SEQ ID NO: 44282 - RNA, 19 nt, Artificial Sequence
  Synthetic
ccugcuggccucggaagag

SEQ ID NO: 44283 - RNA, 20 nt, Artificial Sequence
  Synthetic
cccugcuggccucggaagag

SEQ ID NO: 44284 - RNA, 21 nt, Artificial Sequence
  Synthetic
ccccugcuggccucggaagag

SEQ ID NO: 44285 - RNA, 22 nt, Artificial Sequence
  Synthetic
cccccugcuggccucggaagag

SEQ ID NO: 44286 - RNA, 23 nt, Artificial Sequence
  Synthetic
ccccccugcuggccucggaagag

SEQ ID NO: 44287 - RNA, 24 nt, Artificial Sequence
  Synthetic
gccccccugcuggccucggaagag

SEQ ID NO: 44288 - RNA, 18 nt, Artificial Sequence
  Synthetic
ccuccagacgcaccggag

SEQ ID NO: 44289 - RNA, 19 nt, Artificial Sequence
  Synthetic
cccuccagacgcaccggag

SEQ ID NO: 44290 - RNA, 20 nt, Artificial Sequence
  Synthetic
gcccuccagacgcaccggag

SEQ ID NO: 44291 - RNA, 21 nt, Artificial Sequence
  Synthetic
cgcccuccagacgcaccggag

SEQ ID NO: 44292 - RNA, 22 nt, Artificial Sequence
  Synthetic
ccgcccuccagacgcaccggag

SEQ ID NO: 44293 - RNA, 23 nt, Artificial Sequence
  Synthetic
cccgcccuccagacgcaccggag

SEQ ID NO: 44294 - RNA, 24 nt, Artificial Sequence
  Synthetic
ucccgcccuccagacgcaccggag

SEQ ID NO: 44295 - RNA, 18 nt, Artificial Sequence
  Synthetic
gagcucccgggagcuccg

SEQ ID NO: 44296 - RNA, 19 nt, Artificial Sequence
  Synthetic
ggagcucccgggagcuccg

SEQ ID NO: 44297 - RNA, 20 nt, Artificial Sequence
  Synthetic
cggagcucccgggagcuccg

SEQ ID NO: 44298 - RNA, 21 nt, Artificial Sequence
  Synthetic
gcggagcucccgggagcuccg

SEQ ID NO: 44299 - RNA, 22 nt, Artificial Sequence
  Synthetic
ugcggagcucccgggagcuccg

SEQ ID NO: 44300 - RNA, 23 nt, Artificial Sequence
  Synthetic
gugcggagcucccgggagcuccg

SEQ ID NO: 44301 - RNA, 24 nt, Artificial Sequence
  Synthetic
ggugcggagcucccgggagcuccg

SEQ ID NO: 44302 - RNA, 18 nt, Artificial Sequence
  Synthetic
ccugccaucgucucuccg

SEQ ID NO: 44303 - RNA, 19 nt, Artificial Sequence
  Synthetic
uccugccaucgucucuccg

SEQ ID NO: 44304 - RNA, 20 nt, Artificial Sequence
  Synthetic
cuccugccaucgucucuccg

SEQ ID NO: 44305 - RNA, 21 nt, Artificial Sequence
  Synthetic
gcuccugccaucgucucuccg

SEQ ID NO: 44306 - RNA, 22 nt, Artificial Sequence
  Synthetic
ggcuccugccaucgucucuccg

SEQ ID NO: 44307 - RNA, 23 nt, Artificial Sequence
  Synthetic
cggcuccugccaucgucucuccg

SEQ ID NO: 44308 - RNA, 24 nt, Artificial Sequence
  Synthetic
gcggcuccugccaucgucucuccg

SEQ ID NO: 44309 - RNA, 18 nt, Artificial Sequence
  Synthetic
ggccuccgccacccggcg

SEQ ID NO: 44310 - RNA, 19 nt, Artificial Sequence
  Synthetic
cggccuccgccacccggcg

SEQ ID NO: 44311 - RNA, 20 nt, Artificial Sequence
  Synthetic
ucggccuccgccacccggcg

SEQ ID NO: 44312 - RNA, 21 nt, Artificial Sequence
  Synthetic
cucggccuccgccacccggcg

SEQ ID NO: 44313 - RNA, 22 nt, Artificial Sequence
  Synthetic
ccucggccuccgccacccggcg

SEQ ID NO: 44314 - RNA, 23 nt, Artificial Sequence
  Synthetic
gccucggccuccgccacccggcg

SEQ ID NO: 44315 - RNA, 24 nt, Artificial Sequence
  Synthetic
cgccucggccuccgccacccggcg

SEQ ID NO: 44316 - RNA, 18 nt, Artificial Sequence
  Synthetic
ccgggccccgaagacucg

SEQ ID NO: 44317 - RNA, 19 nt, Artificial Sequence
  Synthetic
gccgggccccgaagacucg

SEQ ID NO: 44318 - RNA, 20 nt, Artificial Sequence
  Synthetic
ggccgggccccgaagacucg

SEQ ID NO: 44319 - RNA, 21 nt, Artificial Sequence
  Synthetic
gggccgggccccgaagacucg

SEQ ID NO: 44320 - RNA, 22 nt, Artificial Sequence
  Synthetic
ugggccgggccccgaagacucg

SEQ ID NO: 44321 - RNA, 23 nt, Artificial Sequence
  Synthetic
augggccgggccccgaagacucg

SEQ ID NO: 44322 - RNA, 24 nt, Artificial Sequence
  Synthetic
aaugggccgggccccgaagacucg

SEQ ID NO: 44323 - RNA, 18 nt, Artificial Sequence
  Synthetic
aacguuagaccgaguucg

SEQ ID NO: 44324 - RNA, 19 nt, Artificial Sequence
  Synthetic
uaacguuagaccgaguucg

SEQ ID NO: 44325 - RNA, 20 nt, Artificial Sequence
  Synthetic
guaacguuagaccgaguucg

SEQ ID NO: 44326 - RNA, 21 nt, Artificial Sequence
  Synthetic
uguaacguuagaccgaguucg

SEQ ID NO: 44327 - RNA, 22 nt, Artificial Sequence
  Synthetic
guguaacguuagaccgaguucg

SEQ ID NO: 44328 - RNA, 23 nt, Artificial Sequence
  Synthetic
gguguaacguuagaccgaguucg

SEQ ID NO: 44329 - RNA, 24 nt, Artificial Sequence
  Synthetic
ggguguaacguuagaccgaguucg

SEQ ID NO: 44330 - RNA, 18 nt, Artificial Sequence
  Synthetic
ugcuggccucggaagagg

SEQ ID NO: 44331 - RNA, 19 nt, Artificial Sequence
  Synthetic
cugcuggccucggaagagg

SEQ ID NO: 44332 - RNA, 20 nt, Artificial Sequence
  Synthetic
ccugcuggccucggaagagg

SEQ ID NO: 44333 - RNA, 21 nt, Artificial Sequence
  Synthetic
cccugcuggccucggaagagg

SEQ ID NO: 44334 - RNA, 22 nt, Artificial Sequence
  Synthetic
ccccugcuggccucggaagagg

SEQ ID NO: 44335 - RNA, 23 nt, Artificial Sequence
  Synthetic
cccccugcuggccucggaagagg

SEQ ID NO: 44336 - RNA, 24 nt, Artificial Sequence
  Synthetic
ccccccugcuggccucggaagagg

SEQ ID NO: 44337 - RNA, 18 nt, Artificial Sequence
  Synthetic
gcggcccgcccugugagg

SEQ ID NO: 44338 - RNA, 19 nt, Artificial Sequence
  Synthetic
ggcggcccgcccugugagg

SEQ ID NO: 44339 - RNA, 20 nt, Artificial Sequence
  Synthetic
aggcggcccgcccugugagg

SEQ ID NO: 44340 - RNA, 21 nt, Artificial Sequence
  Synthetic
gaggcggcccgcccugugagg

SEQ ID NO: 44341 - RNA, 22 nt, Artificial Sequence
  Synthetic
cgaggcggcccgcccugugagg

SEQ ID NO: 44342 - RNA, 23 nt, Artificial Sequence
  Synthetic
ccgaggcggcccgcccugugagg

SEQ ID NO: 44343 - RNA, 24 nt, Artificial Sequence
  Synthetic
cccgaggcggcccgcccugugagg

SEQ ID NO: 44344 - RNA, 18 nt, Artificial Sequence
  Synthetic
ccccccugcuggccucgg

SEQ ID NO: 44345 - RNA, 19 nt, Artificial Sequence
  Synthetic
gccccccugcuggccucgg

SEQ ID NO: 44346 - RNA, 20 nt, Artificial Sequence
  Synthetic
ugccccccugcuggccucgg

SEQ ID NO: 44347 - RNA, 21 nt, Artificial Sequence
  Synthetic
cugccccccugcuggccucgg

SEQ ID NO: 44348 - RNA, 22 nt, Artificial Sequence
  Synthetic
ccugccccccugcuggccucgg

SEQ ID NO: 44349 - RNA, 23 nt, Artificial Sequence
  Synthetic
uccugccccccugcuggccucgg

SEQ ID NO: 44350 - RNA, 24 nt, Artificial Sequence
  Synthetic
guccugccccccugcuggccucgg

SEQ ID NO: 44351 - RNA, 18 nt, Artificial Sequence
  Synthetic
gcuggccucggaagaggg

SEQ ID NO: 44352 - RNA, 19 nt, Artificial Sequence
  Synthetic
ugcuggccucggaagaggg

SEQ ID NO: 44353 - RNA, 20 nt, Artificial Sequence
  Synthetic
cugcuggccucggaagaggg

SEQ ID NO: 44354 - RNA, 21 nt, Artificial Sequence
  Synthetic
ccugcuggccucggaagaggg

SEQ ID NO: 44355 - RNA, 22 nt, Artificial Sequence
  Synthetic
cccugcuggccucggaagaggg

SEQ ID NO: 44356 - RNA, 23 nt, Artificial Sequence
  Synthetic
ccccugcuggccucggaagaggg

SEQ ID NO: 44357 - RNA, 24 nt, Artificial Sequence
  Synthetic
cccccugcuggccucggaagaggg

SEQ ID NO: 44358 - RNA, 18 nt, Artificial Sequence
  Synthetic
aacacccagacauccggg

SEQ ID NO: 44359 - RNA, 19 nt, Artificial Sequence
  Synthetic
aaacacccagacauccggg

SEQ ID NO: 44360 - RNA, 20 nt, Artificial Sequence
  Synthetic
gaaacacccagacauccggg

SEQ ID NO: 44361 - RNA, 21 nt, Artificial Sequence
  Synthetic
ggaaacacccagacauccggg

SEQ ID NO: 44362 - RNA, 22 nt, Artificial Sequence
  Synthetic
gggaaacacccagacauccggg

SEQ ID NO: 44363 - RNA, 23 nt, Artificial Sequence
  Synthetic
agggaaacacccagacauccggg

SEQ ID NO: 44364 - RNA, 24 nt, Artificial Sequence
  Synthetic
cagggaaacacccagacauccggg

SEQ ID NO: 44365 - RNA, 18 nt, Artificial Sequence
  Synthetic
uggccucggaagaggggg

SEQ ID NO: 44366 - RNA, 19 nt, Artificial Sequence
  Synthetic
cuggccucggaagaggggg

SEQ ID NO: 44367 - RNA, 20 nt, Artificial Sequence
  Synthetic
gcuggccucggaagaggggg

SEQ ID NO: 44368 - RNA, 21 nt, Artificial Sequence
  Synthetic
ugcuggccucggaagaggggg

SEQ ID NO: 44369 - RNA, 22 nt, Artificial Sequence
  Synthetic
cugcuggccucggaagaggggg

SEQ ID NO: 44370 - RNA, 23 nt, Artificial Sequence
  Synthetic
ccugcuggccucggaagaggggg

SEQ ID NO: 44371 - RNA, 24 nt, Artificial Sequence
  Synthetic
cccugcuggccucggaagaggggg

SEQ ID NO: 44372 - RNA, 18 nt, Artificial Sequence
  Synthetic
uaacucccgcccaauggg

SEQ ID NO: 44373 - RNA, 19 nt, Artificial Sequence
  Synthetic
guaacucccgcccaauggg

SEQ ID NO: 44374 - RNA, 20 nt, Artificial Sequence
  Synthetic
gguaacucccgcccaauggg

SEQ ID NO: 44375 - RNA, 21 nt, Artificial Sequence
  Synthetic
cgguaacucccgcccaauggg

SEQ ID NO: 44376 - RNA, 22 nt, Artificial Sequence
  Synthetic
gcgguaacucccgcccaauggg

SEQ ID NO: 44377 - RNA, 23 nt, Artificial Sequence
  Synthetic
ggcgguaacucccgcccaauggg

SEQ ID NO: 44378 - RNA, 24 nt, Artificial Sequence
  Synthetic
gggcgguaacucccgcccaauggg

SEQ ID NO: 44379 - RNA, 18 nt, Artificial Sequence
  Synthetic
ggggcggguaagaauggg

SEQ ID NO: 44380 - RNA, 19 nt, Artificial Sequence
  Synthetic
gggggcggguaagaauggg

SEQ ID NO: 44381 - RNA, 20 nt, Artificial Sequence
  Synthetic
ggggggcggguaagaauggg

SEQ ID NO: 44382 - RNA, 21 nt, Artificial Sequence
  Synthetic
aggggggcggguaagaauggg

SEQ ID NO: 44383 - RNA, 22 nt, Artificial Sequence
  Synthetic
aaggggggcggguaagaauggg

SEQ ID NO: 44384 - RNA, 23 nt, Artificial Sequence
  Synthetic
aaaggggggcggguaagaauggg

SEQ ID NO: 44385 - RNA, 24 nt, Artificial Sequence
  Synthetic
aaaaggggggcggguaagaauggg

SEQ ID NO: 44386 - RNA, 18 nt, Artificial Sequence
  Synthetic
gggggcggguaagaaugg

SEQ ID NO: 44387 - RNA, 19 nt, Artificial Sequence
  Synthetic
ggggggcggguaagaaugg

SEQ ID NO: 44388 - RNA, 20 nt, Artificial Sequence
  Synthetic
aggggggcggguaagaaugg

SEQ ID NO: 44389 - RNA, 21 nt, Artificial Sequence
  Synthetic
aaggggggcggguaagaaugg

SEQ ID NO: 44390 - RNA, 22 nt, Artificial Sequence
  Synthetic
aaaggggggcggguaagaaugg

SEQ ID NO: 44391 - RNA, 23 nt, Artificial Sequence
  Synthetic
aaaaggggggcggguaagaaugg

SEQ ID NO: 44392 - RNA, 24 nt, Artificial Sequence
  Synthetic
aaaaaggggggcggguaagaaugg

SEQ ID NO: 44393 - RNA, 18 nt, Artificial Sequence
  Synthetic
ucggcggacgcugguugg

SEQ ID NO: 44394 - RNA, 19 nt, Artificial Sequence
  Synthetic
cucggcggacgcugguugg

SEQ ID NO: 44395 - RNA, 20 nt, Artificial Sequence
  Synthetic
acucggcggacgcugguugg

SEQ ID NO: 44396 - RNA, 21 nt, Artificial Sequence
  Synthetic
gacucggcggacgcugguugg

SEQ ID NO: 44397 - RNA, 22 nt, Artificial Sequence
  Synthetic
agacucggcggacgcugguugg

SEQ ID NO: 44398 - RNA, 23 nt, Artificial Sequence
  Synthetic
aagacucggcggacgcugguugg

SEQ ID NO: 44399 - RNA, 24 nt, Artificial Sequence
  Synthetic
gaagacucggcggacgcugguugg

SEQ ID NO: 44400 - RNA, 18 nt, Artificial Sequence
  Synthetic
ggggggcggguaagaaug

SEQ ID NO: 44401 - RNA, 19 nt, Artificial Sequence
  Synthetic
aggggggcggguaagaaug

SEQ ID NO: 44402 - RNA, 20 nt, Artificial Sequence
  Synthetic
aaggggggcggguaagaaug

SEQ ID NO: 44403 - RNA, 21 nt, Artificial Sequence
  Synthetic
aaaggggggcggguaagaaug

SEQ ID NO: 44404 - RNA, 22 nt, Artificial Sequence
  Synthetic
aaaaggggggcggguaagaaug

SEQ ID NO: 44405 - RNA, 23 nt, Artificial Sequence
  Synthetic
aaaaaggggggcggguaagaaug

SEQ ID NO: 44406 - RNA, 24 nt, Artificial Sequence
  Synthetic
aaaaaaggggggcggguaagaaug

SEQ ID NO: 44407 - RNA, 18 nt, Artificial Sequence
  Synthetic
cggcgucccccaaauaug

SEQ ID NO: 44408 - RNA, 19 nt, Artificial Sequence
  Synthetic
acggcgucccccaaauaug

SEQ ID NO: 44409 - RNA, 20 nt, Artificial Sequence
  Synthetic
cacggcgucccccaaauaug

SEQ ID NO: 44410 - RNA, 21 nt, Artificial Sequence
  Synthetic
ccacggcgucccccaaauaug

SEQ ID NO: 44411 - RNA, 22 nt, Artificial Sequence
  Synthetic
cccacggcgucccccaaauaug

SEQ ID NO: 44412 - RNA, 23 nt, Artificial Sequence
  Synthetic
ucccacggcgucccccaaauaug

SEQ ID NO: 44413 - RNA, 24 nt, Artificial Sequence
  Synthetic
gucccacggcgucccccaaauaug

SEQ ID NO: 44414 - RNA, 18 nt, Artificial Sequence
  Synthetic
ccggagagcggcuuggug

SEQ ID NO: 44415 - RNA, 19 nt, Artificial Sequence
  Synthetic
uccggagagcggcuuggug

SEQ ID NO: 44416 - RNA, 20 nt, Artificial Sequence
  Synthetic
cuccggagagcggcuuggug

SEQ ID NO: 44417 - RNA, 21 nt, Artificial Sequence
  Synthetic
ucuccggagagcggcuuggug

SEQ ID NO: 44418 - RNA, 22 nt, Artificial Sequence
  Synthetic
cucuccggagagcggcuuggug

SEQ ID NO: 44419 - RNA, 23 nt, Artificial Sequence
  Synthetic
ucucuccggagagcggcuuggug

SEQ ID NO: 44420 - RNA, 24 nt, Artificial Sequence
  Synthetic
gucucuccggagagcggcuuggug

SEQ ID NO: 44421 - RNA, 18 nt, Artificial Sequence
  Synthetic
aggggccauguguaugug

SEQ ID NO: 44422 - RNA, 19 nt, Artificial Sequence
  Synthetic
aaggggccauguguaugug

SEQ ID NO: 44423 - RNA, 20 nt, Artificial Sequence
  Synthetic
aaaggggccauguguaugug

SEQ ID NO: 44424 - RNA, 21 nt, Artificial Sequence
  Synthetic
caaaggggccauguguaugug

SEQ ID NO: 44425 - RNA, 22 nt, Artificial Sequence
  Synthetic
ucaaaggggccauguguaugug

SEQ ID NO: 44426 - RNA, 23 nt, Artificial Sequence
  Synthetic
gucaaaggggccauguguaugug

SEQ ID NO: 44427 - RNA, 24 nt, Artificial Sequence
  Synthetic
agucaaaggggccauguguaugug

SEQ ID NO: 44428 - RNA, 18 nt, Artificial Sequence
  Synthetic
guccuuguguguuuguug

SEQ ID NO: 44429 - RNA, 19 nt, Artificial Sequence
  Synthetic
gguccuuguguguuuguug

SEQ ID NO: 44430 - RNA, 20 nt, Artificial Sequence
  Synthetic
cgguccuuguguguuuguug

SEQ ID NO: 44431 - RNA, 21 nt, Artificial Sequence
  Synthetic
ccgguccuuguguguuuguug

SEQ ID NO: 44432 - RNA, 22 nt, Artificial Sequence
  Synthetic
cccgguccuuguguguuuguug

SEQ ID NO: 44433 - RNA, 23 nt, Artificial Sequence
  Synthetic
ccccgguccuuguguguuuguug

SEQ ID NO: 44434 - RNA, 24 nt, Artificial Sequence
  Synthetic
accccgguccuuguguguuuguug

SEQ ID NO: 44435 - RNA, 18 nt, Artificial Sequence
  Synthetic
aggggggcggguaagaau

SEQ ID NO: 44436 - RNA, 19 nt, Artificial Sequence
  Synthetic
aaggggggcggguaagaau

SEQ ID NO: 44437 - RNA, 20 nt, Artificial Sequence
  Synthetic
aaaggggggcggguaagaau

SEQ ID NO: 44438 - RNA, 21 nt, Artificial Sequence
  Synthetic
aaaaggggggcggguaagaau

SEQ ID NO: 44439 - RNA, 22 nt, Artificial Sequence
  Synthetic
aaaaaggggggcggguaagaau

SEQ ID NO: 44440 - RNA, 23 nt, Artificial Sequence
  Synthetic
aaaaaaggggggcggguaagaau

SEQ ID NO: 44441 - RNA, 24 nt, Artificial Sequence
  Synthetic
gaaaaaaggggggcggguaagaau

SEQ ID NO: 44442 - RNA, 18 nt, Artificial Sequence
  Synthetic
agggaaacacccagacau

SEQ ID NO: 44443 - RNA, 19 nt, Artificial Sequence
  Synthetic
cagggaaacacccagacau

SEQ ID NO: 44444 - RNA, 20 nt, Artificial Sequence
  Synthetic
gcagggaaacacccagacau

SEQ ID NO: 44445 - RNA, 18 nt, Artificial Sequence
  Synthetic
cccgaggcggcccgcccu

SEQ ID NO: 44446 - RNA, 19 nt, Artificial Sequence
  Synthetic
ccccgaggcggcccgcccu

SEQ ID NO: 44447 - RNA, 20 nt, Artificial Sequence
  Synthetic
cccccgaggcggcccgcccu

SEQ ID NO: 44448 - RNA, 21 nt, Artificial Sequence
  Synthetic
gcccccgaggcggcccgcccu

SEQ ID NO: 44449 - RNA, 22 nt, Artificial Sequence
  Synthetic
cgcccccgaggcggcccgcccu

SEQ ID NO: 44450 - RNA, 23 nt, Artificial Sequence
  Synthetic
ccgcccccgaggcggcccgcccu

SEQ ID NO: 44451 - RNA, 24 nt, Artificial Sequence
  Synthetic
cccgcccccgaggcggcccgcccu

SEQ ID NO: 44452 - RNA, 18 nt, Artificial Sequence
  Synthetic
cugccccccugcuggccu

SEQ ID NO: 44453 - RNA, 19 nt, Artificial Sequence
  Synthetic
ccugccccccugcuggccu

SEQ ID NO: 44454 - RNA, 20 nt, Artificial Sequence
  Synthetic
uccugccccccugcuggccu

SEQ ID NO: 44455 - RNA, 21 nt, Artificial Sequence
  Synthetic
guccugccccccugcuggccu

SEQ ID NO: 44456 - RNA, 22 nt, Artificial Sequence
  Synthetic
aguccugccccccugcuggccu

SEQ ID NO: 44457 - RNA, 23 nt, Artificial Sequence
  Synthetic
aaguccugccccccugcuggccu

SEQ ID NO: 44458 - RNA, 24 nt, Artificial Sequence
  Synthetic
aaaguccugccccccugcuggccu

SEQ ID NO: 44459 - RNA, 18 nt, Artificial Sequence
  Synthetic
agacauccggggcgggcu

SEQ ID NO: 44460 - RNA, 19 nt, Artificial Sequence
  Synthetic
cagacauccggggcgggcu

SEQ ID NO: 44461 - RNA, 20 nt, Artificial Sequence
  Synthetic
ccagacauccggggcgggcu

SEQ ID NO: 44462 - RNA, 21 nt, Artificial Sequence
  Synthetic
cccagacauccggggcgggcu

SEQ ID NO: 44463 - RNA, 22 nt, Artificial Sequence
  Synthetic
acccagacauccggggcgggcu

SEQ ID NO: 44464 - RNA, 23 nt, Artificial Sequence
  Synthetic
cacccagacauccggggcgggcu

SEQ ID NO: 44465 - RNA, 24 nt, Artificial Sequence
  Synthetic
acacccagacauccggggcgggcu

SEQ ID NO: 44466 - RNA, 18 nt, Artificial Sequence
  Synthetic
gcuccugccaucgucucu

SEQ ID NO: 44467 - RNA, 19 nt, Artificial Sequence
  Synthetic
ggcuccugccaucgucucu

SEQ ID NO: 44468 - RNA, 20 nt, Artificial Sequence
  Synthetic
cggcuccugccaucgucucu

SEQ ID NO: 44469 - RNA, 21 nt, Artificial Sequence
  Synthetic
gcggcuccugccaucgucucu

SEQ ID NO: 44470 - RNA, 22 nt, Artificial Sequence
  Synthetic
cgcggcuccugccaucgucucu

SEQ ID NO: 44471 - RNA, 23 nt, Artificial Sequence
  Synthetic
gcgcggcuccugccaucgucucu

SEQ ID NO: 44472 - RNA, 24 nt, Artificial Sequence
  Synthetic
ugcgcggcuccugccaucgucucu

SEQ ID NO: 44473 - RNA, 18 nt, Artificial Sequence
  Synthetic
gccugcguaugagucagu

SEQ ID NO: 44474 - RNA, 19 nt, Artificial Sequence
  Synthetic
ggccugcguaugagucagu

SEQ ID NO: 44475 - RNA, 20 nt, Artificial Sequence
  Synthetic
gggccugcguaugagucagu

SEQ ID NO: 44476 - RNA, 21 nt, Artificial Sequence
  Synthetic
ggggccugcguaugagucagu

SEQ ID NO: 44477 - RNA, 22 nt, Artificial Sequence
  Synthetic
gggggccugcguaugagucagu

SEQ ID NO: 44478 - RNA, 23 nt, Artificial Sequence
  Synthetic
ggggggccugcguaugagucagu

SEQ ID NO: 44479 - RNA, 24 nt, Artificial Sequence
  Synthetic
aggggggccugcguaugagucagu

SEQ ID NO: 44480 - RNA, 18 nt, Artificial Sequence
  Synthetic
cuccagacgcaccggagu

SEQ ID NO: 44481 - RNA, 19 nt, Artificial Sequence
  Synthetic
ccuccagacgcaccggagu

SEQ ID NO: 44482 - RNA, 20 nt, Artificial Sequence
  Synthetic
cccuccagacgcaccggagu

SEQ ID NO: 44483 - RNA, 21 nt, Artificial Sequence
  Synthetic
gcccuccagacgcaccggagu

SEQ ID NO: 44484 - RNA, 22 nt, Artificial Sequence
  Synthetic
cgcccuccagacgcaccggagu

SEQ ID NO: 44485 - RNA, 23 nt, Artificial Sequence
  Synthetic
ccgcccuccagacgcaccggagu

SEQ ID NO: 44486 - RNA, 24 nt, Artificial Sequence
  Synthetic
cccgcccuccagacgcaccggagu

SEQ ID NO: 44487 - RNA, 18 nt, Artificial Sequence
  Synthetic
gugucucuguguaugagu

SEQ ID NO: 44488 - RNA, 19 nt, Artificial Sequence
  Synthetic
cgugucucuguguaugagu

SEQ ID NO: 44489 - RNA, 20 nt, Artificial Sequence
  Synthetic
gcgugucucuguguaugagu

SEQ ID NO: 44490 - RNA, 21 nt, Artificial Sequence
  Synthetic
ggcgugucucuguguaugagu

SEQ ID NO: 44491 - RNA, 22 nt, Artificial Sequence
  Synthetic
gggcgugucucuguguaugagu

SEQ ID NO: 44492 - RNA, 23 nt, Artificial Sequence
  Synthetic
ggggcgugucucuguguaugagu

SEQ ID NO: 44493 - RNA, 24 nt, Artificial Sequence
  Synthetic
gggggcgugucucuguguaugagu

SEQ ID NO: 44494 - RNA, 18 nt, Artificial Sequence
  Synthetic
cccuagaugcgugugagu

SEQ ID NO: 44495 - RNA, 19 nt, Artificial Sequence
  Synthetic
ccccuagaugcgugugagu

SEQ ID NO: 44496 - RNA, 20 nt, Artificial Sequence
  Synthetic
cccccuagaugcgugugagu

SEQ ID NO: 44497 - RNA, 21 nt, Artificial Sequence
  Synthetic
ccccccuagaugcgugugagu

SEQ ID NO: 44498 - RNA, 22 nt, Artificial Sequence
  Synthetic
accccccuagaugcgugugagu

SEQ ID NO: 44499 - RNA, 23 nt, Artificial Sequence
  Synthetic
caccccccuagaugcgugugagu

SEQ ID NO: 44500 - RNA, 24 nt, Artificial Sequence
  Synthetic
ccaccccccuagaugcgugugagu

SEQ ID NO: 44501 - RNA, 18 nt, Artificial Sequence
  Synthetic
uccggagagcggcuuggu

SEQ ID NO: 44502 - RNA, 19 nt, Artificial Sequence
  Synthetic
cuccggagagcggcuuggu

SEQ ID NO: 44503 - RNA, 20 nt, Artificial Sequence
  Synthetic
ucuccggagagcggcuuggu

SEQ ID NO: 44504 - RNA, 21 nt, Artificial Sequence
  Synthetic
cucuccggagagcggcuuggu

SEQ ID NO: 44505 - RNA, 22 nt, Artificial Sequence
  Synthetic
ucucuccggagagcggcuuggu

SEQ ID NO: 44506 - RNA, 23 nt, Artificial Sequence
  Synthetic
gucucuccggagagcggcuuggu

SEQ ID NO: 44507 - RNA, 24 nt, Artificial Sequence
  Synthetic
cgucucuccggagagcggcuuggu

SEQ ID NO: 44508 - RNA, 18 nt, Artificial Sequence
  Synthetic
cgaggcggcccgcccugu

SEQ ID NO: 44509 - RNA, 19 nt, Artificial Sequence
  Synthetic
ccgaggcggcccgcccugu

SEQ ID NO: 44510 - RNA, 20 nt, Artificial Sequence
  Synthetic
cccgaggcggcccgcccugu

SEQ ID NO: 44511 - RNA, 21 nt, Artificial Sequence
  Synthetic
ccccgaggcggcccgcccugu

SEQ ID NO: 44512 - RNA, 22 nt, Artificial Sequence
  Synthetic
cccccgaggcggcccgcccugu

SEQ ID NO: 44513 - RNA, 23 nt, Artificial Sequence
  Synthetic
gcccccgaggcggcccgcccugu

SEQ ID NO: 44514 - RNA, 24 nt, Artificial Sequence
  Synthetic
cgcccccgaggcggcccgcccugu

SEQ ID NO: 44515 - RNA, 18 nt, Artificial Sequence
  Synthetic
ggggccauguguaugugu

SEQ ID NO: 44516 - RNA, 19 nt, Artificial Sequence
  Synthetic
aggggccauguguaugugu

SEQ ID NO: 44517 - RNA, 20 nt, Artificial Sequence
  Synthetic
aaggggccauguguaugugu

SEQ ID NO: 44518 - RNA, 21 nt, Artificial Sequence
  Synthetic
aaaggggccauguguaugugu

SEQ ID NO: 44519 - RNA, 22 nt, Artificial Sequence
  Synthetic
caaaggggccauguguaugugu

SEQ ID NO: 44520 - RNA, 23 nt, Artificial Sequence
  Synthetic
ucaaaggggccauguguaugugu

SEQ ID NO: 44521 - RNA, 24 nt, Artificial Sequence
  Synthetic
gucaaaggggccauguguaugugu

SEQ ID NO: 44522 - RNA, 18 nt, Artificial Sequence
  Synthetic
uccuuguguguuuguugu

SEQ ID NO: 44523 - RNA, 19 nt, Artificial Sequence
  Synthetic
guccuuguguguuuguugu

SEQ ID NO: 44524 - RNA, 20 nt, Artificial Sequence
  Synthetic
gguccuuguguguuuguugu

SEQ ID NO: 44525 - RNA, 21 nt, Artificial Sequence
  Synthetic
cgguccuuguguguuuguugu

SEQ ID NO: 44526 - RNA, 22 nt, Artificial Sequence
  Synthetic
ccgguccuuguguguuuguugu

SEQ ID NO: 44527 - RNA, 23 nt, Artificial Sequence
  Synthetic
cccgguccuuguguguuuguugu

SEQ ID NO: 44528 - RNA, 24 nt, Artificial Sequence
  Synthetic
ccccgguccuuguguguuuguugu

SEQ ID NO: 44529 - RNA, 18 nt, Artificial Sequence
  Synthetic
gguccuuguguguuuguu

SEQ ID NO: 44530 - RNA, 19 nt, Artificial Sequence
  Synthetic
cgguccuuguguguuuguu

SEQ ID NO: 44531 - RNA, 20 nt, Artificial Sequence
  Synthetic
ccgguccuuguguguuuguu

SEQ ID NO: 44532 - RNA, 21 nt, Artificial Sequence
  Synthetic
cccgguccuuguguguuuguu

SEQ ID NO: 44533 - RNA, 22 nt, Artificial Sequence
  Synthetic
ccccgguccuuguguguuuguu

SEQ ID NO: 44534 - RNA, 23 nt, Artificial Sequence
  Synthetic
accccgguccuuguguguuuguu

SEQ ID NO: 44535 - RNA, 24 nt, Artificial Sequence
  Synthetic
gaccccgguccuuguguguuuguu

SEQ ID NO: 44536 - RNA, 18 nt, Artificial Sequence
  Synthetic
cgggagaagagggaagaa

SEQ ID NO: 44537 - RNA, 19 nt, Artificial Sequence
  Synthetic
gcgggagaagagggaagaa

SEQ ID NO: 44538 - RNA, 20 nt, Artificial Sequence
  Synthetic
ggcgggagaagagggaagaa

SEQ ID NO: 44539 - RNA, 21 nt, Artificial Sequence
  Synthetic
gggcgggagaagagggaagaa

SEQ ID NO: 44540 - RNA, 22 nt, Artificial Sequence
  Synthetic
agggcgggagaagagggaagaa

SEQ ID NO: 44541 - RNA, 23 nt, Artificial Sequence
  Synthetic
gagggcgggagaagagggaagaa

SEQ ID NO: 44542 - RNA, 24 nt, Artificial Sequence
  Synthetic
ggagggcgggagaagagggaagaa

SEQ ID NO: 44543 - RNA, 18 nt, Artificial Sequence
  Synthetic
gucuggagggcgggagaa

SEQ ID NO: 44544 - RNA, 19 nt, Artificial Sequence
  Synthetic
cgucuggagggcgggagaa

SEQ ID NO: 44545 - RNA, 20 nt, Artificial Sequence
  Synthetic
gcgucuggagggcgggagaa

SEQ ID NO: 44546 - RNA, 21 nt, Artificial Sequence
  Synthetic
ugcgucuggagggcgggagaa

SEQ ID NO: 44547 - RNA, 22 nt, Artificial Sequence
  Synthetic
gugcgucuggagggcgggagaa

SEQ ID NO: 44548 - RNA, 23 nt, Artificial Sequence
  Synthetic
ggugcgucuggagggcgggagaa

SEQ ID NO: 44549 - RNA, 24 nt, Artificial Sequence
  Synthetic
cggugcgucuggagggcgggagaa

SEQ ID NO: 44550 - RNA, 18 nt, Artificial Sequence
  Synthetic
gacccccugacucauaca

SEQ ID NO: 44551 - RNA, 19 nt, Artificial Sequence
  Synthetic
ggacccccugacucauaca

SEQ ID NO: 44552 - RNA, 20 nt, Artificial Sequence
  Synthetic
gggacccccugacucauaca

SEQ ID NO: 44553 - RNA, 21 nt, Artificial Sequence
  Synthetic
ugggacccccugacucauaca

SEQ ID NO: 44554 - RNA, 22 nt, Artificial Sequence
  Synthetic
gugggacccccugacucauaca

SEQ ID NO: 44555 - RNA, 23 nt, Artificial Sequence
  Synthetic
cgugggacccccugacucauaca

SEQ ID NO: 44556 - RNA, 24 nt, Artificial Sequence
  Synthetic
ccgugggacccccugacucauaca

SEQ ID NO: 44557 - RNA, 18 nt, Artificial Sequence
  Synthetic
ggcgggaguuaccgccca

SEQ ID NO: 44558 - RNA, 19 nt, Artificial Sequence
  Synthetic
gggcgggaguuaccgccca

SEQ ID NO: 44559 - RNA, 20 nt, Artificial Sequence
  Synthetic
ugggcgggaguuaccgccca

SEQ ID NO: 44560 - RNA, 21 nt, Artificial Sequence
  Synthetic
uugggcgggaguuaccgccca

SEQ ID NO: 44561 - RNA, 22 nt, Artificial Sequence
  Synthetic
auugggcgggaguuaccgccca

SEQ ID NO: 44562 - RNA, 23 nt, Artificial Sequence
  Synthetic
cauugggcgggaguuaccgccca

SEQ ID NO: 44563 - RNA, 24 nt, Artificial Sequence
  Synthetic
ccauugggcgggaguuaccgccca

SEQ ID NO: 44564 - RNA, 18 nt, Artificial Sequence
  Synthetic
ucuucggggcccggccca

SEQ ID NO: 44565 - RNA, 19 nt, Artificial Sequence
  Synthetic
gucuucggggcccggccca

SEQ ID NO: 44566 - RNA, 20 nt, Artificial Sequence
  Synthetic
agucuucggggcccggccca

SEQ ID NO: 44567 - RNA, 21 nt, Artificial Sequence
  Synthetic
gagucuucggggcccggccca

SEQ ID NO: 44568 - RNA, 22 nt, Artificial Sequence
  Synthetic
cgagucuucggggcccggccca

SEQ ID NO: 44569 - RNA, 23 nt, Artificial Sequence
  Synthetic
ccgagucuucggggcccggccca

SEQ ID NO: 44570 - RNA, 24 nt, Artificial Sequence
  Synthetic
gccgagucuucggggcccggccca

SEQ ID NO: 44571 - RNA, 18 nt, Artificial Sequence
  Synthetic
aagaggggucgggaucca

SEQ ID NO: 44572 - RNA, 19 nt, Artificial Sequence
  Synthetic
gaagaggggucgggaucca

SEQ ID NO: 44573 - RNA, 20 nt, Artificial Sequence
  Synthetic
agaagaggggucgggaucca

SEQ ID NO: 44574 - RNA, 21 nt, Artificial Sequence
  Synthetic
aagaagaggggucgggaucca

SEQ ID NO: 44575 - RNA, 22 nt, Artificial Sequence
  Synthetic
gaagaagaggggucgggaucca

SEQ ID NO: 44576 - RNA, 23 nt, Artificial Sequence
  Synthetic
ggaagaagaggggucgggaucca

SEQ ID NO: 44577 - RNA, 24 nt, Artificial Sequence
  Synthetic
gggaagaagaggggucgggaucca

SEQ ID NO: 44578 - RNA, 18 nt, Artificial Sequence
  Synthetic
ccucuuccgaggccagca

SEQ ID NO: 44579 - RNA, 19 nt, Artificial Sequence
  Synthetic
cccucuuccgaggccagca

SEQ ID NO: 44580 - RNA, 20 nt, Artificial Sequence
  Synthetic
ccccucuuccgaggccagca

SEQ ID NO: 44581 - RNA, 21 nt, Artificial Sequence
  Synthetic
cccccucuuccgaggccagca

SEQ ID NO: 44582 - RNA, 22 nt, Artificial Sequence
  Synthetic
ccccccucuuccgaggccagca

SEQ ID NO: 44583 - RNA, 23 nt, Artificial Sequence
  Synthetic
uccccccucuuccgaggccagca

SEQ ID NO: 44584 - RNA, 24 nt, Artificial Sequence
  Synthetic
cuccccccucuuccgaggccagca

SEQ ID NO: 44585 - RNA, 18 nt, Artificial Sequence
  Synthetic
ggagccagcccgcccuca

SEQ ID NO: 44586 - RNA, 19 nt, Artificial Sequence
  Synthetic
uggagccagcccgcccuca

SEQ ID NO: 44587 - RNA, 20 nt, Artificial Sequence
  Synthetic
uuggagccagcccgcccuca

SEQ ID NO: 44588 - RNA, 21 nt, Artificial Sequence
  Synthetic
cuuggagccagcccgcccuca

SEQ ID NO: 44589 - RNA, 22 nt, Artificial Sequence
  Synthetic
gcuuggagccagcccgcccuca

SEQ ID NO: 44590 - RNA, 23 nt, Artificial Sequence
  Synthetic
cgcuuggagccagcccgcccuca

SEQ ID NO: 44591 - RNA, 24 nt, Artificial Sequence
  Synthetic
acgcuuggagccagcccgcccuca

SEQ ID NO: 44592 - RNA, 18 nt, Artificial Sequence
  Synthetic
cggaggccgaggcgguca

SEQ ID NO: 44593 - RNA, 19 nt, Artificial Sequence
  Synthetic
gcggaggccgaggcgguca

SEQ ID NO: 44594 - RNA, 20 nt, Artificial Sequence
  Synthetic
ggcggaggccgaggcgguca

SEQ ID NO: 44595 - RNA, 21 nt, Artificial Sequence
  Synthetic
uggcggaggccgaggcgguca

SEQ ID NO: 44596 - RNA, 22 nt, Artificial Sequence
  Synthetic
guggcggaggccgaggcgguca

SEQ ID NO: 44597 - RNA, 23 nt, Artificial Sequence
  Synthetic
gguggcggaggccgaggcgguca

SEQ ID NO: 44598 - RNA, 24 nt, Artificial Sequence
  Synthetic
ggguggcggaggccgaggcgguca

SEQ ID NO: 44599 - RNA, 18 nt, Artificial Sequence
  Synthetic
cuggagggcgggagaaga

SEQ ID NO: 44600 - RNA, 19 nt, Artificial Sequence
  Synthetic
ucuggagggcgggagaaga

SEQ ID NO: 44601 - RNA, 20 nt, Artificial Sequence
  Synthetic
gucuggagggcgggagaaga

SEQ ID NO: 44602 - RNA, 21 nt, Artificial Sequence
  Synthetic
cgucuggagggcgggagaaga

SEQ ID NO: 44603 - RNA, 22 nt, Artificial Sequence
  Synthetic
gcgucuggagggcgggagaaga

SEQ ID NO: 44604 - RNA, 23 nt, Artificial Sequence
  Synthetic
ugcgucuggagggcgggagaaga

SEQ ID NO: 44605 - RNA, 24 nt, Artificial Sequence
  Synthetic
gugcgucuggagggcgggagaaga

SEQ ID NO: 44606 - RNA, 18 nt, Artificial Sequence
  Synthetic
ugaggcgggggggggaga

SEQ ID NO: 44607 - RNA, 19 nt, Artificial Sequence
  Synthetic
gugaggcgggggggggaga

SEQ ID NO: 44608 - RNA, 20 nt, Artificial Sequence
  Synthetic
ugugaggcgggggggggaga

SEQ ID NO: 44609 - RNA, 21 nt, Artificial Sequence
  Synthetic
uugugaggcgggggggggaga

SEQ ID NO: 44610 - RNA, 22 nt, Artificial Sequence
  Synthetic
uuugugaggcgggggggggaga

SEQ ID NO: 44611 - RNA, 23 nt, Artificial Sequence
  Synthetic
cuuugugaggcgggggggggaga

SEQ ID NO: 44612 - RNA, 24 nt, Artificial Sequence
  Synthetic
acuuugugaggcgggggggggaga

SEQ ID NO: 44613 - RNA, 18 nt, Artificial Sequence
  Synthetic
ggcccgcgagcgggccga

SEQ ID NO: 44614 - RNA, 19 nt, Artificial Sequence
  Synthetic
gggcccgcgagcgggccga

SEQ ID NO: 44615 - RNA, 20 nt, Artificial Sequence
  Synthetic
ugggcccgcgagcgggccga

SEQ ID NO: 44616 - RNA, 21 nt, Artificial Sequence
  Synthetic
gugggcccgcgagcgggccga

SEQ ID NO: 44617 - RNA, 22 nt, Artificial Sequence
  Synthetic
cgugggcccgcgagcgggccga

SEQ ID NO: 44618 - RNA, 23 nt, Artificial Sequence
  Synthetic
ucgugggcccgcgagcgggccga

SEQ ID NO: 44619 - RNA, 24 nt, Artificial Sequence
  Synthetic
cucgugggcccgcgagcgggccga

SEQ ID NO: 44620 - RNA, 18 nt, Artificial Sequence
  Synthetic
cggcucgugggcccgcga

SEQ ID NO: 44621 - RNA, 19 nt, Artificial Sequence
  Synthetic
gcggcucgugggcccgcga

SEQ ID NO: 44622 - RNA, 20 nt, Artificial Sequence
  Synthetic
cgcggcucgugggcccgcga

SEQ ID NO: 44623 - RNA, 18 nt, Artificial Sequence
  Synthetic
acaacaaacacacaagga

SEQ ID NO: 44624 - RNA, 19 nt, Artificial Sequence
  Synthetic
cacaacaaacacacaagga

SEQ ID NO: 44625 - RNA, 20 nt, Artificial Sequence
  Synthetic
ccacaacaaacacacaagga

SEQ ID NO: 44626 - RNA, 21 nt, Artificial Sequence
  Synthetic
cccacaacaaacacacaagga

SEQ ID NO: 44627 - RNA, 22 nt, Artificial Sequence
  Synthetic
ccccacaacaaacacacaagga

SEQ ID NO: 44628 - RNA, 23 nt, Artificial Sequence
  Synthetic
cccccacaacaaacacacaagga

SEQ ID NO: 44629 - RNA, 24 nt, Artificial Sequence
  Synthetic
gcccccacaacaaacacacaagga

SEQ ID NO: 44630 - RNA, 18 nt, Artificial Sequence
  Synthetic
ugugaggcggggggggga

SEQ ID NO: 44631 - RNA, 19 nt, Artificial Sequence
  Synthetic
uugugaggcggggggggga

SEQ ID NO: 44632 - RNA, 20 nt, Artificial Sequence
  Synthetic
uuugugaggcggggggggga

SEQ ID NO: 44633 - RNA, 21 nt, Artificial Sequence
  Synthetic
cuuugugaggcggggggggga

SEQ ID NO: 44634 - RNA, 22 nt, Artificial Sequence
  Synthetic
acuuugugaggcggggggggga

SEQ ID NO: 44635 - RNA, 23 nt, Artificial Sequence
  Synthetic
gacuuugugaggcggggggggga

SEQ ID NO: 44636 - RNA, 24 nt, Artificial Sequence
  Synthetic
ggacuuugugaggcggggggggga

SEQ ID NO: 44637 - RNA, 18 nt, Artificial Sequence
  Synthetic
cuuacucacacgcaucua

SEQ ID NO: 44638 - RNA, 19 nt, Artificial Sequence
  Synthetic
ccuuacucacacgcaucua

SEQ ID NO: 44639 - RNA, 20 nt, Artificial Sequence
  Synthetic
cccuuacucacacgcaucua

SEQ ID NO: 44640 - RNA, 21 nt, Artificial Sequence
  Synthetic
ccccuuacucacacgcaucua

SEQ ID NO: 44641 - RNA, 22 nt, Artificial Sequence
  Synthetic
cccccuuacucacacgcaucua

SEQ ID NO: 44642 - RNA, 23 nt, Artificial Sequence
  Synthetic
ccccccuuacucacacgcaucua

SEQ ID NO: 44643 - RNA, 24 nt, Artificial Sequence
  Synthetic
gccccccuuacucacacgcaucua

SEQ ID NO: 44644 - RNA, 18 nt, Artificial Sequence
  Synthetic
guaauuagaaacucauua

SEQ ID NO: 44645 - RNA, 19 nt, Artificial Sequence
  Synthetic
gguaauuagaaacucauua

SEQ ID NO: 44646 - RNA, 20 nt, Artificial Sequence
  Synthetic
ugguaauuagaaacucauua

SEQ ID NO: 44647 - RNA, 21 nt, Artificial Sequence
  Synthetic
augguaauuagaaacucauua

SEQ ID NO: 44648 - RNA, 22 nt, Artificial Sequence
  Synthetic
uaugguaauuagaaacucauua

SEQ ID NO: 44649 - RNA, 23 nt, Artificial Sequence
  Synthetic
guaugguaauuagaaacucauua

SEQ ID NO: 44650 - RNA, 24 nt, Artificial Sequence
  Synthetic
gguaugguaauuagaaacucauua

SEQ ID NO: 44651 - RNA, 18 nt, Artificial Sequence
  Synthetic
cccccacaacaaacacac

SEQ ID NO: 44652 - RNA, 19 nt, Artificial Sequence
  Synthetic
gcccccacaacaaacacac

SEQ ID NO: 44653 - RNA, 20 nt, Artificial Sequence
  Synthetic
cgcccccacaacaaacacac

SEQ ID NO: 44654 - RNA, 21 nt, Artificial Sequence
  Synthetic
acgcccccacaacaaacacac

SEQ ID NO: 44655 - RNA, 22 nt, Artificial Sequence
  Synthetic
cacgcccccacaacaaacacac

SEQ ID NO: 44656 - RNA, 23 nt, Artificial Sequence
  Synthetic
acacgcccccacaacaaacacac

SEQ ID NO: 44657 - RNA, 24 nt, Artificial Sequence
  Synthetic
gacacgcccccacaacaaacacac

SEQ ID NO: 44658 - RNA, 18 nt, Artificial Sequence
  Synthetic
cucggucuaacguuacac

SEQ ID NO: 44659 - RNA, 19 nt, Artificial Sequence
  Synthetic
acucggucuaacguuacac

SEQ ID NO: 44660 - RNA, 20 nt, Artificial Sequence
  Synthetic
aacucggucuaacguuacac

SEQ ID NO: 44661 - RNA, 21 nt, Artificial Sequence
  Synthetic
gaacucggucuaacguuacac

SEQ ID NO: 44662 - RNA, 22 nt, Artificial Sequence
  Synthetic
cgaacucggucuaacguuacac

SEQ ID NO: 44663 - RNA, 23 nt, Artificial Sequence
  Synthetic
gcgaacucggucuaacguuacac

SEQ ID NO: 44664 - RNA, 24 nt, Artificial Sequence
  Synthetic
ggcgaacucggucuaacguuacac

SEQ ID NO: 44665 - RNA, 18 nt, Artificial Sequence
  Synthetic
ucgugggugcugauugac

SEQ ID NO: 44666 - RNA, 19 nt, Artificial Sequence
  Synthetic
cucgugggugcugauugac

SEQ ID NO: 44667 - RNA, 20 nt, Artificial Sequence
  Synthetic
acucgugggugcugauugac

SEQ ID NO: 44668 - RNA, 21 nt, Artificial Sequence
  Synthetic
aacucgugggugcugauugac

SEQ ID NO: 44669 - RNA, 22 nt, Artificial Sequence
  Synthetic
gaacucgugggugcugauugac

SEQ ID NO: 44670 - RNA, 23 nt, Artificial Sequence
  Synthetic
ggaacucgugggugcugauugac

SEQ ID NO: 44671 - RNA, 24 nt, Artificial Sequence
  Synthetic
gggaacucgugggugcugauugac

SEQ ID NO: 44672 - RNA, 18 nt, Artificial Sequence
  Synthetic
gugcccgggcccuggccc

SEQ ID NO: 44673 - RNA, 19 nt, Artificial Sequence
  Synthetic
cgugcccgggcccuggccc

SEQ ID NO: 44674 - RNA, 20 nt, Artificial Sequence
  Synthetic
ccgugcccgggcccuggccc

SEQ ID NO: 44675 - RNA, 21 nt, Artificial Sequence
  Synthetic
cccgugcccgggcccuggccc

SEQ ID NO: 44676 - RNA, 22 nt, Artificial Sequence
  Synthetic
gcccgugcccgggcccuggccc

SEQ ID NO: 44677 - RNA, 23 nt, Artificial Sequence
  Synthetic
ggcccgugcccgggcccuggccc

SEQ ID NO: 44678 - RNA, 24 nt, Artificial Sequence
  Synthetic
aggcccgugcccgggcccuggccc

SEQ ID NO: 44679 - RNA, 18 nt, Artificial Sequence
  Synthetic
gucuuccgcggagcuccc

SEQ ID NO: 44680 - RNA, 19 nt, Artificial Sequence
  Synthetic
ggucuuccgcggagcuccc

SEQ ID NO: 44681 - RNA, 20 nt, Artificial Sequence
  Synthetic
gggucuuccgcggagcuccc

SEQ ID NO: 44682 - RNA, 21 nt, Artificial Sequence
  Synthetic
ugggucuuccgcggagcuccc

SEQ ID NO: 44683 - RNA, 22 nt, Artificial Sequence
  Synthetic
cugggucuuccgcggagcuccc

SEQ ID NO: 44684 - RNA, 23 nt, Artificial Sequence
  Synthetic
ccugggucuuccgcggagcuccc

SEQ ID NO: 44685 - RNA, 24 nt, Artificial Sequence
  Synthetic
gccugggucuuccgcggagcuccc

SEQ ID NO: 44686 - RNA, 18 nt, Artificial Sequence
  Synthetic
ccauauuugggggacgcc

SEQ ID NO: 44687 - RNA, 19 nt, Artificial Sequence
  Synthetic
gccauauuugggggacgcc

SEQ ID NO: 44688 - RNA, 20 nt, Artificial Sequence
  Synthetic
cgccauauuugggggacgcc

SEQ ID NO: 44689 - RNA, 21 nt, Artificial Sequence
  Synthetic
ccgccauauuugggggacgcc

SEQ ID NO: 44690 - RNA, 22 nt, Artificial Sequence
  Synthetic
cccgccauauuugggggacgcc

SEQ ID NO: 44691 - RNA, 23 nt, Artificial Sequence
  Synthetic
gcccgccauauuugggggacgcc

SEQ ID NO: 44692 - RNA, 24 nt, Artificial Sequence
  Synthetic
cgcccgccauauuugggggacgcc

SEQ ID NO: 44693 - RNA, 18 nt, Artificial Sequence
  Synthetic
cucacagggcgggccgcc

SEQ ID NO: 44694 - RNA, 19 nt, Artificial Sequence
  Synthetic
ccucacagggcgggccgcc

SEQ ID NO: 44695 - RNA, 20 nt, Artificial Sequence
  Synthetic
cccucacagggcgggccgcc

SEQ ID NO: 44696 - RNA, 21 nt, Artificial Sequence
  Synthetic
gcccucacagggcgggccgcc

SEQ ID NO: 44697 - RNA, 22 nt, Artificial Sequence
  Synthetic
cgcccucacagggcgggccgcc

SEQ ID NO: 44698 - RNA, 23 nt, Artificial Sequence
  Synthetic
ccgcccucacagggcgggccgcc

SEQ ID NO: 44699 - RNA, 24 nt, Artificial Sequence
  Synthetic
cccgcccucacagggcgggccgcc

SEQ ID NO: 44700 - RNA, 18 nt, Artificial Sequence
  Synthetic
gcagggcccggggucgcc

SEQ ID NO: 44701 - RNA, 19 nt, Artificial Sequence
  Synthetic
cgcagggcccggggucgcc

SEQ ID NO: 44702 - RNA, 20 nt, Artificial Sequence
  Synthetic
acgcagggcccggggucgcc

SEQ ID NO: 44703 - RNA, 21 nt, Artificial Sequence
  Synthetic
gacgcagggcccggggucgcc

SEQ ID NO: 44704 - RNA, 22 nt, Artificial Sequence
  Synthetic
agacgcagggcccggggucgcc

SEQ ID NO: 44705 - RNA, 23 nt, Artificial Sequence
  Synthetic
cagacgcagggcccggggucgcc

SEQ ID NO: 44706 - RNA, 24 nt, Artificial Sequence
  Synthetic
ucagacgcagggcccggggucgcc

SEQ ID NO: 44707 - RNA, 18 nt, Artificial Sequence
  Synthetic
cggucaucgggccgugcc

SEQ ID NO: 44708 - RNA, 19 nt, Artificial Sequence
  Synthetic
gcggucaucgggccgugcc

SEQ ID NO: 44709 - RNA, 20 nt, Artificial Sequence
  Synthetic
ggcggucaucgggccgugcc

SEQ ID NO: 44710 - RNA, 21 nt, Artificial Sequence
  Synthetic
aggcggucaucgggccgugcc

SEQ ID NO: 44711 - RNA, 22 nt, Artificial Sequence
  Synthetic
gaggcggucaucgggccgugcc

SEQ ID NO: 44712 - RNA, 23 nt, Artificial Sequence
  Synthetic
cgaggcggucaucgggccgugcc

SEQ ID NO: 44713 - RNA, 24 nt, Artificial Sequence
  Synthetic
ccgaggcggucaucgggccgugcc

SEQ ID NO: 44714 - RNA, 18 nt, Artificial Sequence
  Synthetic
ggucuuccgcggagcucc

SEQ ID NO: 44715 - RNA, 19 nt, Artificial Sequence
  Synthetic
gggucuuccgcggagcucc

SEQ ID NO: 44716 - RNA, 20 nt, Artificial Sequence
  Synthetic
ugggucuuccgcggagcucc

SEQ ID NO: 44717 - RNA, 21 nt, Artificial Sequence
  Synthetic
cugggucuuccgcggagcucc

SEQ ID NO: 44718 - RNA, 22 nt, Artificial Sequence
  Synthetic
ccugggucuuccgcggagcucc

SEQ ID NO: 44719 - RNA, 23 nt, Artificial Sequence
  Synthetic
gccugggucuuccgcggagcucc

SEQ ID NO: 44720 - RNA, 24 nt, Artificial Sequence
  Synthetic
ggccugggucuuccgcggagcucc

SEQ ID NO: 44721 - RNA, 18 nt, Artificial Sequence
  Synthetic
aggcggccugggucuucc

SEQ ID NO: 44722 - RNA, 19 nt, Artificial Sequence
  Synthetic
gaggcggccugggucuucc

SEQ ID NO: 44723 - RNA, 20 nt, Artificial Sequence
  Synthetic
cgaggcggccugggucuucc

SEQ ID NO: 44724 - RNA, 21 nt, Artificial Sequence
  Synthetic
ccgaggcggccugggucuucc

SEQ ID NO: 44725 - RNA, 22 nt, Artificial Sequence
  Synthetic
cccgaggcggccugggucuucc

SEQ ID NO: 44726 - RNA, 23 nt, Artificial Sequence
  Synthetic
acccgaggcggccugggucuucc

SEQ ID NO: 44727 - RNA, 24 nt, Artificial Sequence
  Synthetic
cacccgaggcggccugggucuucc

SEQ ID NO: 44728 - RNA, 18 nt, Artificial Sequence
  Synthetic
cccucuuccgaggccagc

SEQ ID NO: 44729 - RNA, 19 nt, Artificial Sequence
  Synthetic
ccccucuuccgaggccagc

SEQ ID NO: 44730 - RNA, 20 nt, Artificial Sequence
  Synthetic
cccccucuuccgaggccagc

SEQ ID NO: 44731 - RNA, 21 nt, Artificial Sequence
  Synthetic
ccccccucuuccgaggccagc

SEQ ID NO: 44732 - RNA, 22 nt, Artificial Sequence
  Synthetic
uccccccucuuccgaggccagc

SEQ ID NO: 44733 - RNA, 23 nt, Artificial Sequence
  Synthetic
cuccccccucuuccgaggccagc

SEQ ID NO: 44734 - RNA, 24 nt, Artificial Sequence
  Synthetic
ucuccccccucuuccgaggccagc

SEQ ID NO: 44735 - RNA, 18 nt, Artificial Sequence
  Synthetic
gugggugcugauugacgc

SEQ ID NO: 44736 - RNA, 19 nt, Artificial Sequence
  Synthetic
cgugggugcugauugacgc

SEQ ID NO: 44737 - RNA, 20 nt, Artificial Sequence
  Synthetic
ucgugggugcugauugacgc

SEQ ID NO: 44738 - RNA, 21 nt, Artificial Sequence
  Synthetic
cucgugggugcugauugacgc

SEQ ID NO: 44739 - RNA, 22 nt, Artificial Sequence
  Synthetic
acucgugggugcugauugacgc

SEQ ID NO: 44740 - RNA, 23 nt, Artificial Sequence
  Synthetic
aacucgugggugcugauugacgc

SEQ ID NO: 44741 - RNA, 24 nt, Artificial Sequence
  Synthetic
gaacucgugggugcugauugacgc

SEQ ID NO: 44742 - RNA, 18 nt, Artificial Sequence
  Synthetic
agccgcgcauauauacgc

SEQ ID NO: 44743 - RNA, 19 nt, Artificial Sequence
  Synthetic
gagccgcgcauauauacgc

SEQ ID NO: 44744 - RNA, 20 nt, Artificial Sequence
  Synthetic
ggagccgcgcauauauacgc

SEQ ID NO: 44745 - RNA, 21 nt, Artificial Sequence
  Synthetic
aggagccgcgcauauauacgc

SEQ ID NO: 44746 - RNA, 22 nt, Artificial Sequence
  Synthetic
caggagccgcgcauauauacgc

SEQ ID NO: 44747 - RNA, 23 nt, Artificial Sequence
  Synthetic
gcaggagccgcgcauauauacgc

SEQ ID NO: 44748 - RNA, 24 nt, Artificial Sequence
  Synthetic
ggcaggagccgcgcauauauacgc

SEQ ID NO: 44749 - RNA, 18 nt, Artificial Sequence
  Synthetic
ggcaggacuuugugaggc

SEQ ID NO: 44750 - RNA, 19 nt, Artificial Sequence
  Synthetic
gggcaggacuuugugaggc

SEQ ID NO: 44751 - RNA, 20 nt, Artificial Sequence
  Synthetic
ggggcaggacuuugugaggc

SEQ ID NO: 44752 - RNA, 21 nt, Artificial Sequence
  Synthetic
gggggcaggacuuugugaggc

SEQ ID NO: 44753 - RNA, 22 nt, Artificial Sequence
  Synthetic
ggggggcaggacuuugugaggc

SEQ ID NO: 44754 - RNA, 23 nt, Artificial Sequence
  Synthetic
aggggggcaggacuuugugaggc

SEQ ID NO: 44755 - RNA, 24 nt, Artificial Sequence
  Synthetic
caggggggcaggacuuugugaggc

SEQ ID NO: 44756 - RNA, 18 nt, Artificial Sequence
  Synthetic
uugacucagacgcagggc

SEQ ID NO: 44757 - RNA, 19 nt, Artificial Sequence
  Synthetic
uuugacucagacgcagggc

SEQ ID NO: 44758 - RNA, 20 nt, Artificial Sequence
  Synthetic
cuuugacucagacgcagggc

SEQ ID NO: 44759 - RNA, 21 nt, Artificial Sequence
  Synthetic
ccuuugacucagacgcagggc

SEQ ID NO: 44760 - RNA, 22 nt, Artificial Sequence
  Synthetic
cccuuugacucagacgcagggc

SEQ ID NO: 44761 - RNA, 23 nt, Artificial Sequence
  Synthetic
ccccuuugacucagacgcagggc

SEQ ID NO: 44762 - RNA, 24 nt, Artificial Sequence
  Synthetic
gccccuuugacucagacgcagggc

SEQ ID NO: 44763 - RNA, 18 nt, Artificial Sequence
  Synthetic
ccggugcgucuggagggc

SEQ ID NO: 44764 - RNA, 19 nt, Artificial Sequence
  Synthetic
uccggugcgucuggagggc

SEQ ID NO: 44765 - RNA, 20 nt, Artificial Sequence
  Synthetic
cuccggugcgucuggagggc

SEQ ID NO: 44766 - RNA, 21 nt, Artificial Sequence
  Synthetic
acuccggugcgucuggagggc

SEQ ID NO: 44767 - RNA, 22 nt, Artificial Sequence
  Synthetic
gacuccggugcgucuggagggc

SEQ ID NO: 44768 - RNA, 23 nt, Artificial Sequence
  Synthetic
cgacuccggugcgucuggagggc

SEQ ID NO: 44769 - RNA, 24 nt, Artificial Sequence
  Synthetic
ccgacuccggugcgucuggagggc

SEQ ID NO: 44770 - RNA, 18 nt, Artificial Sequence
  Synthetic
ucgggccgugccuggggc

SEQ ID NO: 44771 - RNA, 19 nt, Artificial Sequence
  Synthetic
aucgggccgugccuggggc

SEQ ID NO: 44772 - RNA, 20 nt, Artificial Sequence
  Synthetic
caucgggccgugccuggggc

SEQ ID NO: 44773 - RNA, 21 nt, Artificial Sequence
  Synthetic
ucaucgggccgugccuggggc

SEQ ID NO: 44774 - RNA, 22 nt, Artificial Sequence
  Synthetic
gucaucgggccgugccuggggc

SEQ ID NO: 44775 - RNA, 23 nt, Artificial Sequence
  Synthetic
ggucaucgggccgugccuggggc

SEQ ID NO: 44776 - RNA, 24 nt, Artificial Sequence
  Synthetic
cggucaucgggccgugccuggggc

SEQ ID NO: 44777 - RNA, 18 nt, Artificial Sequence
  Synthetic
cuccggagagacgauggc

SEQ ID NO: 44778 - RNA, 19 nt, Artificial Sequence
  Synthetic
ucuccggagagacgauggc

SEQ ID NO: 44779 - RNA, 20 nt, Artificial Sequence
  Synthetic
cucuccggagagacgauggc

SEQ ID NO: 44780 - RNA, 21 nt, Artificial Sequence
  Synthetic
gcucuccggagagacgauggc

SEQ ID NO: 44781 - RNA, 22 nt, Artificial Sequence
  Synthetic
cgcucuccggagagacgauggc

SEQ ID NO: 44782 - RNA, 23 nt, Artificial Sequence
  Synthetic
ccgcucuccggagagacgauggc

SEQ ID NO: 44783 - RNA, 24 nt, Artificial Sequence
  Synthetic
gccgcucuccggagagacgauggc

SEQ ID NO: 44784 - RNA, 18 nt, Artificial Sequence
  Synthetic
ggggcccgaggcccgugc

SEQ ID NO: 44785 - RNA, 19 nt, Artificial Sequence
  Synthetic
uggggcccgaggcccgugc

SEQ ID NO: 44786 - RNA, 20 nt, Artificial Sequence
  Synthetic
cuggggcccgaggcccgugc

SEQ ID NO: 44787 - RNA, 21 nt, Artificial Sequence
  Synthetic
ccuggggcccgaggcccgugc

SEQ ID NO: 44788 - RNA, 22 nt, Artificial Sequence
  Synthetic
gccuggggcccgaggcccgugc

SEQ ID NO: 44789 - RNA, 23 nt, Artificial Sequence
  Synthetic
ugccuggggcccgaggcccgugc

SEQ ID NO: 44790 - RNA, 24 nt, Artificial Sequence
  Synthetic
gugccuggggcccgaggcccgugc

SEQ ID NO: 44791 - RNA, 18 nt, Artificial Sequence
  Synthetic
gcggucaucgggccgugc

SEQ ID NO: 44792 - RNA, 19 nt, Artificial Sequence
  Synthetic
ggcggucaucgggccgugc

SEQ ID NO: 44793 - RNA, 20 nt, Artificial Sequence
  Synthetic
aggcggucaucgggccgugc

SEQ ID NO: 44794 - RNA, 21 nt, Artificial Sequence
  Synthetic
gaggcggucaucgggccgugc

SEQ ID NO: 44795 - RNA, 22 nt, Artificial Sequence
  Synthetic
cgaggcggucaucgggccgugc

SEQ ID NO: 44796 - RNA, 23 nt, Artificial Sequence
  Synthetic
ccgaggcggucaucgggccgugc

SEQ ID NO: 44797 - RNA, 24 nt, Artificial Sequence
  Synthetic
gccgaggcggucaucgggccgugc

SEQ ID NO: 44798 - RNA, 18 nt, Artificial Sequence
  Synthetic
ugguaauuaaaaacuugc

SEQ ID NO: 44799 - RNA, 19 nt, Artificial Sequence
  Synthetic
augguaauuaaaaacuugc

SEQ ID NO: 44800 - RNA, 20 nt, Artificial Sequence
  Synthetic
uaugguaauuaaaaacuugc

SEQ ID NO: 44801 - RNA, 21 nt, Artificial Sequence
  Synthetic
guaugguaauuaaaaacuugc

SEQ ID NO: 44802 - RNA, 22 nt, Artificial Sequence
  Synthetic
gguaugguaauuaaaaacuugc

SEQ ID NO: 44803 - RNA, 23 nt, Artificial Sequence
  Synthetic
cgguaugguaauuaaaaacuugc

SEQ ID NO: 44804 - RNA, 24 nt, Artificial Sequence
  Synthetic
ccgguaugguaauuaaaaacuugc

SEQ ID NO: 44805 - RNA, 18 nt, Artificial Sequence
  Synthetic
cccuuacucacacgcauc

SEQ ID NO: 44806 - RNA, 19 nt, Artificial Sequence
  Synthetic
ccccuuacucacacgcauc

SEQ ID NO: 44807 - RNA, 20 nt, Artificial Sequence
  Synthetic
cccccuuacucacacgcauc

SEQ ID NO: 44808 - RNA, 21 nt, Artificial Sequence
  Synthetic
ccccccuuacucacacgcauc

SEQ ID NO: 44809 - RNA, 22 nt, Artificial Sequence
  Synthetic
gccccccuuacucacacgcauc

SEQ ID NO: 44810 - RNA, 23 nt, Artificial Sequence
  Synthetic
ggccccccuuacucacacgcauc

SEQ ID NO: 44811 - RNA, 24 nt, Artificial Sequence
  Synthetic
aggccccccuuacucacacgcauc

SEQ ID NO: 44812 - RNA, 18 nt, Artificial Sequence
  Synthetic
cacagggcgggccgccuc

SEQ ID NO: 44813 - RNA, 19 nt, Artificial Sequence
  Synthetic
ucacagggcgggccgccuc

SEQ ID NO: 44814 - RNA, 20 nt, Artificial Sequence
  Synthetic
cucacagggcgggccgccuc

SEQ ID NO: 44815 - RNA, 21 nt, Artificial Sequence
  Synthetic
ccucacagggcgggccgccuc

SEQ ID NO: 44816 - RNA, 22 nt, Artificial Sequence
  Synthetic
cccucacagggcgggccgccuc

SEQ ID NO: 44817 - RNA, 23 nt, Artificial Sequence
  Synthetic
gcccucacagggcgggccgccuc

SEQ ID NO: 44818 - RNA, 24 nt, Artificial Sequence
  Synthetic
cgcccucacagggcgggccgccuc

SEQ ID NO: 44819 - RNA, 18 nt, Artificial Sequence
  Synthetic
gggucuuccgcggagcuc

SEQ ID NO: 44820 - RNA, 19 nt, Artificial Sequence
  Synthetic
ugggucuuccgcggagcuc

SEQ ID NO: 44821 - RNA, 20 nt, Artificial Sequence
  Synthetic
cugggucuuccgcggagcuc

SEQ ID NO: 44822 - RNA, 21 nt, Artificial Sequence
  Synthetic
ccugggucuuccgcggagcuc

SEQ ID NO: 44823 - RNA, 22 nt, Artificial Sequence
  Synthetic
gccugggucuuccgcggagcuc

SEQ ID NO: 44824 - RNA, 23 nt, Artificial Sequence
  Synthetic
ggccugggucuuccgcggagcuc

SEQ ID NO: 44825 - RNA, 24 nt, Artificial Sequence
  Synthetic
cggccugggucuuccgcggagcuc

SEQ ID NO: 44826 - RNA, 18 nt, Artificial Sequence
  Synthetic
ccgcaccaagccgcucuc

SEQ ID NO: 44827 - RNA, 19 nt, Artificial Sequence
  Synthetic
uccgcaccaagccgcucuc

SEQ ID NO: 44828 - RNA, 20 nt, Artificial Sequence
  Synthetic
cuccgcaccaagccgcucuc

SEQ ID NO: 44829 - RNA, 21 nt, Artificial Sequence
  Synthetic
gcuccgcaccaagccgcucuc

SEQ ID NO: 44830 - RNA, 22 nt, Artificial Sequence
  Synthetic
agcuccgcaccaagccgcucuc

SEQ ID NO: 44831 - RNA, 23 nt, Artificial Sequence
  Synthetic
gagcuccgcaccaagccgcucuc

SEQ ID NO: 44832 - RNA, 24 nt, Artificial Sequence
  Synthetic
ggagcuccgcaccaagccgcucuc

SEQ ID NO: 44833 - RNA, 18 nt, Artificial Sequence
  Synthetic
ccccgacuccggugcguc

SEQ ID NO: 44834 - RNA, 19 nt, Artificial Sequence
  Synthetic
cccccgacuccggugcguc

SEQ ID NO: 44835 - RNA, 20 nt, Artificial Sequence
  Synthetic
acccccgacuccggugcguc

SEQ ID NO: 44836 - RNA, 21 nt, Artificial Sequence
  Synthetic
gacccccgacuccggugcguc

SEQ ID NO: 44837 - RNA, 22 nt, Artificial Sequence
  Synthetic
ggacccccgacuccggugcguc

SEQ ID NO: 44838 - RNA, 23 nt, Artificial Sequence
  Synthetic
gggacccccgacuccggugcguc

SEQ ID NO: 44839 - RNA, 24 nt, Artificial Sequence
  Synthetic
ugggacccccgacuccggugcguc

SEQ ID NO: 44840 - RNA, 18 nt, Artificial Sequence
  Synthetic
ucuggagggcgggagaag

SEQ ID NO: 44841 - RNA, 19 nt, Artificial Sequence
  Synthetic
gucuggagggcgggagaag

SEQ ID NO: 44842 - RNA, 20 nt, Artificial Sequence
  Synthetic
cgucuggagggcgggagaag

SEQ ID NO: 44843 - RNA, 21 nt, Artificial Sequence
  Synthetic
gcgucuggagggcgggagaag

SEQ ID NO: 44844 - RNA, 22 nt, Artificial Sequence
  Synthetic
ugcgucuggagggcgggagaag

SEQ ID NO: 44845 - RNA, 23 nt, Artificial Sequence
  Synthetic
gugcgucuggagggcgggagaag

SEQ ID NO: 44846 - RNA, 24 nt, Artificial Sequence
  Synthetic
ggugcgucuggagggcgggagaag

SEQ ID NO: 44847 - RNA, 18 nt, Artificial Sequence
  Synthetic
ggcgggagaagagggaag

SEQ ID NO: 44848 - RNA, 19 nt, Artificial Sequence
  Synthetic
gggcgggagaagagggaag

SEQ ID NO: 44849 - RNA, 20 nt, Artificial Sequence
  Synthetic
agggcgggagaagagggaag

SEQ ID NO: 44850 - RNA, 21 nt, Artificial Sequence
  Synthetic
gagggcgggagaagagggaag

SEQ ID NO: 44851 - RNA, 22 nt, Artificial Sequence
  Synthetic
ggagggcgggagaagagggaag

SEQ ID NO: 44852 - RNA, 23 nt, Artificial Sequence
  Synthetic
uggagggcgggagaagagggaag

SEQ ID NO: 44853 - RNA, 24 nt, Artificial Sequence
  Synthetic
cuggagggcgggagaagagggaag

SEQ ID NO: 44854 - RNA, 18 nt, Artificial Sequence
  Synthetic
ccccucuuccgaggccag

SEQ ID NO: 44855 - RNA, 19 nt, Artificial Sequence
  Synthetic
cccccucuuccgaggccag

SEQ ID NO: 44856 - RNA, 20 nt, Artificial Sequence
  Synthetic
ccccccucuuccgaggccag

SEQ ID NO: 44857 - RNA, 21 nt, Artificial Sequence
  Synthetic
uccccccucuuccgaggccag

SEQ ID NO: 44858 - RNA, 22 nt, Artificial Sequence
  Synthetic
cuccccccucuuccgaggccag

SEQ ID NO: 44859 - RNA, 23 nt, Artificial Sequence
  Synthetic
ucuccccccucuuccgaggccag

SEQ ID NO: 44860 - RNA, 24 nt, Artificial Sequence
  Synthetic
uucuccccccucuuccgaggccag

SEQ ID NO: 44861 - RNA, 18 nt, Artificial Sequence
  Synthetic
cucuuccgaggccagcag

SEQ ID NO: 44862 - RNA, 19 nt, Artificial Sequence
  Synthetic
ccucuuccgaggccagcag

SEQ ID NO: 44863 - RNA, 20 nt, Artificial Sequence
  Synthetic
cccucuuccgaggccagcag

SEQ ID NO: 44864 - RNA, 21 nt, Artificial Sequence
  Synthetic
ccccucuuccgaggccagcag

SEQ ID NO: 44865 - RNA, 22 nt, Artificial Sequence
  Synthetic
cccccucuuccgaggccagcag

SEQ ID NO: 44866 - RNA, 23 nt, Artificial Sequence
  Synthetic
ccccccucuuccgaggccagcag

SEQ ID NO: 44867 - RNA, 24 nt, Artificial Sequence
  Synthetic
uccccccucuuccgaggccagcag

SEQ ID NO: 44868 - RNA, 18 nt, Artificial Sequence
  Synthetic
gaggcgggggggggagag

SEQ ID NO: 44869 - RNA, 19 nt, Artificial Sequence
  Synthetic
ugaggcgggggggggagag

SEQ ID NO: 44870 - RNA, 20 nt, Artificial Sequence
  Synthetic
gugaggcgggggggggagag

SEQ ID NO: 44871 - RNA, 21 nt, Artificial Sequence
  Synthetic
ugugaggcgggggggggagag

SEQ ID NO: 44872 - RNA, 22 nt, Artificial Sequence
  Synthetic
uugugaggcgggggggggagag

SEQ ID NO: 44873 - RNA, 23 nt, Artificial Sequence
  Synthetic
uuugugaggcgggggggggagag

SEQ ID NO: 44874 - RNA, 24 nt, Artificial Sequence
  Synthetic
cuuugugaggcgggggggggagag

SEQ ID NO: 44875 - RNA, 18 nt, Artificial Sequence
  Synthetic
gcgucuggagggcgggag

SEQ ID NO: 44876 - RNA, 19 nt, Artificial Sequence
  Synthetic
ugcgucuggagggcgggag

SEQ ID NO: 44877 - RNA, 20 nt, Artificial Sequence
  Synthetic
gugcgucuggagggcgggag

SEQ ID NO: 44878 - RNA, 21 nt, Artificial Sequence
  Synthetic
ggugcgucuggagggcgggag

SEQ ID NO: 44879 - RNA, 22 nt, Artificial Sequence
  Synthetic
cggugcgucuggagggcgggag

SEQ ID NO: 44880 - RNA, 23 nt, Artificial Sequence
  Synthetic
ccggugcgucuggagggcgggag

SEQ ID NO: 44881 - RNA, 24 nt, Artificial Sequence
  Synthetic
uccggugcgucuggagggcgggag

SEQ ID NO: 44882 - RNA, 18 nt, Artificial Sequence
  Synthetic
gugaggcgggggggggag

SEQ ID NO: 44883 - RNA, 19 nt, Artificial Sequence
  Synthetic
ugugaggcgggggggggag

SEQ ID NO: 44884 - RNA, 20 nt, Artificial Sequence
  Synthetic
uugugaggcgggggggggag

SEQ ID NO: 44885 - RNA, 21 nt, Artificial Sequence
  Synthetic
uuugugaggcgggggggggag

SEQ ID NO: 44886 - RNA, 22 nt, Artificial Sequence
  Synthetic
cuuugugaggcgggggggggag

SEQ ID NO: 44887 - RNA, 23 nt, Artificial Sequence
  Synthetic
acuuugugaggcgggggggggag

SEQ ID NO: 44888 - RNA, 24 nt, Artificial Sequence
  Synthetic
gacuuugugaggcgggggggggag

SEQ ID NO: 44889 - RNA, 18 nt, Artificial Sequence
  Synthetic
ggggcaggacuuugugag

SEQ ID NO: 44890 - RNA, 19 nt, Artificial Sequence
  Synthetic
gggggcaggacuuugugag

SEQ ID NO: 44891 - RNA, 20 nt, Artificial Sequence
  Synthetic
ggggggcaggacuuugugag

SEQ ID NO: 44892 - RNA, 21 nt, Artificial Sequence
  Synthetic
aggggggcaggacuuugugag

SEQ ID NO: 44893 - RNA, 22 nt, Artificial Sequence
  Synthetic
caggggggcaggacuuugugag

SEQ ID NO: 44894 - RNA, 23 nt, Artificial Sequence
  Synthetic
gcaggggggcaggacuuugugag

SEQ ID NO: 44895 - RNA, 24 nt, Artificial Sequence
  Synthetic
agcaggggggcaggacuuugugag

SEQ ID NO: 44896 - RNA, 18 nt, Artificial Sequence
  Synthetic
gccccuuugacucagacg

SEQ ID NO: 44897 - RNA, 19 nt, Artificial Sequence
  Synthetic
ggccccuuugacucagacg

SEQ ID NO: 44898 - RNA, 20 nt, Artificial Sequence
  Synthetic
uggccccuuugacucagacg

SEQ ID NO: 44899 - RNA, 21 nt, Artificial Sequence
  Synthetic
auggccccuuugacucagacg

SEQ ID NO: 44900 - RNA, 22 nt, Artificial Sequence
  Synthetic
cauggccccuuugacucagacg

SEQ ID NO: 44901 - RNA, 23 nt, Artificial Sequence
  Synthetic
acauggccccuuugacucagacg

SEQ ID NO: 44902 - RNA, 24 nt, Artificial Sequence
  Synthetic
cacauggccccuuugacucagacg

SEQ ID NO: 44903 - RNA, 18 nt, Artificial Sequence
  Synthetic
cgugggugcugauugacg

SEQ ID NO: 44904 - RNA, 19 nt, Artificial Sequence
  Synthetic
ucgugggugcugauugacg

SEQ ID NO: 44905 - RNA, 20 nt, Artificial Sequence
  Synthetic
cucgugggugcugauugacg

SEQ ID NO: 44906 - RNA, 21 nt, Artificial Sequence
  Synthetic
acucgugggugcugauugacg

SEQ ID NO: 44907 - RNA, 22 nt, Artificial Sequence
  Synthetic
aacucgugggugcugauugacg

SEQ ID NO: 44908 - RNA, 23 nt, Artificial Sequence
  Synthetic
gaacucgugggugcugauugacg

SEQ ID NO: 44909 - RNA, 24 nt, Artificial Sequence
  Synthetic
ggaacucgugggugcugauugacg

SEQ ID NO: 44910 - RNA, 18 nt, Artificial Sequence
  Synthetic
gcccgcggagccggcccg

SEQ ID NO: 44911 - RNA, 19 nt, Artificial Sequence
  Synthetic
ggcccgcggagccggcccg

SEQ ID NO: 44912 - RNA, 20 nt, Artificial Sequence
  Synthetic
uggcccgcggagccggcccg

SEQ ID NO: 44913 - RNA, 21 nt, Artificial Sequence
  Synthetic
cuggcccgcggagccggcccg

SEQ ID NO: 44914 - RNA, 22 nt, Artificial Sequence
  Synthetic
ccuggcccgcggagccggcccg

SEQ ID NO: 44915 - RNA, 23 nt, Artificial Sequence
  Synthetic
cccuggcccgcggagccggcccg

SEQ ID NO: 44916 - RNA, 24 nt, Artificial Sequence
  Synthetic
gcccuggcccgcggagccggcccg

SEQ ID NO: 44917 - RNA, 18 nt, Artificial Sequence
  Synthetic
ugcccgggcccuggcccg

SEQ ID NO: 44918 - RNA, 19 nt, Artificial Sequence
  Synthetic
gugcccgggcccuggcccg

SEQ ID NO: 44919 - RNA, 20 nt, Artificial Sequence
  Synthetic
cgugcccgggcccuggcccg

SEQ ID NO: 44920 - RNA, 21 nt, Artificial Sequence
  Synthetic
ccgugcccgggcccuggcccg

SEQ ID NO: 44921 - RNA, 22 nt, Artificial Sequence
  Synthetic
cccgugcccgggcccuggcccg

SEQ ID NO: 44922 - RNA, 23 nt, Artificial Sequence
  Synthetic
gcccgugcccgggcccuggcccg

SEQ ID NO: 44923 - RNA, 24 nt, Artificial Sequence
  Synthetic
ggcccgugcccgggcccuggcccg

SEQ ID NO: 44924 - RNA, 18 nt, Artificial Sequence
  Synthetic
cauauuugggggacgccg

SEQ ID NO: 44925 - RNA, 19 nt, Artificial Sequence
  Synthetic
ccauauuugggggacgccg

SEQ ID NO: 44926 - RNA, 20 nt, Artificial Sequence
  Synthetic
gccauauuugggggacgccg

SEQ ID NO: 44927 - RNA, 21 nt, Artificial Sequence
  Synthetic
cgccauauuugggggacgccg

SEQ ID NO: 44928 - RNA, 22 nt, Artificial Sequence
  Synthetic
ccgccauauuugggggacgccg

SEQ ID NO: 44929 - RNA, 23 nt, Artificial Sequence
  Synthetic
cccgccauauuugggggacgccg

SEQ ID NO: 44930 - RNA, 24 nt, Artificial Sequence
  Synthetic
gcccgccauauuugggggacgccg

SEQ ID NO: 44931 - RNA, 18 nt, Artificial Sequence
  Synthetic
cagggcccggggucgccg

SEQ ID NO: 44932 - RNA, 19 nt, Artificial Sequence
  Synthetic
gcagggcccggggucgccg

SEQ ID NO: 44933 - RNA, 20 nt, Artificial Sequence
  Synthetic
cgcagggcccggggucgccg

SEQ ID NO: 44934 - RNA, 21 nt, Artificial Sequence
  Synthetic
acgcagggcccggggucgccg

SEQ ID NO: 44935 - RNA, 22 nt, Artificial Sequence
  Synthetic
gacgcagggcccggggucgccg

SEQ ID NO: 44936 - RNA, 23 nt, Artificial Sequence
  Synthetic
agacgcagggcccggggucgccg

SEQ ID NO: 44937 - RNA, 24 nt, Artificial Sequence
  Synthetic
cagacgcagggcccggggucgccg

SEQ ID NO: 44938 - RNA, 18 nt, Artificial Sequence
  Synthetic
gcaccaagccgcucuccg

SEQ ID NO: 44939 - RNA, 19 nt, Artificial Sequence
  Synthetic
cgcaccaagccgcucuccg

SEQ ID NO: 44940 - RNA, 20 nt, Artificial Sequence
  Synthetic
ccgcaccaagccgcucuccg

SEQ ID NO: 44941 - RNA, 21 nt, Artificial Sequence
  Synthetic
uccgcaccaagccgcucuccg

SEQ ID NO: 44942 - RNA, 22 nt, Artificial Sequence
  Synthetic
cuccgcaccaagccgcucuccg

SEQ ID NO: 44943 - RNA, 23 nt, Artificial Sequence
  Synthetic
gcuccgcaccaagccgcucuccg

SEQ ID NO: 44944 - RNA, 24 nt, Artificial Sequence
  Synthetic
agcuccgcaccaagccgcucuccg

SEQ ID NO: 44945 - RNA, 18 nt, Artificial Sequence
  Synthetic
ggcggccugggucuuccg

SEQ ID NO: 44946 - RNA, 19 nt, Artificial Sequence
  Synthetic
aggcggccugggucuuccg

SEQ ID NO: 44947 - RNA, 20 nt, Artificial Sequence
  Synthetic
gaggcggccugggucuuccg

SEQ ID NO: 44948 - RNA, 21 nt, Artificial Sequence
  Synthetic
cgaggcggccugggucuuccg

SEQ ID NO: 44949 - RNA, 22 nt, Artificial Sequence
  Synthetic
ccgaggcggccugggucuuccg

SEQ ID NO: 44950 - RNA, 23 nt, Artificial Sequence
  Synthetic
cccgaggcggccugggucuuccg

SEQ ID NO: 44951 - RNA, 24 nt, Artificial Sequence
  Synthetic
acccgaggcggccugggucuuccg

SEQ ID NO: 44952 - RNA, 18 nt, Artificial Sequence
  Synthetic
ucggcggccgccagcgcg

SEQ ID NO: 44953 - RNA, 19 nt, Artificial Sequence
  Synthetic
aucggcggccgccagcgcg

SEQ ID NO: 44954 - RNA, 20 nt, Artificial Sequence
  Synthetic
aaucggcggccgccagcgcg

SEQ ID NO: 44955 - RNA, 21 nt, Artificial Sequence
  Synthetic
caaucggcggccgccagcgcg

SEQ ID NO: 44956 - RNA, 22 nt, Artificial Sequence
  Synthetic
ccaaucggcggccgccagcgcg

SEQ ID NO: 44957 - RNA, 23 nt, Artificial Sequence
  Synthetic
gccaaucggcggccgccagcgcg

SEQ ID NO: 44958 - RNA, 24 nt, Artificial Sequence
  Synthetic
ggccaaucggcggccgccagcgcg

SEQ ID NO: 44959 - RNA, 18 nt, Artificial Sequence
  Synthetic
gcaggacuuugugaggcg

SEQ ID NO: 44960 - RNA, 19 nt, Artificial Sequence
  Synthetic
ggcaggacuuugugaggcg

SEQ ID NO: 44961 - RNA, 20 nt, Artificial Sequence
  Synthetic
gggcaggacuuugugaggcg

SEQ ID NO: 44962 - RNA, 21 nt, Artificial Sequence
  Synthetic
ggggcaggacuuugugaggcg

SEQ ID NO: 44963 - RNA, 22 nt, Artificial Sequence
  Synthetic
gggggcaggacuuugugaggcg

SEQ ID NO: 44964 - RNA, 23 nt, Artificial Sequence
  Synthetic
ggggggcaggacuuugugaggcg

SEQ ID NO: 44965 - RNA, 24 nt, Artificial Sequence
  Synthetic
aggggggcaggacuuugugaggcg

SEQ ID NO: 44966 - RNA, 18 nt, Artificial Sequence
  Synthetic
ggggucgggauccaaagg

SEQ ID NO: 44967 - RNA, 19 nt, Artificial Sequence
  Synthetic
aggggucgggauccaaagg

SEQ ID NO: 44968 - RNA, 20 nt, Artificial Sequence
  Synthetic
gaggggucgggauccaaagg

SEQ ID NO: 44969 - RNA, 21 nt, Artificial Sequence
  Synthetic
agaggggucgggauccaaagg

SEQ ID NO: 44970 - RNA, 22 nt, Artificial Sequence
  Synthetic
aagaggggucgggauccaaagg

SEQ ID NO: 44971 - RNA, 23 nt, Artificial Sequence
  Synthetic
gaagaggggucgggauccaaagg

SEQ ID NO: 44972 - RNA, 24 nt, Artificial Sequence
  Synthetic
agaagaggggucgggauccaaagg

SEQ ID NO: 44973 - RNA, 18 nt, Artificial Sequence
  Synthetic
ccagcccgcccucacagg

SEQ ID NO: 44974 - RNA, 19 nt, Artificial Sequence
  Synthetic
gccagcccgcccucacagg

SEQ ID NO: 44975 - RNA, 20 nt, Artificial Sequence
  Synthetic
agccagcccgcccucacagg

SEQ ID NO: 44976 - RNA, 21 nt, Artificial Sequence
  Synthetic
gagccagcccgcccucacagg

SEQ ID NO: 44977 - RNA, 22 nt, Artificial Sequence
  Synthetic
ggagccagcccgcccucacagg

SEQ ID NO: 44978 - RNA, 23 nt, Artificial Sequence
  Synthetic
uggagccagcccgcccucacagg

SEQ ID NO: 44979 - RNA, 24 nt, Artificial Sequence
  Synthetic
uuggagccagcccgcccucacagg

SEQ ID NO: 44980 - RNA, 18 nt, Artificial Sequence
  Synthetic
aggcgggggggggagagg

SEQ ID NO: 44981 - RNA, 19 nt, Artificial Sequence
  Synthetic
gaggcgggggggggagagg

SEQ ID NO: 44982 - RNA, 20 nt, Artificial Sequence
  Synthetic
ugaggcgggggggggagagg

SEQ ID NO: 44983 - RNA, 21 nt, Artificial Sequence
  Synthetic
gugaggcgggggggggagagg

SEQ ID NO: 44984 - RNA, 22 nt, Artificial Sequence
  Synthetic
ugugaggcgggggggggagagg

SEQ ID NO: 44985 - RNA, 23 nt, Artificial Sequence
  Synthetic
uugugaggcgggggggggagagg

SEQ ID NO: 44986 - RNA, 24 nt, Artificial Sequence
  Synthetic
uuugugaggcgggggggggagagg

SEQ ID NO: 44987 - RNA, 18 nt, Artificial Sequence
  Synthetic
ggcgccggguggcggagg

SEQ ID NO: 44988 - RNA, 19 nt, Artificial Sequence
  Synthetic
cggcgccggguggcggagg

SEQ ID NO: 44989 - RNA, 20 nt, Artificial Sequence
  Synthetic
ccggcgccggguggcggagg

SEQ ID NO: 44990 - RNA, 21 nt, Artificial Sequence
  Synthetic
uccggcgccggguggcggagg

SEQ ID NO: 44991 - RNA, 22 nt, Artificial Sequence
  Synthetic
uuccggcgccggguggcggagg

SEQ ID NO: 44992 - RNA, 23 nt, Artificial Sequence
  Synthetic
guuccggcgccggguggcggagg

SEQ ID NO: 44993 - RNA, 24 nt, Artificial Sequence
  Synthetic
gguuccggcgccggguggcggagg

SEQ ID NO: 44994 - RNA, 18 nt, Artificial Sequence
  Synthetic
cuccggugcgucuggagg

SEQ ID NO: 44995 - RNA, 19 nt, Artificial Sequence
  Synthetic
acuccggugcgucuggagg

SEQ ID NO: 44996 - RNA, 20 nt, Artificial Sequence
  Synthetic
gacuccggugcgucuggagg

SEQ ID NO: 44997 - RNA, 21 nt, Artificial Sequence
  Synthetic
cgacuccggugcgucuggagg

SEQ ID NO: 44998 - RNA, 22 nt, Artificial Sequence
  Synthetic
ccgacuccggugcgucuggagg

SEQ ID NO: 44999 - RNA, 23 nt, Artificial Sequence
  Synthetic
cccgacuccggugcgucuggagg

SEQ ID NO: 45000 - RNA, 24 nt, Artificial Sequence
  Synthetic
ccccgacuccggugcgucuggagg

SEQ ID NO: 45001 - RNA, 18 nt, Artificial Sequence
  Synthetic
gggcaggacuuugugagg

SEQ ID NO: 45002 - RNA, 19 nt, Artificial Sequence
  Synthetic
ggggcaggacuuugugagg

SEQ ID NO: 45003 - RNA, 20 nt, Artificial Sequence
  Synthetic
gggggcaggacuuugugagg

SEQ ID NO: 45004 - RNA, 21 nt, Artificial Sequence
  Synthetic
ggggggcaggacuuugugagg

SEQ ID NO: 45005 - RNA, 22 nt, Artificial Sequence
  Synthetic
aggggggcaggacuuugugagg

SEQ ID NO: 45006 - RNA, 23 nt, Artificial Sequence
  Synthetic
caggggggcaggacuuugugagg

SEQ ID NO: 45007 - RNA, 24 nt, Artificial Sequence
  Synthetic
gcaggggggcaggacuuugugagg

SEQ ID NO: 45008 - RNA, 18 nt, Artificial Sequence
  Synthetic
cggcggccgccagcgcgg

SEQ ID NO: 45009 - RNA, 19 nt, Artificial Sequence
  Synthetic
ucggcggccgccagcgcgg

SEQ ID NO: 45010 - RNA, 20 nt, Artificial Sequence
  Synthetic
aucggcggccgccagcgcgg

SEQ ID NO: 45011 - RNA, 21 nt, Artificial Sequence
  Synthetic
aaucggcggccgccagcgcgg

SEQ ID NO: 45012 - RNA, 22 nt, Artificial Sequence
  Synthetic
caaucggcggccgccagcgcgg

SEQ ID NO: 45013 - RNA, 23 nt, Artificial Sequence
  Synthetic
ccaaucggcggccgccagcgcgg

SEQ ID NO: 45014 - RNA, 24 nt, Artificial Sequence
  Synthetic
gccaaucggcggccgccagcgcgg

SEQ ID NO: 45015 - RNA, 18 nt, Artificial Sequence
  Synthetic
caggacuuugugaggcgg

SEQ ID NO: 45016 - RNA, 19 nt, Artificial Sequence
  Synthetic
gcaggacuuugugaggcgg

SEQ ID NO: 45017 - RNA, 20 nt, Artificial Sequence
  Synthetic
ggcaggacuuugugaggcgg

SEQ ID NO: 45018 - RNA, 21 nt, Artificial Sequence
  Synthetic
gggcaggacuuugugaggcgg

SEQ ID NO: 45019 - RNA, 22 nt, Artificial Sequence
  Synthetic
ggggcaggacuuugugaggcgg

SEQ ID NO: 45020 - RNA, 23 nt, Artificial Sequence
  Synthetic
gggggcaggacuuugugaggcgg

SEQ ID NO: 45021 - RNA, 24 nt, Artificial Sequence
  Synthetic
ggggggcaggacuuugugaggcgg

SEQ ID NO: 45022 - RNA, 18 nt, Artificial Sequence
  Synthetic
ggugcgucuggagggcgg

SEQ ID NO: 45023 - RNA, 19 nt, Artificial Sequence
  Synthetic
cggugcgucuggagggcgg

SEQ ID NO: 45024 - RNA, 20 nt, Artificial Sequence
  Synthetic
ccggugcgucuggagggcgg

SEQ ID NO: 45025 - RNA, 21 nt, Artificial Sequence
  Synthetic
uccggugcgucuggagggcgg

SEQ ID NO: 45026 - RNA, 22 nt, Artificial Sequence
  Synthetic
cuccggugcgucuggagggcgg

SEQ ID NO: 45027 - RNA, 23 nt, Artificial Sequence
  Synthetic
acuccggugcgucuggagggcgg

SEQ ID NO: 45028 - RNA, 24 nt, Artificial Sequence
  Synthetic
gacuccggugcgucuggagggcgg

SEQ ID NO: 45029 - RNA, 18 nt, Artificial Sequence
  Synthetic
gagggcgggagaagaggg

SEQ ID NO: 45030 - RNA, 19 nt, Artificial Sequence
  Synthetic
ggagggcgggagaagaggg

SEQ ID NO: 45031 - RNA, 20 nt, Artificial Sequence
  Synthetic
uggagggcgggagaagaggg

SEQ ID NO: 45032 - RNA, 21 nt, Artificial Sequence
  Synthetic
cuggagggcgggagaagaggg

SEQ ID NO: 45033 - RNA, 22 nt, Artificial Sequence
  Synthetic
ucuggagggcgggagaagaggg

SEQ ID NO: 45034 - RNA, 23 nt, Artificial Sequence
  Synthetic
gucuggagggcgggagaagaggg

SEQ ID NO: 45035 - RNA, 24 nt, Artificial Sequence
  Synthetic
cgucuggagggcgggagaagaggg

SEQ ID NO: 45036 - RNA, 18 nt, Artificial Sequence
  Synthetic
uccggugcgucuggaggg

SEQ ID NO: 45037 - RNA, 19 nt, Artificial Sequence
  Synthetic
cuccggugcgucuggaggg

SEQ ID NO: 45038 - RNA, 20 nt, Artificial Sequence
  Synthetic
acuccggugcgucuggaggg

SEQ ID NO: 45039 - RNA, 21 nt, Artificial Sequence
  Synthetic
gacuccggugcgucuggaggg

SEQ ID NO: 45040 - RNA, 22 nt, Artificial Sequence
  Synthetic
cgacuccggugcgucuggaggg

SEQ ID NO: 45041 - RNA, 23 nt, Artificial Sequence
  Synthetic
ccgacuccggugcgucuggaggg

SEQ ID NO: 45042 - RNA, 24 nt, Artificial Sequence
  Synthetic
cccgacuccggugcgucuggaggg

SEQ ID NO: 45043 - RNA, 18 nt, Artificial Sequence
  Synthetic
aggacuuugugaggcggg

SEQ ID NO: 45044 - RNA, 19 nt, Artificial Sequence
  Synthetic
caggacuuugugaggcggg

SEQ ID NO: 45045 - RNA, 20 nt, Artificial Sequence
  Synthetic
gcaggacuuugugaggcggg

SEQ ID NO: 45046 - RNA, 21 nt, Artificial Sequence
  Synthetic
ggcaggacuuugugaggcggg

SEQ ID NO: 45047 - RNA, 22 nt, Artificial Sequence
  Synthetic
gggcaggacuuugugaggcggg

SEQ ID NO: 45048 - RNA, 23 nt, Artificial Sequence
  Synthetic
ggggcaggacuuugugaggcggg

SEQ ID NO: 45049 - RNA, 24 nt, Artificial Sequence
  Synthetic
gggggcaggacuuugugaggcggg

SEQ ID NO: 45050 - RNA, 18 nt, Artificial Sequence
  Synthetic
aagagggaagaagagggg

SEQ ID NO: 45051 - RNA, 19 nt, Artificial Sequence
  Synthetic
gaagagggaagaagagggg

SEQ ID NO: 45052 - RNA, 20 nt, Artificial Sequence
  Synthetic
agaagagggaagaagagggg

SEQ ID NO: 45053 - RNA, 21 nt, Artificial Sequence
  Synthetic
gagaagagggaagaagagggg

SEQ ID NO: 45054 - RNA, 22 nt, Artificial Sequence
  Synthetic
ggagaagagggaagaagagggg

SEQ ID NO: 45055 - RNA, 23 nt, Artificial Sequence
  Synthetic
gggagaagagggaagaagagggg

SEQ ID NO: 45056 - RNA, 24 nt, Artificial Sequence
  Synthetic
cgggagaagagggaagaagagggg

SEQ ID NO: 45057 - RNA, 18 nt, Artificial Sequence
  Synthetic
ggacuuugugaggcgggg

SEQ ID NO: 45058 - RNA, 19 nt, Artificial Sequence
  Synthetic
aggacuuugugaggcgggg

SEQ ID NO: 45059 - RNA, 20 nt, Artificial Sequence
  Synthetic
caggacuuugugaggcgggg

SEQ ID NO: 45060 - RNA, 21 nt, Artificial Sequence
  Synthetic
gcaggacuuugugaggcgggg

SEQ ID NO: 45061 - RNA, 22 nt, Artificial Sequence
  Synthetic
ggcaggacuuugugaggcgggg

SEQ ID NO: 45062 - RNA, 23 nt, Artificial Sequence
  Synthetic
gggcaggacuuugugaggcgggg

SEQ ID NO: 45063 - RNA, 24 nt, Artificial Sequence
  Synthetic
ggggcaggacuuugugaggcgggg

SEQ ID NO: 45064 - RNA, 18 nt, Artificial Sequence
  Synthetic
gggcgggccgccucgggg

SEQ ID NO: 45065 - RNA, 19 nt, Artificial Sequence
  Synthetic
agggcgggccgccucgggg

SEQ ID NO: 45066 - RNA, 20 nt, Artificial Sequence
  Synthetic
cagggcgggccgccucgggg

SEQ ID NO: 45067 - RNA, 21 nt, Artificial Sequence
  Synthetic
acagggcgggccgccucgggg

SEQ ID NO: 45068 - RNA, 22 nt, Artificial Sequence
  Synthetic
cacagggcgggccgccucgggg

SEQ ID NO: 45069 - RNA, 23 nt, Artificial Sequence
  Synthetic
ucacagggcgggccgccucgggg

SEQ ID NO: 45070 - RNA, 24 nt, Artificial Sequence
  Synthetic
cucacagggcgggccgccucgggg

SEQ ID NO: 45071 - RNA, 18 nt, Artificial Sequence
  Synthetic
ucacacgcaucuaggggg

SEQ ID NO: 45072 - RNA, 19 nt, Artificial Sequence
  Synthetic
cucacacgcaucuaggggg

SEQ ID NO: 45073 - RNA, 20 nt, Artificial Sequence
  Synthetic
acucacacgcaucuaggggg

SEQ ID NO: 45074 - RNA, 21 nt, Artificial Sequence
  Synthetic
uacucacacgcaucuaggggg

SEQ ID NO: 45075 - RNA, 22 nt, Artificial Sequence
  Synthetic
uuacucacacgcaucuaggggg

SEQ ID NO: 45076 - RNA, 23 nt, Artificial Sequence
  Synthetic
cuuacucacacgcaucuaggggg

SEQ ID NO: 45077 - RNA, 24 nt, Artificial Sequence
  Synthetic
ccuuacucacacgcaucuaggggg

SEQ ID NO: 45078 - RNA, 18 nt, Artificial Sequence
  Synthetic
gacuuugugaggcggggg

SEQ ID NO: 45079 - RNA, 19 nt, Artificial Sequence
  Synthetic
ggacuuugugaggcggggg

SEQ ID NO: 45080 - RNA, 20 nt, Artificial Sequence
  Synthetic
aggacuuugugaggcggggg

SEQ ID NO: 45081 - RNA, 21 nt, Artificial Sequence
  Synthetic
caggacuuugugaggcggggg

SEQ ID NO: 45082 - RNA, 22 nt, Artificial Sequence
  Synthetic
gcaggacuuugugaggcggggg

SEQ ID NO: 45083 - RNA, 23 nt, Artificial Sequence
  Synthetic
ggcaggacuuugugaggcggggg

SEQ ID NO: 45084 - RNA, 24 nt, Artificial Sequence
  Synthetic
gggcaggacuuugugaggcggggg

SEQ ID NO: 45085 - RNA, 18 nt, Artificial Sequence
  Synthetic
ggcgggccgccucggggg

SEQ ID NO: 45086 - RNA, 19 nt, Artificial Sequence
  Synthetic
gggcgggccgccucggggg

SEQ ID NO: 45087 - RNA, 20 nt, Artificial Sequence
  Synthetic
agggcgggccgccucggggg

SEQ ID NO: 45088 - RNA, 21 nt, Artificial Sequence
  Synthetic
cagggcgggccgccucggggg

SEQ ID NO: 45089 - RNA, 22 nt, Artificial Sequence
  Synthetic
acagggcgggccgccucggggg

SEQ ID NO: 45090 - RNA, 23 nt, Artificial Sequence
  Synthetic
cacagggcgggccgccucggggg

SEQ ID NO: 45091 - RNA, 24 nt, Artificial Sequence
  Synthetic
ucacagggcgggccgccucggggg

SEQ ID NO: 45092 - RNA, 18 nt, Artificial Sequence
  Synthetic
ccgaggccagcagggggg

SEQ ID NO: 45093 - RNA, 19 nt, Artificial Sequence
  Synthetic
uccgaggccagcagggggg

SEQ ID NO: 45094 - RNA, 20 nt, Artificial Sequence
  Synthetic
uuccgaggccagcagggggg

SEQ ID NO: 45095 - RNA, 21 nt, Artificial Sequence
  Synthetic
cuuccgaggccagcagggggg

SEQ ID NO: 45096 - RNA, 22 nt, Artificial Sequence
  Synthetic
ucuuccgaggccagcagggggg

SEQ ID NO: 45097 - RNA, 23 nt, Artificial Sequence
  Synthetic
cucuuccgaggccagcagggggg

SEQ ID NO: 45098 - RNA, 24 nt, Artificial Sequence
  Synthetic
ccucuuccgaggccagcagggggg

SEQ ID NO: 45099 - RNA, 18 nt, Artificial Sequence
  Synthetic
cacacgcaucuagggggg

SEQ ID NO: 45100 - RNA, 19 nt, Artificial Sequence
  Synthetic
ucacacgcaucuagggggg

SEQ ID NO: 45101 - RNA, 20 nt, Artificial Sequence
  Synthetic
cucacacgcaucuagggggg

SEQ ID NO: 45102 - RNA, 21 nt, Artificial Sequence
  Synthetic
acucacacgcaucuagggggg

SEQ ID NO: 45103 - RNA, 22 nt, Artificial Sequence
  Synthetic
uacucacacgcaucuagggggg

SEQ ID NO: 45104 - RNA, 23 nt, Artificial Sequence
  Synthetic
uuacucacacgcaucuagggggg

SEQ ID NO: 45105 - RNA, 24 nt, Artificial Sequence
  Synthetic
cuuacucacacgcaucuagggggg

SEQ ID NO: 45106 - RNA, 18 nt, Artificial Sequence
  Synthetic
acuuugugaggcgggggg

SEQ ID NO: 45107 - RNA, 19 nt, Artificial Sequence
  Synthetic
gacuuugugaggcgggggg

SEQ ID NO: 45108 - RNA, 20 nt, Artificial Sequence
  Synthetic
ggacuuugugaggcgggggg

SEQ ID NO: 45109 - RNA, 21 nt, Artificial Sequence
  Synthetic
aggacuuugugaggcgggggg

SEQ ID NO: 45110 - RNA, 22 nt, Artificial Sequence
  Synthetic
caggacuuugugaggcgggggg

SEQ ID NO: 45111 - RNA, 23 nt, Artificial Sequence
  Synthetic
gcaggacuuugugaggcgggggg

SEQ ID NO: 45112 - RNA, 24 nt, Artificial Sequence
  Synthetic
ggcaggacuuugugaggcgggggg

SEQ ID NO: 45113 - RNA, 18 nt, Artificial Sequence
  Synthetic
uuugugaggcgggggggg

SEQ ID NO: 45114 - RNA, 19 nt, Artificial Sequence
  Synthetic
cuuugugaggcgggggggg

SEQ ID NO: 45115 - RNA, 20 nt, Artificial Sequence
  Synthetic
acuuugugaggcgggggggg

SEQ ID NO: 45116 - RNA, 21 nt, Artificial Sequence
  Synthetic
gacuuugugaggcgggggggg

SEQ ID NO: 45117 - RNA, 22 nt, Artificial Sequence
  Synthetic
ggacuuugugaggcgggggggg

SEQ ID NO: 45118 - RNA, 23 nt, Artificial Sequence
  Synthetic
aggacuuugugaggcgggggggg

SEQ ID NO: 45119 - RNA, 24 nt, Artificial Sequence
  Synthetic
caggacuuugugaggcgggggggg

SEQ ID NO: 45120 - RNA, 18 nt, Artificial Sequence
  Synthetic
gcaucuaggggggugggg

SEQ ID NO: 45121 - RNA, 19 nt, Artificial Sequence
  Synthetic
cgcaucuaggggggugggg

SEQ ID NO: 45122 - RNA, 20 nt, Artificial Sequence
  Synthetic
acgcaucuaggggggugggg

SEQ ID NO: 45123 - RNA, 21 nt, Artificial Sequence
  Synthetic
cacgcaucuaggggggugggg

SEQ ID NO: 45124 - RNA, 22 nt, Artificial Sequence
  Synthetic
acacgcaucuaggggggugggg

SEQ ID NO: 45125 - RNA, 23 nt, Artificial Sequence
  Synthetic
cacacgcaucuaggggggugggg

SEQ ID NO: 45126 - RNA, 24 nt, Artificial Sequence
  Synthetic
ucacacgcaucuaggggggugggg

SEQ ID NO: 45127 - RNA, 18 nt, Artificial Sequence
  Synthetic
gaguuaccgcccaauggg

SEQ ID NO: 45128 - RNA, 19 nt, Artificial Sequence
  Synthetic
ggaguuaccgcccaauggg

SEQ ID NO: 45129 - RNA, 20 nt, Artificial Sequence
  Synthetic
gggaguuaccgcccaauggg

SEQ ID NO: 45130 - RNA, 21 nt, Artificial Sequence
  Synthetic
cgggaguuaccgcccaauggg

SEQ ID NO: 45131 - RNA, 22 nt, Artificial Sequence
  Synthetic
gcgggaguuaccgcccaauggg

SEQ ID NO: 45132 - RNA, 23 nt, Artificial Sequence
  Synthetic
ggcgggaguuaccgcccaauggg

SEQ ID NO: 45133 - RNA, 24 nt, Artificial Sequence
  Synthetic
gggcgggaguuaccgcccaauggg

SEQ ID NO: 45134 - RNA, 18 nt, Artificial Sequence
  Synthetic
cgcaucuagggggguggg

SEQ ID NO: 45135 - RNA, 19 nt, Artificial Sequence
  Synthetic
acgcaucuagggggguggg

SEQ ID NO: 45136 - RNA, 20 nt, Artificial Sequence
  Synthetic
cacgcaucuagggggguggg

SEQ ID NO: 45137 - RNA, 21 nt, Artificial Sequence
  Synthetic
acacgcaucuagggggguggg

SEQ ID NO: 45138 - RNA, 22 nt, Artificial Sequence
  Synthetic
cacacgcaucuagggggguggg

SEQ ID NO: 45139 - RNA, 23 nt, Artificial Sequence
  Synthetic
ucacacgcaucuagggggguggg

SEQ ID NO: 45140 - RNA, 24 nt, Artificial Sequence
  Synthetic
cucacacgcaucuagggggguggg

SEQ ID NO: 45141 - RNA, 18 nt, Artificial Sequence
  Synthetic
ggggcccggcccauuggg

SEQ ID NO: 45142 - RNA, 19 nt, Artificial Sequence
  Synthetic
cggggcccggcccauuggg

SEQ ID NO: 45143 - RNA, 20 nt, Artificial Sequence
  Synthetic
ucggggcccggcccauuggg

SEQ ID NO: 45144 - RNA, 21 nt, Artificial Sequence
  Synthetic
uucggggcccggcccauuggg

SEQ ID NO: 45145 - RNA, 22 nt, Artificial Sequence
  Synthetic
cuucggggcccggcccauuggg

SEQ ID NO: 45146 - RNA, 23 nt, Artificial Sequence
  Synthetic
ucuucggggcccggcccauuggg

SEQ ID NO: 45147 - RNA, 24 nt, Artificial Sequence
  Synthetic
gucuucggggcccggcccauuggg

SEQ ID NO: 45148 - RNA, 18 nt, Artificial Sequence
  Synthetic
ucuccggagagacgaugg

SEQ ID NO: 45149 - RNA, 19 nt, Artificial Sequence
  Synthetic
cucuccggagagacgaugg

SEQ ID NO: 45150 - RNA, 20 nt, Artificial Sequence
  Synthetic
gcucuccggagagacgaugg

SEQ ID NO: 45151 - RNA, 21 nt, Artificial Sequence
  Synthetic
cgcucuccggagagacgaugg

SEQ ID NO: 45152 - RNA, 22 nt, Artificial Sequence
  Synthetic
ccgcucuccggagagacgaugg

SEQ ID NO: 45153 - RNA, 23 nt, Artificial Sequence
  Synthetic
gccgcucuccggagagacgaugg

SEQ ID NO: 45154 - RNA, 24 nt, Artificial Sequence
  Synthetic
agccgcucuccggagagacgaugg

SEQ ID NO: 45155 - RNA, 18 nt, Artificial Sequence
  Synthetic
gguuccggcgccgggugg

SEQ ID NO: 45156 - RNA, 19 nt, Artificial Sequence
  Synthetic
cgguuccggcgccgggugg

SEQ ID NO: 45157 - RNA, 20 nt, Artificial Sequence
  Synthetic
ucgguuccggcgccgggugg

SEQ ID NO: 45158 - RNA, 21 nt, Artificial Sequence
  Synthetic
cucgguuccggcgccgggugg

SEQ ID NO: 45159 - RNA, 22 nt, Artificial Sequence
  Synthetic
gcucgguuccggcgccgggugg

SEQ ID NO: 45160 - RNA, 23 nt, Artificial Sequence
  Synthetic
ggcucgguuccggcgccgggugg

SEQ ID NO: 45161 - RNA, 24 nt, Artificial Sequence
  Synthetic
gggcucgguuccggcgccgggugg

SEQ ID NO: 45162 - RNA, 18 nt, Artificial Sequence
  Synthetic
cggggcccggcccauugg

SEQ ID NO: 45163 - RNA, 19 nt, Artificial Sequence
  Synthetic
ucggggcccggcccauugg

SEQ ID NO: 45164 - RNA, 20 nt, Artificial Sequence
  Synthetic
uucggggcccggcccauugg

SEQ ID NO: 45165 - RNA, 21 nt, Artificial Sequence
  Synthetic
cuucggggcccggcccauugg

SEQ ID NO: 45166 - RNA, 22 nt, Artificial Sequence
  Synthetic
ucuucggggcccggcccauugg

SEQ ID NO: 45167 - RNA, 23 nt, Artificial Sequence
  Synthetic
gucuucggggcccggcccauugg

SEQ ID NO: 45168 - RNA, 24 nt, Artificial Sequence
  Synthetic
agucuucggggcccggcccauugg

SEQ ID NO: 45169 - RNA, 18 nt, Artificial Sequence
  Synthetic
ccgacuccggugcgucug

SEQ ID NO: 45170 - RNA, 19 nt, Artificial Sequence
  Synthetic
cccgacuccggugcgucug

SEQ ID NO: 45171 - RNA, 20 nt, Artificial Sequence
  Synthetic
ccccgacuccggugcgucug

SEQ ID NO: 45172 - RNA, 21 nt, Artificial Sequence
  Synthetic
cccccgacuccggugcgucug

SEQ ID NO: 45173 - RNA, 22 nt, Artificial Sequence
  Synthetic
acccccgacuccggugcgucug

SEQ ID NO: 45174 - RNA, 23 nt, Artificial Sequence
  Synthetic
gacccccgacuccggugcgucug

SEQ ID NO: 45175 - RNA, 24 nt, Artificial Sequence
  Synthetic
ggacccccgacuccggugcgucug

SEQ ID NO: 45176 - RNA, 18 nt, Artificial Sequence
  Synthetic
aggaccggggucgccgug

SEQ ID NO: 45177 - RNA, 19 nt, Artificial Sequence
  Synthetic
aaggaccggggucgccgug

SEQ ID NO: 45178 - RNA, 20 nt, Artificial Sequence
  Synthetic
caaggaccggggucgccgug

SEQ ID NO: 45179 - RNA, 21 nt, Artificial Sequence
  Synthetic
acaaggaccggggucgccgug

SEQ ID NO: 45180 - RNA, 22 nt, Artificial Sequence
  Synthetic
cacaaggaccggggucgccgug

SEQ ID NO: 45181 - RNA, 23 nt, Artificial Sequence
  Synthetic
acacaaggaccggggucgccgug

SEQ ID NO: 45182 - RNA, 24 nt, Artificial Sequence
  Synthetic
cacacaaggaccggggucgccgug

SEQ ID NO: 45183 - RNA, 18 nt, Artificial Sequence
  Synthetic
cgguuccggcgccgggug

SEQ ID NO: 45184 - RNA, 19 nt, Artificial Sequence
  Synthetic
ucgguuccggcgccgggug

SEQ ID NO: 45185 - RNA, 20 nt, Artificial Sequence
  Synthetic
cucgguuccggcgccgggug

SEQ ID NO: 45186 - RNA, 21 nt, Artificial Sequence
  Synthetic
gcucgguuccggcgccgggug

SEQ ID NO: 45187 - RNA, 22 nt, Artificial Sequence
  Synthetic
ggcucgguuccggcgccgggug

SEQ ID NO: 45188 - RNA, 23 nt, Artificial Sequence
  Synthetic
gggcucgguuccggcgccgggug

SEQ ID NO: 45189 - RNA, 24 nt, Artificial Sequence
  Synthetic
cgggcucgguuccggcgccgggug

SEQ ID NO: 45190 - RNA, 18 nt, Artificial Sequence
  Synthetic
cacgcaucuaggggggug

SEQ ID NO: 45191 - RNA, 19 nt, Artificial Sequence
  Synthetic
acacgcaucuaggggggug

SEQ ID NO: 45192 - RNA, 20 nt, Artificial Sequence
  Synthetic
cacacgcaucuaggggggug

SEQ ID NO: 45193 - RNA, 21 nt, Artificial Sequence
  Synthetic
ucacacgcaucuaggggggug

SEQ ID NO: 45194 - RNA, 22 nt, Artificial Sequence
  Synthetic
cucacacgcaucuaggggggug

SEQ ID NO: 45195 - RNA, 23 nt, Artificial Sequence
  Synthetic
acucacacgcaucuaggggggug

SEQ ID NO: 45196 - RNA, 24 nt, Artificial Sequence
  Synthetic
uacucacacgcaucuaggggggug

SEQ ID NO: 45197 - RNA, 18 nt, Artificial Sequence
  Synthetic
agccgcccgccauauuug

SEQ ID NO: 45198 - RNA, 19 nt, Artificial Sequence
  Synthetic
gagccgcccgccauauuug

SEQ ID NO: 45199 - RNA, 20 nt, Artificial Sequence
  Synthetic
ggagccgcccgccauauuug

SEQ ID NO: 45200 - RNA, 21 nt, Artificial Sequence
  Synthetic
aggagccgcccgccauauuug

SEQ ID NO: 45201 - RNA, 22 nt, Artificial Sequence
  Synthetic
gaggagccgcccgccauauuug

SEQ ID NO: 45202 - RNA, 23 nt, Artificial Sequence
  Synthetic
ggaggagccgcccgccauauuug

SEQ ID NO: 45203 - RNA, 24 nt, Artificial Sequence
  Synthetic
gggaggagccgcccgccauauuug

SEQ ID NO: 45204 - RNA, 18 nt, Artificial Sequence
  Synthetic
gcuucccgguaugguaau

SEQ ID NO: 45205 - RNA, 19 nt, Artificial Sequence
  Synthetic
cgcuucccgguaugguaau

SEQ ID NO: 45206 - RNA, 20 nt, Artificial Sequence
  Synthetic
ccgcuucccgguaugguaau

SEQ ID NO: 45207 - RNA, 21 nt, Artificial Sequence
  Synthetic
uccgcuucccgguaugguaau

SEQ ID NO: 45208 - RNA, 22 nt, Artificial Sequence
  Synthetic
uuccgcuucccgguaugguaau

SEQ ID NO: 45209 - RNA, 23 nt, Artificial Sequence
  Synthetic
guuccgcuucccgguaugguaau

SEQ ID NO: 45210 - RNA, 24 nt, Artificial Sequence
  Synthetic
uguuccgcuucccgguaugguaau

SEQ ID NO: 45211 - RNA, 18 nt, Artificial Sequence
  Synthetic
aggagccgcccgccauau

SEQ ID NO: 45212 - RNA, 19 nt, Artificial Sequence
  Synthetic
gaggagccgcccgccauau

SEQ ID NO: 45213 - RNA, 20 nt, Artificial Sequence
  Synthetic
ggaggagccgcccgccauau

SEQ ID NO: 45214 - RNA, 21 nt, Artificial Sequence
  Synthetic
gggaggagccgcccgccauau

SEQ ID NO: 45215 - RNA, 22 nt, Artificial Sequence
  Synthetic
ggggaggagccgcccgccauau

SEQ ID NO: 45216 - RNA, 23 nt, Artificial Sequence
  Synthetic
uggggaggagccgcccgccauau

SEQ ID NO: 45217 - RNA, 24 nt, Artificial Sequence
  Synthetic
guggggaggagccgcccgccauau

SEQ ID NO: 45218 - RNA, 18 nt, Artificial Sequence
  Synthetic
ucacagggcgggccgccu

SEQ ID NO: 45219 - RNA, 19 nt, Artificial Sequence
  Synthetic
cucacagggcgggccgccu

SEQ ID NO: 45220 - RNA, 20 nt, Artificial Sequence
  Synthetic
ccucacagggcgggccgccu

SEQ ID NO: 45221 - RNA, 21 nt, Artificial Sequence
  Synthetic
cccucacagggcgggccgccu

SEQ ID NO: 45222 - RNA, 22 nt, Artificial Sequence
  Synthetic
gcccucacagggcgggccgccu

SEQ ID NO: 45223 - RNA, 23 nt, Artificial Sequence
  Synthetic
cgcccucacagggcgggccgccu

SEQ ID NO: 45224 - RNA, 24 nt, Artificial Sequence
  Synthetic
ccgcccucacagggcgggccgccu

SEQ ID NO: 45225 - RNA, 18 nt, Artificial Sequence
  Synthetic
gccgcgcauauauacgcu

SEQ ID NO: 45226 - RNA, 19 nt, Artificial Sequence
  Synthetic
agccgcgcauauauacgcu

SEQ ID NO: 45227 - RNA, 20 nt, Artificial Sequence
  Synthetic
gagccgcgcauauauacgcu

SEQ ID NO: 45228 - RNA, 21 nt, Artificial Sequence
  Synthetic
ggagccgcgcauauauacgcu

SEQ ID NO: 45229 - RNA, 22 nt, Artificial Sequence
  Synthetic
aggagccgcgcauauauacgcu

SEQ ID NO: 45230 - RNA, 23 nt, Artificial Sequence
  Synthetic
caggagccgcgcauauauacgcu

SEQ ID NO: 45231 - RNA, 24 nt, Artificial Sequence
  Synthetic
gcaggagccgcgcauauauacgcu

SEQ ID NO: 45232 - RNA, 18 nt, Artificial Sequence
  Synthetic
ccuuacucacacgcaucu

SEQ ID NO: 45233 - RNA, 19 nt, Artificial Sequence
  Synthetic
cccuuacucacacgcaucu

SEQ ID NO: 45234 - RNA, 20 nt, Artificial Sequence
  Synthetic
ccccuuacucacacgcaucu

SEQ ID NO: 45235 - RNA, 21 nt, Artificial Sequence
  Synthetic
cccccuuacucacacgcaucu

SEQ ID NO: 45236 - RNA, 22 nt, Artificial Sequence
  Synthetic
ccccccuuacucacacgcaucu

SEQ ID NO: 45237 - RNA, 23 nt, Artificial Sequence
  Synthetic
gccccccuuacucacacgcaucu

SEQ ID NO: 45238 - RNA, 24 nt, Artificial Sequence
  Synthetic
ggccccccuuacucacacgcaucu

SEQ ID NO: 45239 - RNA, 18 nt, Artificial Sequence
  Synthetic
uccgcaccaagccgcucu

SEQ ID NO: 45240 - RNA, 19 nt, Artificial Sequence
  Synthetic
cuccgcaccaagccgcucu

SEQ ID NO: 45241 - RNA, 20 nt, Artificial Sequence
  Synthetic
gcuccgcaccaagccgcucu

SEQ ID NO: 45242 - RNA, 21 nt, Artificial Sequence
  Synthetic
agcuccgcaccaagccgcucu

SEQ ID NO: 45243 - RNA, 22 nt, Artificial Sequence
  Synthetic
gagcuccgcaccaagccgcucu

SEQ ID NO: 45244 - RNA, 23 nt, Artificial Sequence
  Synthetic
ggagcuccgcaccaagccgcucu

SEQ ID NO: 45245 - RNA, 24 nt, Artificial Sequence
  Synthetic
gggagcuccgcaccaagccgcucu

SEQ ID NO: 45246 - RNA, 18 nt, Artificial Sequence
  Synthetic
ccagcguccgccgagucu

SEQ ID NO: 45247 - RNA, 19 nt, Artificial Sequence
  Synthetic
accagcguccgccgagucu

SEQ ID NO: 45248 - RNA, 20 nt, Artificial Sequence
  Synthetic
aaccagcguccgccgagucu

SEQ ID NO: 45249 - RNA, 21 nt, Artificial Sequence
  Synthetic
caaccagcguccgccgagucu

SEQ ID NO: 45250 - RNA, 22 nt, Artificial Sequence
  Synthetic
ccaaccagcguccgccgagucu

SEQ ID NO: 45251 - RNA, 23 nt, Artificial Sequence
  Synthetic
gccaaccagcguccgccgagucu

SEQ ID NO: 45252 - RNA, 24 nt, Artificial Sequence
  Synthetic
ggccaaccagcguccgccgagucu

SEQ ID NO: 45253 - RNA, 18 nt, Artificial Sequence
  Synthetic
cccccgacuccggugcgu

SEQ ID NO: 45254 - RNA, 19 nt, Artificial Sequence
  Synthetic
acccccgacuccggugcgu

SEQ ID NO: 45255 - RNA, 20 nt, Artificial Sequence
  Synthetic
gacccccgacuccggugcgu

SEQ ID NO: 45256 - RNA, 21 nt, Artificial Sequence
  Synthetic
ggacccccgacuccggugcgu

SEQ ID NO: 45257 - RNA, 22 nt, Artificial Sequence
  Synthetic
gggacccccgacuccggugcgu

SEQ ID NO: 45258 - RNA, 23 nt, Artificial Sequence
  Synthetic
ugggacccccgacuccggugcgu

SEQ ID NO: 45259 - RNA, 24 nt, Artificial Sequence
  Synthetic
gugggacccccgacuccggugcgu

SEQ ID NO: 45260 - RNA, 18 nt, Artificial Sequence
  Synthetic
acacgcaucuaggggggu

SEQ ID NO: 45261 - RNA, 19 nt, Artificial Sequence
  Synthetic
cacacgcaucuaggggggu

SEQ ID NO: 45262 - RNA, 20 nt, Artificial Sequence
  Synthetic
ucacacgcaucuaggggggu

SEQ ID NO: 45263 - RNA, 21 nt, Artificial Sequence
  Synthetic
cucacacgcaucuaggggggu

SEQ ID NO: 45264 - RNA, 22 nt, Artificial Sequence
  Synthetic
acucacacgcaucuaggggggu

SEQ ID NO: 45265 - RNA, 23 nt, Artificial Sequence
  Synthetic
uacucacacgcaucuaggggggu

SEQ ID NO: 45266 - RNA, 24 nt, Artificial Sequence
  Synthetic
uuacucacacgcaucuaggggggu

SEQ ID NO: 45267 - RNA, 18 nt, Artificial Sequence
  Synthetic
ggaccggggucgccgugu

SEQ ID NO: 45268 - RNA, 19 nt, Artificial Sequence
  Synthetic
aggaccggggucgccgugu

SEQ ID NO: 45269 - RNA, 20 nt, Artificial Sequence
  Synthetic
aaggaccggggucgccgugu

SEQ ID NO: 45270 - RNA, 21 nt, Artificial Sequence
  Synthetic
caaggaccggggucgccgugu

SEQ ID NO: 45271 - RNA, 22 nt, Artificial Sequence
  Synthetic
acaaggaccggggucgccgugu

SEQ ID NO: 45272 - RNA, 23 nt, Artificial Sequence
  Synthetic
cacaaggaccggggucgccgugu

SEQ ID NO: 45273 - RNA, 24 nt, Artificial Sequence
  Synthetic
acacaaggaccggggucgccgugu

SEQ ID NO: 45274 - RNA, 18 nt, Artificial Sequence
  Synthetic
ggagccgcccgccauauu

SEQ ID NO: 45275 - RNA, 19 nt, Artificial Sequence
  Synthetic
aggagccgcccgccauauu

SEQ ID NO: 45276 - RNA, 20 nt, Artificial Sequence
  Synthetic
gaggagccgcccgccauauu

SEQ ID NO: 45277 - RNA, 21 nt, Artificial Sequence
  Synthetic
ggaggagccgcccgccauauu

SEQ ID NO: 45278 - RNA, 22 nt, Artificial Sequence
  Synthetic
gggaggagccgcccgccauauu

SEQ ID NO: 45279 - RNA, 23 nt, Artificial Sequence
  Synthetic
ggggaggagccgcccgccauauu

SEQ ID NO: 45280 - RNA, 24 nt, Artificial Sequence
  Synthetic
uggggaggagccgcccgccauauu

SEQ ID NO: 45281 - RNA, 18 nt, Artificial Sequence
  Synthetic
cccuuucuccccccucuu

SEQ ID NO: 45282 - RNA, 19 nt, Artificial Sequence
  Synthetic
ccccuuucuccccccucuu

SEQ ID NO: 45283 - RNA, 20 nt, Artificial Sequence
  Synthetic
accccuuucuccccccucuu

SEQ ID NO: 45284 - RNA, 21 nt, Artificial Sequence
  Synthetic
gaccccuuucuccccccucuu

SEQ ID NO: 45285 - RNA, 22 nt, Artificial Sequence
  Synthetic
agaccccuuucuccccccucuu

SEQ ID NO: 45286 - RNA, 23 nt, Artificial Sequence
  Synthetic
cagaccccuuucuccccccucuu

SEQ ID NO: 45287 - RNA, 24 nt, Artificial Sequence
  Synthetic
gcagaccccuuucuccccccucuu

SEQ ID NO: 45288 - RNA, 18 nt, Artificial Sequence
  Synthetic
cagcguccgccgagucuu

SEQ ID NO: 45289 - RNA, 19 nt, Artificial Sequence
  Synthetic
ccagcguccgccgagucuu

SEQ ID NO: 45290 - RNA, 20 nt, Artificial Sequence
  Synthetic
accagcguccgccgagucuu

SEQ ID NO: 45291 - RNA, 21 nt, Artificial Sequence
  Synthetic
aaccagcguccgccgagucuu

SEQ ID NO: 45292 - RNA, 22 nt, Artificial Sequence
  Synthetic
caaccagcguccgccgagucuu

SEQ ID NO: 45293 - RNA, 23 nt, Artificial Sequence
  Synthetic
ccaaccagcguccgccgagucuu

SEQ ID NO: 45294 - RNA, 24 nt, Artificial Sequence
  Synthetic
gccaaccagcguccgccgagucuu

SEQ ID NO: 45295 - RNA, 18 nt, Artificial Sequence
  Synthetic
gaccggggucgccguguu

SEQ ID NO: 45296 - RNA, 19 nt, Artificial Sequence
  Synthetic
ggaccggggucgccguguu

SEQ ID NO: 45297 - RNA, 20 nt, Artificial Sequence
  Synthetic
aggaccggggucgccguguu

SEQ ID NO: 45298 - RNA, 21 nt, Artificial Sequence
  Synthetic
aaggaccggggucgccguguu

SEQ ID NO: 45299 - RNA, 22 nt, Artificial Sequence
  Synthetic
caaggaccggggucgccguguu

SEQ ID NO: 45300 - RNA, 23 nt, Artificial Sequence
  Synthetic
acaaggaccggggucgccguguu

SEQ ID NO: 45301 - RNA, 24 nt, Artificial Sequence
  Synthetic
cacaaggaccggggucgccguguu

SEQ ID NO: 45302 - RNA, 18 nt, Artificial Sequence
  Synthetic
gagccgcccgccauauuu

SEQ ID NO: 45303 - RNA, 19 nt, Artificial Sequence
  Synthetic
ggagccgcccgccauauuu

SEQ ID NO: 45304 - RNA, 20 nt, Artificial Sequence
  Synthetic
aggagccgcccgccauauuu

SEQ ID NO: 45305 - RNA, 21 nt, Artificial Sequence
  Synthetic
gaggagccgcccgccauauuu

SEQ ID NO: 45306 - RNA, 22 nt, Artificial Sequence
  Synthetic
ggaggagccgcccgccauauuu

SEQ ID NO: 45307 - RNA, 23 nt, Artificial Sequence
  Synthetic
gggaggagccgcccgccauauuu

SEQ ID NO: 45308 - RNA, 24 nt, Artificial Sequence
  Synthetic
ggggaggagccgcccgccauauuu

SEQ ID NO: 45309 - RNA, 18 nt, Artificial Sequence
  Synthetic
gcaggggggcaggacuuu

SEQ ID NO: 45310 - RNA, 19 nt, Artificial Sequence
  Synthetic
agcaggggggcaggacuuu

SEQ ID NO: 45311 - RNA, 20 nt, Artificial Sequence
  Synthetic
cagcaggggggcaggacuuu

SEQ ID NO: 45312 - RNA, 21 nt, Artificial Sequence
  Synthetic
ccagcaggggggcaggacuuu

SEQ ID NO: 45313 - RNA, 22 nt, Artificial Sequence
  Synthetic
gccagcaggggggcaggacuuu

SEQ ID NO: 45314 - RNA, 23 nt, Artificial Sequence
  Synthetic
ggccagcaggggggcaggacuuu

SEQ ID NO: 45315 - RNA, 24 nt, Artificial Sequence
  Synthetic
aggccagcaggggggcaggacuuu

SEQ ID NO: 45316 - RNA, 17 nt, Artificial Sequence
  Synthetic
ggccugcgucggugccc

SEQ ID NO: 45317 - RNA, 17 nt, Artificial Sequence
  Synthetic
gggggucgcaacguagg

SEQ ID NO: 45318 - RNA, 17 nt, Artificial Sequence
  Synthetic
ggguuccggguuaugcu

SEQ ID NO: 45319 - RNA, 20 nt, Artificial Sequence
  Synthetic
gccccucccgccgacgcaac

SEQ ID NO: 45320 - RNA, 17 nt, Artificial Sequence
  Synthetic
ccucccgccgacgcaac

SEQ ID NO: 45321 - RNA, 17 nt, Artificial Sequence
  Synthetic
agcaugcacggcccggc

SEQ ID NO: 45322 - RNA, 17 nt, Artificial Sequence
  Synthetic
ccccaaaggggcggcag

SEQ ID NO: 45323 - RNA, 20 nt, Artificial Sequence
  Synthetic
cuuggccugcgucggugccc

SEQ ID NO: 45324 - RNA, 20 nt, Artificial Sequence
  Synthetic
auuagcaugcacggcccggc

SEQ ID NO: 45325 - RNA, 20 nt, Artificial Sequence
  Synthetic
ccuccccaaaggggcggcag

SEQ ID NO: 45326 - RNA, 20 nt, Artificial Sequence
  Synthetic
ccugggggucgcaacguagg

SEQ ID NO: 45327 - RNA, 20 nt, Artificial Sequence
  Synthetic
cugggguuccggguuaugcu

SEQ ID NO: 45328 - RNA, 17 nt, Artificial Sequence
  Synthetic
cccgccgcgcuggcggc

SEQ ID NO: 45329 - RNA, 17 nt, Artificial Sequence
  Synthetic
ccaucgucucuccggag

SEQ ID NO: 45330 - RNA, 17 nt, Artificial Sequence
  Synthetic
gggcggguaagaauggg

SEQ ID NO: 45331 - RNA, 17 nt, Artificial Sequence
  Synthetic
gagggggaacucguggg

SEQ ID NO: 45332 - RNA, 17 nt, Artificial Sequence
  Synthetic
acuugcaagaggccuug

SEQ ID NO: 45333 - RNA, 17 nt, Artificial Sequence
  Synthetic
gcaggagccgcgcauau

SEQ ID NO: 45334 - RNA, 20 nt, Artificial Sequence
  Synthetic
ggccccgccgcgcuggcggc

SEQ ID NO: 45335 - RNA, 20 nt, Artificial Sequence
  Synthetic
cugccaucgucucuccggag

SEQ ID NO: 45336 - RNA, 20 nt, Artificial Sequence
  Synthetic
ggggggcggguaagaauggg

SEQ ID NO: 45337 - RNA, 20 nt, Artificial Sequence
  Synthetic
ggagagggggaacucguggg

SEQ ID NO: 45338 - RNA, 20 nt, Artificial Sequence
  Synthetic
aaaacuugcaagaggccuug

SEQ ID NO: 45339 - RNA, 20 nt, Artificial Sequence
  Synthetic
auggcaggagccgcgcauau

SEQ ID NO: 45340 - RNA, 17 nt, Artificial Sequence
  Synthetic
ggcacgcgacgcgaaaa

SEQ ID NO: 45341 - RNA, 17 nt, Artificial Sequence
  Synthetic
ggcacgcgcgcccuuaa

SEQ ID NO: 45342 - RNA, 17 nt, Artificial Sequence
  Synthetic
gcuaccgagaccgaaca

SEQ ID NO: 45343 - RNA, 17 nt, Artificial Sequence
  Synthetic
ggggccggauacccaca

SEQ ID NO: 45344 - RNA, 17 nt, Artificial Sequence
  Synthetic
guucgucuguccccuca

SEQ ID NO: 45345 - RNA, 17 nt, Artificial Sequence
  Synthetic
guccccucacggggcga

SEQ ID NO: 45346 - RNA, 17 nt, Artificial Sequence
  Synthetic
ggggcgaaggccgcgua

SEQ ID NO: 45347 - RNA, 17 nt, Artificial Sequence
  Synthetic
gggccggauacccacac

SEQ ID NO: 45348 - RNA, 17 nt, Artificial Sequence
  Synthetic
ggcgagcggguccggac

SEQ ID NO: 45349 - RNA, 17 nt, Artificial Sequence
  Synthetic
gcgcgcccuuaauggac

SEQ ID NO: 45350 - RNA, 17 nt, Artificial Sequence
  Synthetic
ggugcgaaagacuuucc

SEQ ID NO: 45351 - RNA, 17 nt, Artificial Sequence
  Synthetic
gucgcgugccggcgagc

SEQ ID NO: 45352 - RNA, 17 nt, Artificial Sequence
  Synthetic
gggccccuuggguccgc

SEQ ID NO: 45353 - RNA, 17 nt, Artificial Sequence
  Synthetic
guuuuucguuccgucgc

SEQ ID NO: 45354 - RNA, 17 nt, Artificial Sequence
  Synthetic
ggguuaccgccaacggc

SEQ ID NO: 45355 - RNA, 17 nt, Artificial Sequence
  Synthetic
guggacucgcggggggc

SEQ ID NO: 45356 - RNA, 17 nt, Artificial Sequence
  Synthetic
gccugagaugaacacuc

SEQ ID NO: 45357 - RNA, 17 nt, Artificial Sequence
  Synthetic
gcgguccgggccccguc

SEQ ID NO: 45358 - RNA, 17 nt, Artificial Sequence
  Synthetic
gacuuuccgggcgcguc

SEQ ID NO: 45359 - RNA, 17 nt, Artificial Sequence
  Synthetic
gcgcgcgcacucacaag

SEQ ID NO: 45360 - RNA, 17 nt, Artificial Sequence
  Synthetic
gccccggcggacccaag

SEQ ID NO: 45361 - RNA, 17 nt, Artificial Sequence
  Synthetic
gcacucacaagcggcag

SEQ ID NO: 45362 - RNA, 17 nt, Artificial Sequence
  Synthetic
guacggcccgggacgag

SEQ ID NO: 45363 - RNA, 17 nt, Artificial Sequence
  Synthetic
ggccuucgccccgugag

SEQ ID NO: 45364 - RNA, 17 nt, Artificial Sequence
  Synthetic
gcgagcggguccggacg

SEQ ID NO: 45365 - RNA, 17 nt, Artificial Sequence
  Synthetic
gcguacggcccgggacg

SEQ ID NO: 45366 - RNA, 17 nt, Artificial Sequence
  Synthetic
gccccuuggguccgccg

SEQ ID NO: 45367 - RNA, 17 nt, Artificial Sequence
  Synthetic
ggcgcguccgggugccg

SEQ ID NO: 45368 - RNA, 17 nt, Artificial Sequence
  Synthetic
ggauacccacacgggcg

SEQ ID NO: 45369 - RNA, 17 nt, Artificial Sequence
  Synthetic
gccggcggguggacucg

SEQ ID NO: 45370 - RNA, 17 nt, Artificial Sequence
  Synthetic
gccggccggcgcuuagg

SEQ ID NO: 45371 - RNA, 17 nt, Artificial Sequence
  Synthetic
gacucgcggggggccgg

SEQ ID NO: 45372 - RNA, 17 nt, Artificial Sequence
  Synthetic
gauacccacacgggcgg

SEQ ID NO: 45373 - RNA, 17 nt, Artificial Sequence
  Synthetic
gcggguggacucgcggg

SEQ ID NO: 45374 - RNA, 17 nt, Artificial Sequence
  Synthetic
ggccggcgcuuaggggg

SEQ ID NO: 45375 - RNA, 17 nt, Artificial Sequence
  Synthetic
gcggccuucgccccgug

SEQ ID NO: 45376 - RNA, 17 nt, Artificial Sequence
  Synthetic
gccgccguguucggucu

SEQ ID NO: 45377 - RNA, 20 nt, Artificial Sequence
  Synthetic
gccggcacgcgacgcgaaaa

SEQ ID NO: 45378 - RNA, 20 nt, Artificial Sequence
  Synthetic
gccccgcgccgguccauuaa

SEQ ID NO: 45379 - RNA, 20 nt, Artificial Sequence
  Synthetic
gaggaacaaccgaggggaac

SEQ ID NO: 45380 - RNA, 20 nt, Artificial Sequence
  Synthetic
ggggggccggauacccacac

SEQ ID NO: 45381 - RNA, 20 nt, Artificial Sequence
  Synthetic
gccggcgagcggguccggac

SEQ ID NO: 45382 - RNA, 20 nt, Artificial Sequence
  Synthetic
gcgacgcgaaaaaggccccc

SEQ ID NO: 45383 - RNA, 20 nt, Artificial Sequence
  Synthetic
gcgaaggccgcguacggccc

SEQ ID NO: 45384 - RNA, 20 nt, Artificial Sequence
  Synthetic
ggcgaaggccgcguacggcc

SEQ ID NO: 45385 - RNA, 20 nt, Artificial Sequence
  Synthetic
gcuuuuccggguucccggcc

SEQ ID NO: 45386 - RNA, 20 nt, Artificial Sequence
  Synthetic
gagcggguccggacggggcc

SEQ ID NO: 45387 - RNA, 20 nt, Artificial Sequence
  Synthetic
gcccccgaccgcggcggucc

SEQ ID NO: 45388 - RNA, 20 nt, Artificial Sequence
  Synthetic
gucauuguuuauguggccgc

SEQ ID NO: 45389 - RNA, 20 nt, Artificial Sequence
  Synthetic
gacauccucccccuaagcgc

SEQ ID NO: 45390 - RNA, 20 nt, Artificial Sequence
  Synthetic
gguguuuuucguuccgucgc

SEQ ID NO: 45391 - RNA, 20 nt, Artificial Sequence
  Synthetic
ggucucgguagccggccggc

SEQ ID NO: 45392 - RNA, 20 nt, Artificial Sequence
  Synthetic
ggccggauacccacacgggc

SEQ ID NO: 45393 - RNA, 20 nt, Artificial Sequence
  Synthetic
guucaucucaggccccgggc

SEQ ID NO: 45394 - RNA, 20 nt, Artificial Sequence
  Synthetic
gggugucgcgggccgucugc

SEQ ID NO: 45395 - RNA, 20 nt, Artificial Sequence
  Synthetic
gccuuuuucgcgucgcgugc

SEQ ID NO: 45396 - RNA, 20 nt, Artificial Sequence
  Synthetic
ggggguguaggauggguauc

SEQ ID NO: 45397 - RNA, 20 nt, Artificial Sequence
  Synthetic
ggccacauaaacaaugacuc

SEQ ID NO: 45398 - RNA, 20 nt, Artificial Sequence
  Synthetic
guccgggugccgcggcucuc

SEQ ID NO: 45399 - RNA, 20 nt, Artificial Sequence
  Synthetic
ggcccccgaccgcggcgguc

SEQ ID NO: 45400 - RNA, 20 nt, Artificial Sequence
  Synthetic
gacagacgaacgaaacauuc

SEQ ID NO: 45401 - RNA, 20 nt, Artificial Sequence
  Synthetic
ggguggugcgaaagacuuuc

SEQ ID NO: 45402 - RNA, 20 nt, Artificial Sequence
  Synthetic
ggggccccggcggacccaag

SEQ ID NO: 45403 - RNA, 20 nt, Artificial Sequence
  Synthetic
gccgcguacggcccgggacg

SEQ ID NO: 45404 - RNA, 20 nt, Artificial Sequence
  Synthetic
ggacgaggggcccccgaccg

SEQ ID NO: 45405 - RNA, 20 nt, Artificial Sequence
  Synthetic
ggggccccuuggguccgccg

SEQ ID NO: 45406 - RNA, 20 nt, Artificial Sequence
  Synthetic
ggaacccggaaaagccuccg

SEQ ID NO: 45407 - RNA, 20 nt, Artificial Sequence
  Synthetic
gcccuuaauggaccggcgcg

SEQ ID NO: 45408 - RNA, 20 nt, Artificial Sequence
  Synthetic
gcgcccuuaauggaccggcg

SEQ ID NO: 45409 - RNA, 20 nt, Artificial Sequence
  Synthetic
gccggauacccacacgggcg

SEQ ID NO: 45410 - RNA, 20 nt, Artificial Sequence
  Synthetic
gccuaauggauuuccgggcg

SEQ ID NO: 45411 - RNA, 20 nt, Artificial Sequence
  Synthetic
ggcccggaccgccgcggucg

SEQ ID NO: 45412 - RNA, 20 nt, Artificial Sequence
  Synthetic
ggaacaaccgaggggaacgg

SEQ ID NO: 45413 - RNA, 20 nt, Artificial Sequence
  Synthetic
gcuaccgagaccgaacacgg

SEQ ID NO: 45414 - RNA, 20 nt, Artificial Sequence
  Synthetic
guggacucgcggggggccgg

SEQ ID NO: 45415 - RNA, 20 nt, Artificial Sequence
  Synthetic
gaacccggaaaagccuccgg

SEQ ID NO: 45416 - RNA, 20 nt, Artificial Sequence
  Synthetic
gcccggaccgccgcggucgg

SEQ ID NO: 45417 - RNA, 20 nt, Artificial Sequence
  Synthetic
gggccggauacccacacggg

SEQ ID NO: 45418 - RNA, 20 nt, Artificial Sequence
  Synthetic
ggauacccacacgggcgggg

SEQ ID NO: 45419 - RNA, 20 nt, Artificial Sequence
  Synthetic
gauacccacacgggcggggg

SEQ ID NO: 45420 - RNA, 20 nt, Artificial Sequence
  Synthetic
gcccagagucauuguuuaug

SEQ ID NO: 45421 - RNA, 20 nt, Artificial Sequence
  Synthetic
gagugcgcgcgccggcucug

SEQ ID NO: 45422 - RNA, 20 nt, Artificial Sequence
  Synthetic
gcaugcgccgggccguugug

SEQ ID NO: 45423 - RNA, 20 nt, Artificial Sequence
  Synthetic
gcgcaugcgccgggccguug

SEQ ID NO: 45424 - RNA, 20 nt, Artificial Sequence
  Synthetic
gcggccgccguguucggucu

SEQ ID NO: 45425 - RNA, 20 nt, Artificial Sequence
  Synthetic
ggccacagcaccacgugggu

SEQ ID NO: 45426 - RNA, 20 nt, Artificial Sequence
  Synthetic
gcgcgccggcucugcggugu

SEQ ID NO: 45427 - RNA, 20 nt, Artificial Sequence
  Synthetic
gcugcggcggccgccguguu

SEQ ID NO: 45428 - RNA, 17 nt, Artificial Sequence
  Synthetic
cucgggguuaccgccaa

SEQ ID NO: 45429 - RNA, 17 nt, Artificial Sequence
  Synthetic
cgcccccgcuuuuauaa

SEQ ID NO: 45430 - RNA, 17 nt, Artificial Sequence
  Synthetic
ccucgucugcggccuaa

SEQ ID NO: 45431 - RNA, 17 nt, Artificial Sequence
  Synthetic
ccgcgccgguccauuaa

SEQ ID NO: 45432 - RNA, 17 nt, Artificial Sequence
  Synthetic
cguacggcccgggacga

SEQ ID NO: 45433 - RNA, 17 nt, Artificial Sequence
  Synthetic
acucgcggggggccgga

SEQ ID NO: 45434 - RNA, 17 nt, Artificial Sequence
  Synthetic
cggcgagcggguccgga

SEQ ID NO: 45435 - RNA, 17 nt, Artificial Sequence
  Synthetic
cggccuucgccccguga

SEQ ID NO: 45436 - RNA, 17 nt, Artificial Sequence
  Synthetic
cccgcgccgguccauua

SEQ ID NO: 45437 - RNA, 17 nt, Artificial Sequence
  Synthetic
cggccggccggcgcuua

SEQ ID NO: 45438 - RNA, 17 nt, Artificial Sequence
  Synthetic
acgcgaaaaaggccccc

SEQ ID NO: 45439 - RNA, 17 nt, Artificial Sequence
  Synthetic
acgccccuuggccgccc

SEQ ID NO: 45440 - RNA, 17 nt, Artificial Sequence
  Synthetic
aacccggaaaagccucc

SEQ ID NO: 45441 - RNA, 17 nt, Artificial Sequence
  Synthetic
acuuuccgggcgcgucc

SEQ ID NO: 45442 - RNA, 17 nt, Artificial Sequence
  Synthetic
ucgggggccccucgucc

SEQ ID NO: 45443 - RNA, 17 nt, Artificial Sequence
  Synthetic
cccgaccgcggcggucc

SEQ ID NO: 45444 - RNA, 17 nt, Artificial Sequence
  Synthetic
aggcuuuuccggguucc

SEQ ID NO: 45445 - RNA, 17 nt, Artificial Sequence
  Synthetic
cgccgacaccgcagagc

SEQ ID NO: 45446 - RNA, 17 nt, Artificial Sequence
  Synthetic
uguucggucucgguagc

SEQ ID NO: 45447 - RNA, 17 nt, Artificial Sequence
  Synthetic
cccgcgaguccacccgc

SEQ ID NO: 45448 - RNA, 17 nt, Artificial Sequence
  Synthetic
aagcgccggccggccgc

SEQ ID NO: 45449 - RNA, 17 nt, Artificial Sequence
  Synthetic
auuguuuauguggccgc

SEQ ID NO: 45450 - RNA, 17 nt, Artificial Sequence
  Synthetic
cuugugagugcgcgcgc

SEQ ID NO: 45451 - RNA, 17 nt, Artificial Sequence
  Synthetic
ccuuaauggaccggcgc

SEQ ID NO: 45452 - RNA, 17 nt, Artificial Sequence
  Synthetic
aaccacagcgcaugcgc

SEQ ID NO: 45453 - RNA, 17 nt, Artificial Sequence
  Synthetic
ccggcggguggacucgc

SEQ ID NO: 45454 - RNA, 17 nt, Artificial Sequence
  Synthetic
cguccggacccgcucgc

SEQ ID NO: 45455 - RNA, 17 nt, Artificial Sequence
  Synthetic
acggauugauaucucgc

SEQ ID NO: 45456 - RNA, 17 nt, Artificial Sequence
  Synthetic
cggucucgguagccggc

SEQ ID NO: 45457 - RNA, 17 nt, Artificial Sequence
  Synthetic
cgaguccacccgccggc

SEQ ID NO: 45458 - RNA, 17 nt, Artificial Sequence
  Synthetic
ucccccuaagcgccggc

SEQ ID NO: 45459 - RNA, 17 nt, Artificial Sequence
  Synthetic
cucgguagccggccggc

SEQ ID NO: 45460 - RNA, 17 nt, Artificial Sequence
  Synthetic
cggauacccacacgggc

SEQ ID NO: 45461 - RNA, 17 nt, Artificial Sequence
  Synthetic
auggaccggcgcggggc

SEQ ID NO: 45462 - RNA, 17 nt, Artificial Sequence
  Synthetic
uuggccgccccggcugc

SEQ ID NO: 45463 - RNA, 17 nt, Artificial Sequence
  Synthetic
ugucgcgggccgucugc

SEQ ID NO: 45464 - RNA, 17 nt, Artificial Sequence
  Synthetic
uuuuucgcgucgcgugc

SEQ ID NO: 45465 - RNA, 17 nt, Artificial Sequence
  Synthetic
ccgcccguguggguauc

SEQ ID NO: 45466 - RNA, 17 nt, Artificial Sequence
  Synthetic
cccggaccgccgcgguc

SEQ ID NO: 45467 - RNA, 17 nt, Artificial Sequence
  Synthetic
ccccgaccgcggcgguc

SEQ ID NO: 45468 - RNA, 17 nt, Artificial Sequence
  Synthetic
uggugcgaaagacuuuc

SEQ ID NO: 45469 - RNA, 17 nt, Artificial Sequence
  Synthetic
ccccccggaggcuuuuc

SEQ ID NO: 45470 - RNA, 17 nt, Artificial Sequence
  Synthetic
cgucgcgugccggcgag

SEQ ID NO: 45471 - RNA, 17 nt, Artificial Sequence
  Synthetic
ccaccacccccgaaacg

SEQ ID NO: 45472 - RNA, 17 nt, Artificial Sequence
  Synthetic
aacaaccgaggggaacg

SEQ ID NO: 45473 - RNA, 17 nt, Artificial Sequence
  Synthetic
uacaucaccuacccacg

SEQ ID NO: 45474 - RNA, 17 nt, Artificial Sequence
  Synthetic
ucgucccgggccguacg

SEQ ID NO: 45475 - RNA, 17 nt, Artificial Sequence
  Synthetic
cgaggggcccccgaccg

SEQ ID NO: 45476 - RNA, 17 nt, Artificial Sequence
  Synthetic
ccaacggccggcccccg

SEQ ID NO: 45477 - RNA, 17 nt, Artificial Sequence
  Synthetic
cuuaauggaccggcgcg

SEQ ID NO: 45478 - RNA, 17 nt, Artificial Sequence
  Synthetic
cggcggguggacucgcg

SEQ ID NO: 45479 - RNA, 17 nt, Artificial Sequence
  Synthetic
cccuuaauggaccggcg

SEQ ID NO: 45480 - RNA, 17 nt, Artificial Sequence
  Synthetic
uaauggauuuccgggcg

SEQ ID NO: 45481 - RNA, 17 nt, Artificial Sequence
  Synthetic
aacggauugauaucucg

SEQ ID NO: 45482 - RNA, 17 nt, Artificial Sequence
  Synthetic
ccggaccgccgcggucg

SEQ ID NO: 45483 - RNA, 17 nt, Artificial Sequence
  Synthetic
ucguuuuccccguuucg

SEQ ID NO: 45484 - RNA, 17 nt, Artificial Sequence
  Synthetic
accgagaccgaacacgg

SEQ ID NO: 45485 - RNA, 17 nt, Artificial Sequence
  Synthetic
cgaaaaaggccccccgg

SEQ ID NO: 45486 - RNA, 17 nt, Artificial Sequence
  Synthetic
ucucgguagccggccgg

SEQ ID NO: 45487 - RNA, 17 nt, Artificial Sequence
  Synthetic
cccggaaaagccuccgg

SEQ ID NO: 45488 - RNA, 17 nt, Artificial Sequence
  Synthetic
agccuuuauaaaagcgg

SEQ ID NO: 45489 - RNA, 17 nt, Artificial Sequence
  Synthetic
cucugcggugucggcgg

SEQ ID NO: 45490 - RNA, 17 nt, Artificial Sequence
  Synthetic
cggaccgccgcggucgg

SEQ ID NO: 45491 - RNA, 17 nt, Artificial Sequence
  Synthetic
cggcucugcggugucgg

SEQ ID NO: 45492 - RNA, 17 nt, Artificial Sequence
  Synthetic
cguuuuccccguuucgg

SEQ ID NO: 45493 - RNA, 17 nt, Artificial Sequence
  Synthetic
ccggauacccacacggg

SEQ ID NO: 45494 - RNA, 17 nt, Artificial Sequence
  Synthetic
ccggaaaagccuccggg

SEQ ID NO: 45495 - RNA, 17 nt, Artificial Sequence
  Synthetic
auacccacacgggcggg

SEQ ID NO: 45496 - RNA, 17 nt, Artificial Sequence
  Synthetic
uacccacacgggcgggg

SEQ ID NO: 45497 - RNA, 17 nt, Artificial Sequence
  Synthetic
uuuccccguuucggggg

SEQ ID NO: 45498 - RNA, 17 nt, Artificial Sequence
  Synthetic
cgggggccggccguugg

SEQ ID NO: 45499 - RNA, 17 nt, Artificial Sequence
  Synthetic
ccguuucggggguggug

SEQ ID NO: 45500 - RNA, 17 nt, Artificial Sequence
  Synthetic
ugcgccgggccguugug

SEQ ID NO: 45501 - RNA, 17 nt, Artificial Sequence
  Synthetic
caugcgccgggccguug

SEQ ID NO: 45502 - RNA, 17 nt, Artificial Sequence
  Synthetic
augucgccgacgccccu

SEQ ID NO: 45503 - RNA, 17 nt, Artificial Sequence
  Synthetic
cgccggcucugcggugu

SEQ ID NO: 45504 - RNA, 17 nt, Artificial Sequence
  Synthetic
augcgccgggccguugu

SEQ ID NO: 45505 - RNA, 20 nt, Artificial Sequence
  Synthetic
cccggcccggggccccacaa

SEQ ID NO: 45506 - RNA, 20 nt, Artificial Sequence
  Synthetic
acacucgggguuaccgccaa

SEQ ID NO: 45507 - RNA, 20 nt, Artificial Sequence
  Synthetic
ccgcgcccccgcuuuuauaa

SEQ ID NO: 45508 - RNA, 20 nt, Artificial Sequence
  Synthetic
uuuccucgucugcggccuaa

SEQ ID NO: 45509 - RNA, 20 nt, Artificial Sequence
  Synthetic
ccggcuaccgagaccgaaca

SEQ ID NO: 45510 - RNA, 20 nt, Artificial Sequence
  Synthetic
cggggggccggauacccaca

SEQ ID NO: 45511 - RNA, 20 nt, Artificial Sequence
  Synthetic
cguuaagugcucugcagaca

SEQ ID NO: 45512 - RNA, 20 nt, Artificial Sequence
  Synthetic
uguggccgcgggccagcaga

SEQ ID NO: 45513 - RNA, 20 nt, Artificial Sequence
  Synthetic
ccgcguacggcccgggacga

SEQ ID NO: 45514 - RNA, 20 nt, Artificial Sequence
  Synthetic
cgaacgaaacauuccggcga

SEQ ID NO: 45515 - RNA, 20 nt, Artificial Sequence
  Synthetic
ucuguccccucacggggcga

SEQ ID NO: 45516 - RNA, 20 nt, Artificial Sequence
  Synthetic
uggacucgcggggggccgga

SEQ ID NO: 45517 - RNA, 20 nt, Artificial Sequence
  Synthetic
ugccggcgagcggguccgga

SEQ ID NO: 45518 - RNA, 20 nt, Artificial Sequence
  Synthetic
acgcggccuucgccccguga

SEQ ID NO: 45519 - RNA, 20 nt, Artificial Sequence
  Synthetic
cacggggcgaaggccgcgua

SEQ ID NO: 45520 - RNA, 20 nt, Artificial Sequence
  Synthetic
cgccccgcgccgguccauua

SEQ ID NO: 45521 - RNA, 20 nt, Artificial Sequence
  Synthetic
ugagaugacgcagcaaaaac

SEQ ID NO: 45522 - RNA, 20 nt, Artificial Sequence
  Synthetic
ucguucgucuguccccucac

SEQ ID NO: 45523 - RNA, 20 nt, Artificial Sequence
  Synthetic
ccguuaagugcucugcagac

SEQ ID NO: 45524 - RNA, 20 nt, Artificial Sequence
  Synthetic
cacgcgcgcccuuaauggac

SEQ ID NO: 45525 - RNA, 20 nt, Artificial Sequence
  Synthetic
ccgggccguuguggggcccc

SEQ ID NO: 45526 - RNA, 20 nt, Artificial Sequence
  Synthetic
cgaguguucaucucaggccc

SEQ ID NO: 45527 - RNA, 20 nt, Artificial Sequence
  Synthetic
cuuuuccggguucccggccc

SEQ ID NO: 45528 - RNA, 20 nt, Artificial Sequence
  Synthetic
ccguuguggggccccgggcc

SEQ ID NO: 45529 - RNA, 20 nt, Artificial Sequence
  Synthetic
uccgggugccgcggcucucc

SEQ ID NO: 45530 - RNA, 20 nt, Artificial Sequence
  Synthetic
aagacuuuccgggcgcgucc

SEQ ID NO: 45531 - RNA, 20 nt, Artificial Sequence
  Synthetic
cggaggcuuuuccggguucc

SEQ ID NO: 45532 - RNA, 20 nt, Artificial Sequence
  Synthetic
cugcggccuaauggauuucc

SEQ ID NO: 45533 - RNA, 20 nt, Artificial Sequence
  Synthetic
cgccgccgacaccgcagagc

SEQ ID NO: 45534 - RNA, 20 nt, Artificial Sequence
  Synthetic
ccguguucggucucgguagc

SEQ ID NO: 45535 - RNA, 20 nt, Artificial Sequence
  Synthetic
ccuaagcgccggccggccgc

SEQ ID NO: 45536 - RNA, 20 nt, Artificial Sequence
  Synthetic
ccggggccccuuggguccgc

SEQ ID NO: 45537 - RNA, 20 nt, Artificial Sequence
  Synthetic
ccgcuugugagugcgcgcgc

SEQ ID NO: 45538 - RNA, 20 nt, Artificial Sequence
  Synthetic
cgcccuuaauggaccggcgc

SEQ ID NO: 45539 - RNA, 20 nt, Artificial Sequence
  Synthetic
uuaacggauugauaucucgc

SEQ ID NO: 45540 - RNA, 20 nt, Artificial Sequence
  Synthetic
ucgggguuaccgccaacggc

SEQ ID NO: 45541 - RNA, 20 nt, Artificial Sequence
  Synthetic
ccgcgaguccacccgccggc

SEQ ID NO: 45542 - RNA, 20 nt, Artificial Sequence
  Synthetic
aaaacagaccagcggccggc

SEQ ID NO: 45543 - RNA, 20 nt, Artificial Sequence
  Synthetic
cgaaaaaacagaccagcggc

SEQ ID NO: 45544 - RNA, 20 nt, Artificial Sequence
  Synthetic
cccccgcccguguggguauc

SEQ ID NO: 45545 - RNA, 20 nt, Artificial Sequence
  Synthetic
cgggaacccggaaaagccuc

SEQ ID NO: 45546 - RNA, 20 nt, Artificial Sequence
  Synthetic
uaaccccgaguguucaucuc

SEQ ID NO: 45547 - RNA, 20 nt, Artificial Sequence
  Synthetic
aaagacuuuccgggcgcguc

SEQ ID NO: 45548 - RNA, 20 nt, Artificial Sequence
  Synthetic
uuuuucguuuuccccguuuc

SEQ ID NO: 45549 - RNA, 20 nt, Artificial Sequence
  Synthetic
aggccccccggaggcuuuuc

SEQ ID NO: 45550 - RNA, 20 nt, Artificial Sequence
  Synthetic
cgcgcacucacaagcggcag

SEQ ID NO: 45551 - RNA, 20 nt, Artificial Sequence
  Synthetic
cgcguacggcccgggacgag

SEQ ID NO: 45552 - RNA, 20 nt, Artificial Sequence
  Synthetic
ucgcgucgcgugccggcgag

SEQ ID NO: 45553 - RNA, 20 nt, Artificial Sequence
  Synthetic
cgcggccuucgccccgugag

SEQ ID NO: 45554 - RNA, 20 nt, Artificial Sequence
  Synthetic
aaacaggccacagcaccacg

SEQ ID NO: 45555 - RNA, 20 nt, Artificial Sequence
  Synthetic
aauuacaucaccuacccacg

SEQ ID NO: 45556 - RNA, 20 nt, Artificial Sequence
  Synthetic
cguucgucuguccccucacg

SEQ ID NO: 45557 - RNA, 20 nt, Artificial Sequence
  Synthetic
aauccauuaggccgcagacg

SEQ ID NO: 45558 - RNA, 20 nt, Artificial Sequence
  Synthetic
ccggcgagcggguccggacg

SEQ ID NO: 45559 - RNA, 20 nt, Artificial Sequence
  Synthetic
cccucgucccgggccguacg

SEQ ID NO: 45560 - RNA, 20 nt, Artificial Sequence
  Synthetic
uuuuccggguucccggcccg

SEQ ID NO: 45561 - RNA, 20 nt, Artificial Sequence
  Synthetic
cguuguggggccccgggccg

SEQ ID NO: 45562 - RNA, 20 nt, Artificial Sequence
  Synthetic
uaauggaccggcgcggggcg

SEQ ID NO: 45563 - RNA, 20 nt, Artificial Sequence
  Synthetic
ccuuuauaaaagcgggggcg

SEQ ID NO: 45564 - RNA, 20 nt, Artificial Sequence
  Synthetic
ccggccggcggguggacucg

SEQ ID NO: 45565 - RNA, 20 nt, Artificial Sequence
  Synthetic
uuuucguuuuccccguuucg

SEQ ID NO: 45566 - RNA, 20 nt, Artificial Sequence
  Synthetic
uuggccgccccggcugcagg

SEQ ID NO: 45567 - RNA, 20 nt, Artificial Sequence
  Synthetic
acgcgaaaaaggccccccgg

SEQ ID NO: 45568 - RNA, 20 nt, Artificial Sequence
  Synthetic
cggucucgguagccggccgg

SEQ ID NO: 45569 - RNA, 20 nt, Artificial Sequence
  Synthetic
cucagccuuuauaaaagcgg

SEQ ID NO: 45570 - RNA, 20 nt, Artificial Sequence
  Synthetic
ccggauacccacacgggcgg

SEQ ID NO: 45571 - RNA, 20 nt, Artificial Sequence
  Synthetic
cgccggcucugcggugucgg

SEQ ID NO: 45572 - RNA, 20 nt, Artificial Sequence
  Synthetic
uuucguuuuccccguuucgg

SEQ ID NO: 45573 - RNA, 20 nt, Artificial Sequence
  Synthetic
aacccggaaaagccuccggg

SEQ ID NO: 45574 - RNA, 20 nt, Artificial Sequence
  Synthetic
cucgguagccggccggcggg

SEQ ID NO: 45575 - RNA, 20 nt, Artificial Sequence
  Synthetic
cggauacccacacgggcggg

SEQ ID NO: 45576 - RNA, 20 nt, Artificial Sequence
  Synthetic
cguuuuccccguuucggggg

SEQ ID NO: 45577 - RNA, 20 nt, Artificial Sequence
  Synthetic
auacccacacgggcgggggg

SEQ ID NO: 45578 - RNA, 20 nt, Artificial Sequence
  Synthetic
ccaacggccggcccccgugg

SEQ ID NO: 45579 - RNA, 20 nt, Artificial Sequence
  Synthetic
uuuccccguuucgggggugg

SEQ ID NO: 45580 - RNA, 20 nt, Artificial Sequence
  Synthetic
ccccguuucggggguggugg

SEQ ID NO: 45581 - RNA, 20 nt, Artificial Sequence
  Synthetic
ccacgggggccggccguugg

SEQ ID NO: 45582 - RNA, 20 nt, Artificial Sequence
  Synthetic
uacgcggccuucgccccgug

SEQ ID NO: 45583 - RNA, 20 nt, Artificial Sequence
  Synthetic
uccccguuucggggguggug

SEQ ID NO: 45584 - RNA, 20 nt, Artificial Sequence
  Synthetic
aggaugucgccgacgccccu

SEQ ID NO: 45585 - RNA, 20 nt, Artificial Sequence
  Synthetic
ccgccacgggggccggccgu

SEQ ID NO: 45586 - RNA, 20 nt, Artificial Sequence
  Synthetic
ccggggcggccaaggggcgu

SEQ ID NO: 45587 - RNA, 20 nt, Artificial Sequence
  Synthetic
cgcaugcgccgggccguugu

SEQ ID NO: 45588 - RNA, 20 nt, Artificial Sequence
  Synthetic
accgcgcccggaaauccauu

SEQ ID NO: 45589 - RNA, 20 nt, Artificial Sequence
  Synthetic
ccagcggccggccggcgcuu

SEQ ID NO: 45590 - RNA, 17 nt, Artificial Sequence
  Synthetic
ggcccggggccccacaa

SEQ ID NO: 45591 - RNA, 17 nt, Artificial Sequence
  Synthetic
ggccccggcggacccaa

SEQ ID NO: 45592 - RNA, 17 nt, Artificial Sequence
  Synthetic
gcagccggggcggccaa

SEQ ID NO: 45593 - RNA, 17 nt, Artificial Sequence
  Synthetic
ggaacaaccgaggggaa

SEQ ID NO: 45594 - RNA, 17 nt, Artificial Sequence
  Synthetic
gucugcagagcacuuaa

SEQ ID NO: 45595 - RNA, 17 nt, Artificial Sequence
  Synthetic
gggccccggcggaccca

SEQ ID NO: 45596 - RNA, 17 nt, Artificial Sequence
  Synthetic
ggccgcgggccagcaga

SEQ ID NO: 45597 - RNA, 17 nt, Artificial Sequence
  Synthetic
ggcagggggguguagga

SEQ ID NO: 45598 - RNA, 17 nt, Artificial Sequence
  Synthetic
ggggaacgggggaugga

SEQ ID NO: 45599 - RNA, 17 nt, Artificial Sequence
  Synthetic
gggggccggagggugga

SEQ ID NO: 45600 - RNA, 17 nt, Artificial Sequence
  Synthetic
gaugacgcagcaaaaac

SEQ ID NO: 45601 - RNA, 17 nt, Artificial Sequence
  Synthetic
gaacaaccgaggggaac

SEQ ID NO: 45602 - RNA, 17 nt, Artificial Sequence
  Synthetic
gccccgggccgggaacc

SEQ ID NO: 45603 - RNA, 17 nt, Artificial Sequence
  Synthetic
ggguccgccggggcccc

SEQ ID NO: 45604 - RNA, 17 nt, Artificial Sequence
  Synthetic
ggccguuguggggcccc

SEQ ID NO: 45605 - RNA, 17 nt, Artificial Sequence
  Synthetic
guguucaucucaggccc

SEQ ID NO: 45606 - RNA, 17 nt, Artificial Sequence
  Synthetic
gcggacccaaggggccc

SEQ ID NO: 45607 - RNA, 17 nt, Artificial Sequence
  Synthetic
ggcccggcccggggccc

SEQ ID NO: 45608 - RNA, 17 nt, Artificial Sequence
  Synthetic
gggccguuguggggccc

SEQ ID NO: 45609 - RNA, 17 nt, Artificial Sequence
  Synthetic
ggccccuuggguccgcc

SEQ ID NO: 45610 - RNA, 17 nt, Artificial Sequence
  Synthetic
gacaggggcaccgcgcc

SEQ ID NO: 45611 - RNA, 17 nt, Artificial Sequence
  Synthetic
ggggccccacaacggcc

SEQ ID NO: 45612 - RNA, 17 nt, Artificial Sequence
  Synthetic
gaaggccgcguacggcc

SEQ ID NO: 45613 - RNA, 17 nt, Artificial Sequence
  Synthetic
gggugccgcggcucucc

SEQ ID NO: 45614 - RNA, 17 nt, Artificial Sequence
  Synthetic
ggccccccgccccgcgc

SEQ ID NO: 45615 - RNA, 17 nt, Artificial Sequence
  Synthetic
gccggaggguggaaggc

SEQ ID NO: 45616 - RNA, 17 nt, Artificial Sequence
  Synthetic
guuguggggccccgggc

SEQ ID NO: 45617 - RNA, 17 nt, Artificial Sequence
  Synthetic
ggcgcggggcggggggc

SEQ ID NO: 45618 - RNA, 17 nt, Artificial Sequence
  Synthetic
gguguaggauggguauc

SEQ ID NO: 45619 - RNA, 17 nt, Artificial Sequence
  Synthetic
gaacccggaaaagccuc

SEQ ID NO: 45620 - RNA, 17 nt, Artificial Sequence
  Synthetic
gugccggcgagcggguc

SEQ ID NO: 45621 - RNA, 17 nt, Artificial Sequence
  Synthetic
gcggccuaauggauuuc

SEQ ID NO: 45622 - RNA, 17 nt, Artificial Sequence
  Synthetic
gauggaaggacgggaag

SEQ ID NO: 45623 - RNA, 17 nt, Artificial Sequence
  Synthetic
ggccgccccggcugcag

SEQ ID NO: 45624 - RNA, 17 nt, Artificial Sequence
  Synthetic
ggccggccggcgcuuag

SEQ ID NO: 45625 - RNA, 17 nt, Artificial Sequence
  Synthetic
ggccgucugcuggcccg

SEQ ID NO: 45626 - RNA, 17 nt, Artificial Sequence
  Synthetic
gggccccccugcagccg

SEQ ID NO: 45627 - RNA, 17 nt, Artificial Sequence
  Synthetic
gggggcccggagagccg

SEQ ID NO: 45628 - RNA, 17 nt, Artificial Sequence
  Synthetic
gcggggggggggugucg

SEQ ID NO: 45629 - RNA, 17 nt, Artificial Sequence
  Synthetic
ggaggguggaaggcagg

SEQ ID NO: 45630 - RNA, 17 nt, Artificial Sequence
  Synthetic
gccgccccggcugcagg

SEQ ID NO: 45631 - RNA, 17 nt, Artificial Sequence
  Synthetic
gggccgggccgccacgg

SEQ ID NO: 45632 - RNA, 17 nt, Artificial Sequence
  Synthetic
ggggcccccgaccgcgg

SEQ ID NO: 45633 - RNA, 17 nt, Artificial Sequence
  Synthetic
ggcggguggacucgcgg

SEQ ID NO: 45634 - RNA, 17 nt, Artificial Sequence
  Synthetic
ggaccggcgcggggcgg

SEQ ID NO: 45635 - RNA, 17 nt, Artificial Sequence
  Synthetic
gucggcggcggcugcgg

SEQ ID NO: 45636 - RNA, 17 nt, Artificial Sequence
  Synthetic
ggcugcggcggcugcgg

SEQ ID NO: 45637 - RNA, 17 nt, Artificial Sequence
  Synthetic
gaggguggaaggcaggg

SEQ ID NO: 45638 - RNA, 17 nt, Artificial Sequence
  Synthetic
gguagccggccggcggg

SEQ ID NO: 45639 - RNA, 17 nt, Artificial Sequence
  Synthetic
gaccggcgcggggcggg

SEQ ID NO: 45640 - RNA, 17 nt, Artificial Sequence
  Synthetic
gcccggcgcaugcgcug

SEQ ID NO: 45641 - RNA, 17 nt, Artificial Sequence
  Synthetic
ggugucggcggcggcug

SEQ ID NO: 45642 - RNA, 17 nt, Artificial Sequence
  Synthetic
ggcggcugcggcggcug

SEQ ID NO: 45643 - RNA, 17 nt, Artificial Sequence
  Synthetic
gggggugguggggguug

SEQ ID NO: 45644 - RNA, 17 nt, Artificial Sequence
  Synthetic
gcagggggguguaggau

SEQ ID NO: 45645 - RNA, 17 nt, Artificial Sequence
  Synthetic
ggccugagaugaacacu

SEQ ID NO: 45646 - RNA, 17 nt, Artificial Sequence
  Synthetic
guuucuuuaacccgucu

SEQ ID NO: 45647 - RNA, 17 nt, Artificial Sequence
  Synthetic
gggcggccaaggggcgu

SEQ ID NO: 45648 - RNA, 17 nt, Artificial Sequence
  Synthetic
gcccggaccgccgcggu

SEQ ID NO: 45649 - RNA, 17 nt, Artificial Sequence
  Synthetic
ggaaggcaggggggugu

SEQ ID NO: 45650 - RNA, 17 nt, Artificial Sequence
  Synthetic
gcgcccggaaauccauu

SEQ ID NO: 45651 - RNA, 17 nt, Artificial Sequence
  Synthetic
gcggccggccggcgcuu

SEQ ID NO: 45652 - RNA, 17 nt, Artificial Sequence
  Synthetic
gcggcggccgccguguu

SEQ ID NO: 45653 - RNA, 20 nt, Artificial Sequence
  Synthetic
gcgggcacgcgcgcccuuaa

SEQ ID NO: 45654 - RNA, 20 nt, Artificial Sequence
  Synthetic
ggccccgggccgggccgcca

SEQ ID NO: 45655 - RNA, 20 nt, Artificial Sequence
  Synthetic
gggccggaggguggaaggca

SEQ ID NO: 45656 - RNA, 20 nt, Artificial Sequence
  Synthetic
ggaacgaaaaacaccccaga

SEQ ID NO: 45657 - RNA, 20 nt, Artificial Sequence
  Synthetic
gggaacgggggauggaagga

SEQ ID NO: 45658 - RNA, 20 nt, Artificial Sequence
  Synthetic
gaaggcagggggguguagga

SEQ ID NO: 45659 - RNA, 20 nt, Artificial Sequence
  Synthetic
gcggggggccggagggugga

SEQ ID NO: 45660 - RNA, 20 nt, Artificial Sequence
  Synthetic
gccccgggccgggccgccac

SEQ ID NO: 45661 - RNA, 20 nt, Artificial Sequence
  Synthetic
gaacgaaaaacaccccagac

SEQ ID NO: 45662 - RNA, 20 nt, Artificial Sequence
  Synthetic
ggaacgggggauggaaggac

SEQ ID NO: 45663 - RNA, 20 nt, Artificial Sequence
  Synthetic
gcccggagagccgcggcacc

SEQ ID NO: 45664 - RNA, 20 nt, Artificial Sequence
  Synthetic
gaguguucaucucaggcccc

SEQ ID NO: 45665 - RNA, 20 nt, Artificial Sequence
  Synthetic
gacccaaggggccccggccc

SEQ ID NO: 45666 - RNA, 20 nt, Artificial Sequence
  Synthetic
ggcggcccggcccggggccc

SEQ ID NO: 45667 - RNA, 20 nt, Artificial Sequence
  Synthetic
gccgggccguuguggggccc

SEQ ID NO: 45668 - RNA, 20 nt, Artificial Sequence
  Synthetic
ggucgggggccccucguccc

SEQ ID NO: 45669 - RNA, 20 nt, Artificial Sequence
  Synthetic
gcagacaggggcaccgcgcc

SEQ ID NO: 45670 - RNA, 20 nt, Artificial Sequence
  Synthetic
ggacccaaggggccccggcc

SEQ ID NO: 45671 - RNA, 20 nt, Artificial Sequence
  Synthetic
gcccccguggcggcccggcc

SEQ ID NO: 45672 - RNA, 20 nt, Artificial Sequence
  Synthetic
ggccggcccccguggcggcc

SEQ ID NO: 45673 - RNA, 20 nt, Artificial Sequence
  Synthetic
guccgccggggccccgggcc

SEQ ID NO: 45674 - RNA, 20 nt, Artificial Sequence
  Synthetic
gccccggcugcaggggggcc

SEQ ID NO: 45675 - RNA, 20 nt, Artificial Sequence
  Synthetic
gggaacccggaaaagccucc

SEQ ID NO: 45676 - RNA, 20 nt, Artificial Sequence
  Synthetic
gguggugcgaaagacuuucc

SEQ ID NO: 45677 - RNA, 20 nt, Artificial Sequence
  Synthetic
ggccccccggaggcuuuucc

SEQ ID NO: 45678 - RNA, 20 nt, Artificial Sequence
  Synthetic
gggcggggggggggugucgc

SEQ ID NO: 45679 - RNA, 20 nt, Artificial Sequence
  Synthetic
ggggccggaggguggaaggc

SEQ ID NO: 45680 - RNA, 20 nt, Artificial Sequence
  Synthetic
guucggucucgguagccggc

SEQ ID NO: 45681 - RNA, 20 nt, Artificial Sequence
  Synthetic
gguccgccggggccccgggc

SEQ ID NO: 45682 - RNA, 20 nt, Artificial Sequence
  Synthetic
gccguuguggggccccgggc

SEQ ID NO: 45683 - RNA, 20 nt, Artificial Sequence
  Synthetic
ggccgggccgccacgggggc

SEQ ID NO: 45684 - RNA, 20 nt, Artificial Sequence
  Synthetic
ggggccugagaugaacacuc

SEQ ID NO: 45685 - RNA, 20 nt, Artificial Sequence
  Synthetic
gcggcgguccgggccccguc

SEQ ID NO: 45686 - RNA, 20 nt, Artificial Sequence
  Synthetic
gggcccggaccgccgcgguc

SEQ ID NO: 45687 - RNA, 20 nt, Artificial Sequence
  Synthetic
ggggauggaaggacgggaag

SEQ ID NO: 45688 - RNA, 20 nt, Artificial Sequence
  Synthetic
guuaagugcucugcagacag

SEQ ID NO: 45689 - RNA, 20 nt, Artificial Sequence
  Synthetic
ggccggaggguggaaggcag

SEQ ID NO: 45690 - RNA, 20 nt, Artificial Sequence
  Synthetic
gcgggccgucugcuggcccg

SEQ ID NO: 45691 - RNA, 20 nt, Artificial Sequence
  Synthetic
ggacggggcccggaccgccg

SEQ ID NO: 45692 - RNA, 20 nt, Artificial Sequence
  Synthetic
ggccggcggguggacucgcg

SEQ ID NO: 45693 - RNA, 20 nt, Artificial Sequence
  Synthetic
gggccugagaugaacacucg

SEQ ID NO: 45694 - RNA, 20 nt, Artificial Sequence
  Synthetic
gccggaggguggaaggcagg

SEQ ID NO: 45695 - RNA, 20 nt, Artificial Sequence
  Synthetic
gcggccggccggcgcuuagg

SEQ ID NO: 45696 - RNA, 20 nt, Artificial Sequence
  Synthetic
ggcccggcccggggccccgg

SEQ ID NO: 45697 - RNA, 20 nt, Artificial Sequence
  Synthetic
gccggcggguggacucgcgg

SEQ ID NO: 45698 - RNA, 20 nt, Artificial Sequence
  Synthetic
ggugucggcggcggcugcgg

SEQ ID NO: 45699 - RNA, 20 nt, Artificial Sequence
  Synthetic
ggcggcugcggcggcugcgg

SEQ ID NO: 45700 - RNA, 20 nt, Artificial Sequence
  Synthetic
gggccccccugcagccgggg

SEQ ID NO: 45701 - RNA, 20 nt, Artificial Sequence
  Synthetic
gccggccggcgcuuaggggg

SEQ ID NO: 45702 - RNA, 20 nt, Artificial Sequence
  Synthetic
ggcggcggcugcggcggcug

SEQ ID NO: 45703 - RNA, 20 nt, Artificial Sequence
  Synthetic
ggccccgggccggggccccu

SEQ ID NO: 45704 - RNA, 20 nt, Artificial Sequence
  Synthetic
gccacauaaacaaugacucu

SEQ ID NO: 45705 - RNA, 20 nt, Artificial Sequence
  Synthetic
ggggcccggaccgccgcggu

SEQ ID NO: 45706 - RNA, 20 nt, Artificial Sequence
  Synthetic
gguggaaggcaggggggugu

SEQ ID NO: 45707 - RNA, 20 nt, Artificial Sequence
  Synthetic
gccccgggccggggccccuu

SEQ ID NO: 45708 - RNA, 17 nt, Artificial Sequence
  Synthetic
ccccaccacccccgaaa

SEQ ID NO: 45709 - RNA, 17 nt, Artificial Sequence
  Synthetic
aagcggcagaggcagaa

SEQ ID NO: 45710 - RNA, 17 nt, Artificial Sequence
  Synthetic
uaagugcucugcagaca

SEQ ID NO: 45711 - RNA, 17 nt, Artificial Sequence
  Synthetic
cccgggccgggccgcca

SEQ ID NO: 45712 - RNA, 17 nt, Artificial Sequence
  Synthetic
ugcagccggggcggcca

SEQ ID NO: 45713 - RNA, 17 nt, Artificial Sequence
  Synthetic
ccggaggguggaaggca

SEQ ID NO: 45714 - RNA, 17 nt, Artificial Sequence
  Synthetic
uggccgccccggcugca

SEQ ID NO: 45715 - RNA, 17 nt, Artificial Sequence
  Synthetic
acgaaaaacaccccaga

SEQ ID NO: 45716 - RNA, 17 nt, Artificial Sequence
  Synthetic
acgaaacauuccggcga

SEQ ID NO: 45717 - RNA, 17 nt, Artificial Sequence
  Synthetic
aacgggggauggaagga

SEQ ID NO: 45718 - RNA, 17 nt, Artificial Sequence
  Synthetic
ccgaggggaacggggga

SEQ ID NO: 45719 - RNA, 17 nt, Artificial Sequence
  Synthetic
cccaccacccccgaaac

SEQ ID NO: 45720 - RNA, 17 nt, Artificial Sequence
  Synthetic
ccgggccgggccgccac

SEQ ID NO: 45721 - RNA, 17 nt, Artificial Sequence
  Synthetic
uucgucuguccccucac

SEQ ID NO: 45722 - RNA, 17 nt, Artificial Sequence
  Synthetic
cgaaaaacaccccagac

SEQ ID NO: 45723 - RNA, 17 nt, Artificial Sequence
  Synthetic
uuaagugcucugcagac

SEQ ID NO: 45724 - RNA, 17 nt, Artificial Sequence
  Synthetic
acgggggauggaaggac

SEQ ID NO: 45725 - RNA, 17 nt, Artificial Sequence
  Synthetic
cggagagccgcggcacc

SEQ ID NO: 45726 - RNA, 17 nt, Artificial Sequence
  Synthetic
uguucaucucaggcccc

SEQ ID NO: 45727 - RNA, 17 nt, Artificial Sequence
  Synthetic
aaggccgcguacggccc

SEQ ID NO: 45728 - RNA, 17 nt, Artificial Sequence
  Synthetic
ccaaggggccccggccc

SEQ ID NO: 45729 - RNA, 17 nt, Artificial Sequence
  Synthetic
ccguggcggcccggccc

SEQ ID NO: 45730 - RNA, 17 nt, Artificial Sequence
  Synthetic
uuccggguucccggccc

SEQ ID NO: 45731 - RNA, 17 nt, Artificial Sequence
  Synthetic
uggguccgccggggccc

SEQ ID NO: 45732 - RNA, 17 nt, Artificial Sequence
  Synthetic
cgggggccccucguccc

SEQ ID NO: 45733 - RNA, 17 nt, Artificial Sequence
  Synthetic
cgggccccccugcagcc

SEQ ID NO: 45734 - RNA, 17 nt, Artificial Sequence
  Synthetic
cggcacccggacgcgcc

SEQ ID NO: 45735 - RNA, 17 nt, Artificial Sequence
  Synthetic
accacagcgcaugcgcc

SEQ ID NO: 45736 - RNA, 17 nt, Artificial Sequence
  Synthetic
cccaaggggccccggcc

SEQ ID NO: 45737 - RNA, 17 nt, Artificial Sequence
  Synthetic
cccguggcggcccggcc

SEQ ID NO: 45738 - RNA, 17 nt, Artificial Sequence
  Synthetic
uuuccggguucccggcc

SEQ ID NO: 45739 - RNA, 17 nt, Artificial Sequence
  Synthetic
cggcccccguggcggcc

SEQ ID NO: 45740 - RNA, 17 nt, Artificial Sequence
  Synthetic
aucucaggccccgggcc

SEQ ID NO: 45741 - RNA, 17 nt, Artificial Sequence
  Synthetic
cgccggggccccgggcc

SEQ ID NO: 45742 - RNA, 17 nt, Artificial Sequence
  Synthetic
uuguggggccccgggcc

SEQ ID NO: 45743 - RNA, 17 nt, Artificial Sequence
  Synthetic
cggguccggacggggcc

SEQ ID NO: 45744 - RNA, 17 nt, Artificial Sequence
  Synthetic
ccggcugcaggggggcc

SEQ ID NO: 45745 - RNA, 17 nt, Artificial Sequence
  Synthetic
cggccuaauggauuucc

SEQ ID NO: 45746 - RNA, 17 nt, Artificial Sequence
  Synthetic
cccccggaggcuuuucc

SEQ ID NO: 45747 - RNA, 17 nt, Artificial Sequence
  Synthetic
ucagccuuuauaaaagc

SEQ ID NO: 45748 - RNA, 17 nt, Artificial Sequence
  Synthetic
ccgggccccccugcagc

SEQ ID NO: 45749 - RNA, 17 nt, Artificial Sequence
  Synthetic
auccucccccuaagcgc

SEQ ID NO: 45750 - RNA, 17 nt, Artificial Sequence
  Synthetic
cggggggggggugucgc

SEQ ID NO: 45751 - RNA, 17 nt, Artificial Sequence
  Synthetic
acagaccagcggccggc

SEQ ID NO: 45752 - RNA, 17 nt, Artificial Sequence
  Synthetic
aaaaacagaccagcggc

SEQ ID NO: 45753 - RNA, 17 nt, Artificial Sequence
  Synthetic
caucucaggccccgggc

SEQ ID NO: 45754 - RNA, 17 nt, Artificial Sequence
  Synthetic
ccgccggggccccgggc

SEQ ID NO: 45755 - RNA, 17 nt, Artificial Sequence
  Synthetic
cgggccgccacgggggc

SEQ ID NO: 45756 - RNA, 17 nt, Artificial Sequence
  Synthetic
cacauaaacaaugacuc

SEQ ID NO: 45757 - RNA, 17 nt, Artificial Sequence
  Synthetic
cccugccuuccacccuc

SEQ ID NO: 45758 - RNA, 17 nt, Artificial Sequence
  Synthetic
ccccgaguguucaucuc

SEQ ID NO: 45759 - RNA, 17 nt, Artificial Sequence
  Synthetic
cgggugccgcggcucuc

SEQ ID NO: 45760 - RNA, 17 nt, Artificial Sequence
  Synthetic
uguuucuuuaacccguc

SEQ ID NO: 45761 - RNA, 17 nt, Artificial Sequence
  Synthetic
agacgaacgaaacauuc

SEQ ID NO: 45762 - RNA, 17 nt, Artificial Sequence
  Synthetic
uucguuuuccccguuuc

SEQ ID NO: 45763 - RNA, 17 nt, Artificial Sequence
  Synthetic
cucagccuuuauaaaag

SEQ ID NO: 45764 - RNA, 17 nt, Artificial Sequence
  Synthetic
cagccggggcggccaag

SEQ ID NO: 45765 - RNA, 17 nt, Artificial Sequence
  Synthetic
aagugcucugcagacag

SEQ ID NO: 45766 - RNA, 17 nt, Artificial Sequence
  Synthetic
acgaaaaaacagaccag

SEQ ID NO: 45767 - RNA, 17 nt, Artificial Sequence
  Synthetic
cggaggguggaaggcag

SEQ ID NO: 45768 - RNA, 17 nt, Artificial Sequence
  Synthetic
caggccacagcaccacg

SEQ ID NO: 45769 - RNA, 17 nt, Artificial Sequence
  Synthetic
cgggccgggccgccacg

SEQ ID NO: 45770 - RNA, 17 nt, Artificial Sequence
  Synthetic
ucgucuguccccucacg

SEQ ID NO: 45771 - RNA, 17 nt, Artificial Sequence
  Synthetic
ccauuaggccgcagacg

SEQ ID NO: 45772 - RNA, 17 nt, Artificial Sequence
  Synthetic
caaggggccccggcccg

SEQ ID NO: 45773 - RNA, 17 nt, Artificial Sequence
  Synthetic
cguggcggcccggcccg

SEQ ID NO: 45774 - RNA, 17 nt, Artificial Sequence
  Synthetic
uccggguucccggcccg

SEQ ID NO: 45775 - RNA, 17 nt, Artificial Sequence
  Synthetic
cggggcccggaccgccg

SEQ ID NO: 45776 - RNA, 17 nt, Artificial Sequence
  Synthetic
uguggggccccgggccg

SEQ ID NO: 45777 - RNA, 17 nt, Artificial Sequence
  Synthetic
cauuguuuauguggccg

SEQ ID NO: 45778 - RNA, 17 nt, Artificial Sequence
  Synthetic
acccggaaaagccuccg

SEQ ID NO: 45779 - RNA, 17 nt, Artificial Sequence
  Synthetic
cagccuuuauaaaagcg

SEQ ID NO: 45780 - RNA, 17 nt, Artificial Sequence
  Synthetic
uggaccggcgcggggcg

SEQ ID NO: 45781 - RNA, 17 nt, Artificial Sequence
  Synthetic
uuauaaaagcgggggcg

SEQ ID NO: 45782 - RNA, 17 nt, Artificial Sequence
  Synthetic
ccugagaugaacacucg

SEQ ID NO: 45783 - RNA, 17 nt, Artificial Sequence
  Synthetic
acaaccgaggggaacgg

SEQ ID NO: 45784 - RNA, 17 nt, Artificial Sequence
  Synthetic
ccggcccggggccccgg

SEQ ID NO: 45785 - RNA, 17 nt, Artificial Sequence
  Synthetic
ccgccccggcugcaggg

SEQ ID NO: 45786 - RNA, 17 nt, Artificial Sequence
  Synthetic
cgcggggggccggaggg

SEQ ID NO: 45787 - RNA, 17 nt, Artificial Sequence
  Synthetic
ccccccugcagccgggg

SEQ ID NO: 45788 - RNA, 17 nt, Artificial Sequence
  Synthetic
aauggaccggcgcgggg

SEQ ID NO: 45789 - RNA, 17 nt, Artificial Sequence
  Synthetic
acccacacgggcggggg

SEQ ID NO: 45790 - RNA, 17 nt, Artificial Sequence
  Synthetic
cccacacgggcgggggg

SEQ ID NO: 45791 - RNA, 17 nt, Artificial Sequence
  Synthetic
ccacacgggcggggggg

SEQ ID NO: 45792 - RNA, 17 nt, Artificial Sequence
  Synthetic
acggccggcccccgugg

SEQ ID NO: 45793 - RNA, 17 nt, Artificial Sequence
  Synthetic
ccccguuucgggggugg

SEQ ID NO: 45794 - RNA, 17 nt, Artificial Sequence
  Synthetic
cguuucggggguggugg

SEQ ID NO: 45795 - RNA, 17 nt, Artificial Sequence
  Synthetic
cagagucauuguuuaug

SEQ ID NO: 45796 - RNA, 17 nt, Artificial Sequence
  Synthetic
cuacccacguggugcug

SEQ ID NO: 45797 - RNA, 17 nt, Artificial Sequence
  Synthetic
ugcgcgcgccggcucug

SEQ ID NO: 45798 - RNA, 17 nt, Artificial Sequence
  Synthetic
uuucuuuaacccgucug

SEQ ID NO: 45799 - RNA, 17 nt, Artificial Sequence
  Synthetic
uuuauuuuccucgucug

SEQ ID NO: 45800 - RNA, 17 nt, Artificial Sequence
  Synthetic
ccccccccccgcccgug

SEQ ID NO: 45801 - RNA, 17 nt, Artificial Sequence
  Synthetic
cccgggccggggccccu

SEQ ID NO: 45802 - RNA, 17 nt, Artificial Sequence
  Synthetic
ccaucccccguuccccu

SEQ ID NO: 45803 - RNA, 17 nt, Artificial Sequence
  Synthetic
acauaaacaaugacucu

SEQ ID NO: 45804 - RNA, 17 nt, Artificial Sequence
  Synthetic
aggccacagcaccacgu

SEQ ID NO: 45805 - RNA, 17 nt, Artificial Sequence
  Synthetic
ccacgggggccggccgu

SEQ ID NO: 45806 - RNA, 17 nt, Artificial Sequence
  Synthetic
cacagcaccacgugggu

SEQ ID NO: 45807 - RNA, 17 nt, Artificial Sequence
  Synthetic
cccguuucggggguggu

SEQ ID NO: 45808 - RNA, 17 nt, Artificial Sequence
  Synthetic
cccccccccgcccgugu

SEQ ID NO: 45809 - RNA, 17 nt, Artificial Sequence
  Synthetic
ccgggccggggccccuu

SEQ ID NO: 45810 - RNA, 17 nt, Artificial Sequence
  Synthetic
uuucguuuuccccguuu

SEQ ID NO: 45811 - RNA, 20 nt, Artificial Sequence
  Synthetic
aacccccaccacccccgaaa

SEQ ID NO: 45812 - RNA, 20 nt, Artificial Sequence
  Synthetic
cggggccccggcggacccaa

SEQ ID NO: 45813 - RNA, 20 nt, Artificial Sequence
  Synthetic
ccugcagccggggcggccaa

SEQ ID NO: 45814 - RNA, 20 nt, Artificial Sequence
  Synthetic
cacaagcggcagaggcagaa

SEQ ID NO: 45815 - RNA, 20 nt, Artificial Sequence
  Synthetic
cgaggaacaaccgaggggaa

SEQ ID NO: 45816 - RNA, 20 nt, Artificial Sequence
  Synthetic
ccugucugcagagcacuuaa

SEQ ID NO: 45817 - RNA, 20 nt, Artificial Sequence
  Synthetic
ccggggccccggcggaccca

SEQ ID NO: 45818 - RNA, 20 nt, Artificial Sequence
  Synthetic
cccugcagccggggcggcca

SEQ ID NO: 45819 - RNA, 20 nt, Artificial Sequence
  Synthetic
ccuuggccgccccggcugca

SEQ ID NO: 45820 - RNA, 20 nt, Artificial Sequence
  Synthetic
uucguucgucuguccccuca

SEQ ID NO: 45821 - RNA, 20 nt, Artificial Sequence
  Synthetic
caaccgaggggaacggggga

SEQ ID NO: 45822 - RNA, 20 nt, Artificial Sequence
  Synthetic
cgaggggaacgggggaugga

SEQ ID NO: 45823 - RNA, 20 nt, Artificial Sequence
  Synthetic
cagcggccggccggcgcuua

SEQ ID NO: 45824 - RNA, 20 nt, Artificial Sequence
  Synthetic
acccccaccacccccgaaac

SEQ ID NO: 45825 - RNA, 20 nt, Artificial Sequence
  Synthetic
caggccccgggccgggaacc

SEQ ID NO: 45826 - RNA, 20 nt, Artificial Sequence
  Synthetic
cuuggguccgccggggcccc

SEQ ID NO: 45827 - RNA, 20 nt, Artificial Sequence
  Synthetic
ccgacgccccuuggccgccc

SEQ ID NO: 45828 - RNA, 20 nt, Artificial Sequence
  Synthetic
cccccguggcggcccggccc

SEQ ID NO: 45829 - RNA, 20 nt, Artificial Sequence
  Synthetic
ccggcggacccaaggggccc

SEQ ID NO: 45830 - RNA, 20 nt, Artificial Sequence
  Synthetic
ccuuggguccgccggggccc

SEQ ID NO: 45831 - RNA, 20 nt, Artificial Sequence
  Synthetic
cuccgggccccccugcagcc

SEQ ID NO: 45832 - RNA, 20 nt, Artificial Sequence
  Synthetic
cggggccccuuggguccgcc

SEQ ID NO: 45833 - RNA, 20 nt, Artificial Sequence
  Synthetic
ccgcggcacccggacgcgcc

SEQ ID NO: 45834 - RNA, 20 nt, Artificial Sequence
  Synthetic
cccggggccccacaacggcc

SEQ ID NO: 45835 - RNA, 20 nt, Artificial Sequence
  Synthetic
uucaucucaggccccgggcc

SEQ ID NO: 45836 - RNA, 20 nt, Artificial Sequence
  Synthetic
cggucgggggccccucgucc

SEQ ID NO: 45837 - RNA, 20 nt, Artificial Sequence
  Synthetic
aucucagccuuuauaaaagc

SEQ ID NO: 45838 - RNA, 20 nt, Artificial Sequence
  Synthetic
ucuccgggccccccugcagc

SEQ ID NO: 45839 - RNA, 20 nt, Artificial Sequence
  Synthetic
cgcgucgcgugccggcgagc

SEQ ID NO: 45840 - RNA, 20 nt, Artificial Sequence
  Synthetic
ccccccgcgaguccacccgc

SEQ ID NO: 45841 - RNA, 20 nt, Artificial Sequence
  Synthetic
uccggccccccgccccgcgc

SEQ ID NO: 45842 - RNA, 20 nt, Artificial Sequence
  Synthetic
cggccggcggguggacucgc

SEQ ID NO: 45843 - RNA, 20 nt, Artificial Sequence
  Synthetic
ccccguccggacccgcucgc

SEQ ID NO: 45844 - RNA, 20 nt, Artificial Sequence
  Synthetic
uccucccccuaagcgccggc

SEQ ID NO: 45845 - RNA, 20 nt, Artificial Sequence
  Synthetic
uuaauggaccggcgcggggc

SEQ ID NO: 45846 - RNA, 20 nt, Artificial Sequence
  Synthetic
cggguggacucgcggggggc

SEQ ID NO: 45847 - RNA, 20 nt, Artificial Sequence
  Synthetic
accggcgcggggcggggggc

SEQ ID NO: 45848 - RNA, 20 nt, Artificial Sequence
  Synthetic
cccuuggccgccccggcugc

SEQ ID NO: 45849 - RNA, 20 nt, Artificial Sequence
  Synthetic
ccccccugccuuccacccuc

SEQ ID NO: 45850 - RNA, 20 nt, Artificial Sequence
  Synthetic
uucuguuucuuuaacccguc

SEQ ID NO: 45851 - RNA, 20 nt, Artificial Sequence
  Synthetic
cgcgugccggcgagcggguc

SEQ ID NO: 45852 - RNA, 20 nt, Artificial Sequence
  Synthetic
ucugcggccuaauggauuuc

SEQ ID NO: 45853 - RNA, 20 nt, Artificial Sequence
  Synthetic
caucucagccuuuauaaaag

SEQ ID NO: 45854 - RNA, 20 nt, Artificial Sequence
  Synthetic
ccggcgcgcgcacucacaag

SEQ ID NO: 45855 - RNA, 20 nt, Artificial Sequence
  Synthetic
cugcagccggggcggccaag

SEQ ID NO: 45856 - RNA, 20 nt, Artificial Sequence
  Synthetic
aaaacgaaaaaacagaccag

SEQ ID NO: 45857 - RNA, 20 nt, Artificial Sequence
  Synthetic
cuuggccgccccggcugcag

SEQ ID NO: 45858 - RNA, 20 nt, Artificial Sequence
  Synthetic
agcggccggccggcgcuuag

SEQ ID NO: 45859 - RNA, 20 nt, Artificial Sequence
  Synthetic
cccccaccacccccgaaacg

SEQ ID NO: 45860 - RNA, 20 nt, Artificial Sequence
  Synthetic
aggaacaaccgaggggaacg

SEQ ID NO: 45861 - RNA, 20 nt, Artificial Sequence
  Synthetic
ccccgggccgggccgccacg

SEQ ID NO: 45862 - RNA, 20 nt, Artificial Sequence
  Synthetic
ccgccaacggccggcccccg

SEQ ID NO: 45863 - RNA, 20 nt, Artificial Sequence
  Synthetic
acccaaggggccccggcccg

SEQ ID NO: 45864 - RNA, 20 nt, Artificial Sequence
  Synthetic
ccccguggcggcccggcccg

SEQ ID NO: 45865 - RNA, 20 nt, Artificial Sequence
  Synthetic
uccgggccccccugcagccg

SEQ ID NO: 45866 - RNA, 20 nt, Artificial Sequence
  Synthetic
caggggggcccggagagccg

SEQ ID NO: 45867 - RNA, 20 nt, Artificial Sequence
  Synthetic
agucauuguuuauguggccg

SEQ ID NO: 45868 - RNA, 20 nt, Artificial Sequence
  Synthetic
ccgggcgcguccgggugccg

SEQ ID NO: 45869 - RNA, 20 nt, Artificial Sequence
  Synthetic
ucucagccuuuauaaaagcg

SEQ ID NO: 45870 - RNA, 20 nt, Artificial Sequence
  Synthetic
cuuaacggauugauaucucg

SEQ ID NO: 45871 - RNA, 20 nt, Artificial Sequence
  Synthetic
cgggcggggggggggugucg

SEQ ID NO: 45872 - RNA, 20 nt, Artificial Sequence
  Synthetic
cccgggccgggccgccacgg

SEQ ID NO: 45873 - RNA, 20 nt, Artificial Sequence
  Synthetic
cgaggggcccccgaccgcgg

SEQ ID NO: 45874 - RNA, 20 nt, Artificial Sequence
  Synthetic
cggcucugcggugucggcgg

SEQ ID NO: 45875 - RNA, 20 nt, Artificial Sequence
  Synthetic
aauggaccggcgcggggcgg

SEQ ID NO: 45876 - RNA, 20 nt, Artificial Sequence
  Synthetic
ccggaggguggaaggcaggg

SEQ ID NO: 45877 - RNA, 20 nt, Artificial Sequence
  Synthetic
uggccgccccggcugcaggg

SEQ ID NO: 45878 - RNA, 20 nt, Artificial Sequence
  Synthetic
acucgcggggggccggaggg

SEQ ID NO: 45879 - RNA, 20 nt, Artificial Sequence
  Synthetic
ccggcggguggacucgcggg

SEQ ID NO: 45880 - RNA, 20 nt, Artificial Sequence
  Synthetic
auggaccggcgcggggcggg

SEQ ID NO: 45881 - RNA, 20 nt, Artificial Sequence
  Synthetic
cuuaauggaccggcgcgggg

SEQ ID NO: 45882 - RNA, 20 nt, Artificial Sequence
  Synthetic
uacccacacgggcggggggg

SEQ ID NO: 45883 - RNA, 20 nt, Artificial Sequence
  Synthetic
acggcccggcgcaugcgcug

SEQ ID NO: 45884 - RNA, 20 nt, Artificial Sequence
  Synthetic
ugcggugucggcggcggcug

SEQ ID NO: 45885 - RNA, 20 nt, Artificial Sequence
  Synthetic
caccuacccacguggugcug

SEQ ID NO: 45886 - RNA, 20 nt, Artificial Sequence
  Synthetic
cuguuucuuuaacccgucug

SEQ ID NO: 45887 - RNA, 20 nt, Artificial Sequence
  Synthetic
aauuuuauuuuccucgucug

SEQ ID NO: 45888 - RNA, 20 nt, Artificial Sequence
  Synthetic
acaccccccccccgcccgug

SEQ ID NO: 45889 - RNA, 20 nt, Artificial Sequence
  Synthetic
uucgggggugguggggguug

SEQ ID NO: 45890 - RNA, 20 nt, Artificial Sequence
  Synthetic
aaggcagggggguguaggau

SEQ ID NO: 45891 - RNA, 20 nt, Artificial Sequence
  Synthetic
cggggccugagaugaacacu

SEQ ID NO: 45892 - RNA, 20 nt, Artificial Sequence
  Synthetic
cuuccaucccccguuccccu

SEQ ID NO: 45893 - RNA, 20 nt, Artificial Sequence
  Synthetic
ucuguuucuuuaacccgucu

SEQ ID NO: 45894 - RNA, 20 nt, Artificial Sequence
  Synthetic
aacaggccacagcaccacgu

SEQ ID NO: 45895 - RNA, 20 nt, Artificial Sequence
  Synthetic
uuccccguuucggggguggu

SEQ ID NO: 45896 - RNA, 20 nt, Artificial Sequence
  Synthetic
caccccccccccgcccgugu

SEQ ID NO: 45897 - RNA, 20 nt, Artificial Sequence
  Synthetic
uuuuuucguuuuccccguuu

SEQ ID NO: 45898 - RNA, 17 nt, Artificial Sequence
  Synthetic
aacaauaacaaccccaa

SEQ ID NO: 45899 - RNA, 17 nt, Artificial Sequence
  Synthetic
ggagggggggaaaagaa

SEQ ID NO: 45900 - RNA, 17 nt, Artificial Sequence
  Synthetic
guacugggggugaagaa

SEQ ID NO: 45901 - RNA, 17 nt, Artificial Sequence
  Synthetic
agaacagacacgcagaa

SEQ ID NO: 45902 - RNA, 17 nt, Artificial Sequence
  Synthetic
agaagcgagaacaggaa

SEQ ID NO: 45903 - RNA, 17 nt, Artificial Sequence
  Synthetic
ggauaacgggggaggaa

SEQ ID NO: 45904 - RNA, 17 nt, Artificial Sequence
  Synthetic
uaacggcccccggggaa

SEQ ID NO: 45905 - RNA, 17 nt, Artificial Sequence
  Synthetic
cggggcgcuggagauaa

SEQ ID NO: 45906 - RNA, 17 nt, Artificial Sequence
  Synthetic
agccggcccuuagauaa

SEQ ID NO: 45907 - RNA, 17 nt, Artificial Sequence
  Synthetic
cucgacgagugggauaa

SEQ ID NO: 45908 - RNA, 17 nt, Artificial Sequence
  Synthetic
uaacagagucugacuaa

SEQ ID NO: 45909 - RNA, 17 nt, Artificial Sequence
  Synthetic
acugcccccuuaucuaa

SEQ ID NO: 45910 - RNA, 17 nt, Artificial Sequence
  Synthetic
gggggacccaaacgaca

SEQ ID NO: 45911 - RNA, 17 nt, Artificial Sequence
  Synthetic
cggcuggaagaccgcca

SEQ ID NO: 45912 - RNA, 17 nt, Artificial Sequence
  Synthetic
cgggggucgccggggca

SEQ ID NO: 45913 - RNA, 17 nt, Artificial Sequence
  Synthetic
acccacguacuccaaga

SEQ ID NO: 45914 - RNA, 17 nt, Artificial Sequence
  Synthetic
gguacugggggugaaga

SEQ ID NO: 45915 - RNA, 17 nt, Artificial Sequence
  Synthetic
guggggugggugggaga

SEQ ID NO: 45916 - RNA, 17 nt, Artificial Sequence
  Synthetic
ugcuucuccccaauaga

SEQ ID NO: 45917 - RNA, 17 nt, Artificial Sequence
  Synthetic
aacacaaacacccgcga

SEQ ID NO: 45918 - RNA, 17 nt, Artificial Sequence
  Synthetic
gagaacaggaaaggcga

SEQ ID NO: 45919 - RNA, 17 nt, Artificial Sequence
  Synthetic
guuaucccacucgucga

SEQ ID NO: 45920 - RNA, 17 nt, Artificial Sequence
  Synthetic
gaggaagggagggagga

SEQ ID NO: 45921 - RNA, 17 nt, Artificial Sequence
  Synthetic
gggauaacgggggagga

SEQ ID NO: 45922 - RNA, 17 nt, Artificial Sequence
  Synthetic
gggacggaggggacgga

SEQ ID NO: 45923 - RNA, 17 nt, Artificial Sequence
  Synthetic
cgcgacggggggacgga

SEQ ID NO: 45924 - RNA, 17 nt, Artificial Sequence
  Synthetic
gggggcggcgcgccgga

SEQ ID NO: 45925 - RNA, 17 nt, Artificial Sequence
  Synthetic
ggcaguugguggucgga

SEQ ID NO: 45926 - RNA, 17 nt, Artificial Sequence
  Synthetic
aacgggggaggaaggga

SEQ ID NO: 45927 - RNA, 17 nt, Artificial Sequence
  Synthetic
cggaggggacggaggga

SEQ ID NO: 45928 - RNA, 17 nt, Artificial Sequence
  Synthetic
gggucccgggggcggga

SEQ ID NO: 45929 - RNA, 17 nt, Artificial Sequence
  Synthetic
cggggggacggagggga

SEQ ID NO: 45930 - RNA, 17 nt, Artificial Sequence
  Synthetic
gagggggugacggggga

SEQ ID NO: 45931 - RNA, 17 nt, Artificial Sequence
  Synthetic
cacccgcgacgggggga

SEQ ID NO: 45932 - RNA, 17 nt, Artificial Sequence
  Synthetic
ucugacuaaggguggga

SEQ ID NO: 45933 - RNA, 17 nt, Artificial Sequence
  Synthetic
acggagggaggggguga

SEQ ID NO: 45934 - RNA, 17 nt, Artificial Sequence
  Synthetic
cagccggcccuuagaua

SEQ ID NO: 45935 - RNA, 17 nt, Artificial Sequence
  Synthetic
guaacagagucugacua

SEQ ID NO: 45936 - RNA, 17 nt, Artificial Sequence
  Synthetic
gggcgccccagaggcua

SEQ ID NO: 45937 - RNA, 17 nt, Artificial Sequence
  Synthetic
aacugcccccuuaucua

SEQ ID NO: 45938 - RNA, 17 nt, Artificial Sequence
  Synthetic
gagggggggaaaagaac

SEQ ID NO: 45939 - RNA, 17 nt, Artificial Sequence
  Synthetic
gggggagaagcgagaac

SEQ ID NO: 45940 - RNA, 17 nt, Artificial Sequence
  Synthetic
aacggcccccggggaac

SEQ ID NO: 45941 - RNA, 17 nt, Artificial Sequence
  Synthetic
ucgacgagugggauaac

SEQ ID NO: 45942 - RNA, 17 nt, Artificial Sequence
  Synthetic
gccaggcacaaaaacac

SEQ ID NO: 45943 - RNA, 17 nt, Artificial Sequence
  Synthetic
ucuuuguugaacgacac

SEQ ID NO: 45944 - RNA, 17 nt, Artificial Sequence
  Synthetic
ggggguuacagcgacac

SEQ ID NO: 45945 - RNA, 17 nt, Artificial Sequence
  Synthetic
ggagaaggcgaggagac

SEQ ID NO: 45946 - RNA, 17 nt, Artificial Sequence
  Synthetic
ggggggacccaaacgac

SEQ ID NO: 45947 - RNA, 17 nt, Artificial Sequence
  Synthetic
acacaaacacccgcgac

SEQ ID NO: 45948 - RNA, 17 nt, Artificial Sequence
  Synthetic
ggugcucgucgaucgac

SEQ ID NO: 45949 - RNA, 17 nt, Artificial Sequence
  Synthetic
ggggcggcgcgccggac

SEQ ID NO: 45950 - RNA, 17 nt, Artificial Sequence
  Synthetic
gcaguugguggucggac

SEQ ID NO: 45951 - RNA, 17 nt, Artificial Sequence
  Synthetic
cccggggaacgggggac

SEQ ID NO: 45952 - RNA, 17 nt, Artificial Sequence
  Synthetic
agggggugacgggggac

SEQ ID NO: 45953 - RNA, 17 nt, Artificial Sequence
  Synthetic
cggagggagggggugac

SEQ ID NO: 45954 - RNA, 17 nt, Artificial Sequence
  Synthetic
gggagggaggaggguac

SEQ ID NO: 45955 - RNA, 17 nt, Artificial Sequence
  Synthetic
cuuuguugaacgacacc

SEQ ID NO: 45956 - RNA, 17 nt, Artificial Sequence
  Synthetic
gugcucgucgaucgacc

SEQ ID NO: 45957 - RNA, 17 nt, Artificial Sequence
  Synthetic
ccggggaacgggggacc

SEQ ID NO: 45958 - RNA, 17 nt, Artificial Sequence
  Synthetic
caggugucuaaccuacc

SEQ ID NO: 45959 - RNA, 17 nt, Artificial Sequence
  Synthetic
ccugccccggcgacccc

SEQ ID NO: 45960 - RNA, 17 nt, Artificial Sequence
  Synthetic
gacaccggccgaccccc

SEQ ID NO: 45961 - RNA, 17 nt, Artificial Sequence
  Synthetic
aaccccaucccgccccc

SEQ ID NO: 45962 - RNA, 17 nt, Artificial Sequence
  Synthetic
uggagauaacggccccc

SEQ ID NO: 45963 - RNA, 17 nt, Artificial Sequence
  Synthetic
aaaccccaucccgcccc

SEQ ID NO: 45964 - RNA, 17 nt, Artificial Sequence
  Synthetic
cuggagauaacggcccc

SEQ ID NO: 45965 - RNA, 17 nt, Artificial Sequence
  Synthetic
ccggucccccguucccc

SEQ ID NO: 45966 - RNA, 17 nt, Artificial Sequence
  Synthetic
cucgggauacccagccc

SEQ ID NO: 45967 - RNA, 17 nt, Artificial Sequence
  Synthetic
acucgucgagggcgccc

SEQ ID NO: 45968 - RNA, 17 nt, Artificial Sequence
  Synthetic
cgcccccgccccugccc

SEQ ID NO: 45969 - RNA, 17 nt, Artificial Sequence
  Synthetic
cuuauaugugggguccc

SEQ ID NO: 45970 - RNA, 17 nt, Artificial Sequence
  Synthetic
cccggucccccguuccc

SEQ ID NO: 45971 - RNA, 17 nt, Artificial Sequence
  Synthetic
cccaagcauagagagcc

SEQ ID NO: 45972 - RNA, 17 nt, Artificial Sequence
  Synthetic
ggaaaggcgauggagcc

SEQ ID NO: 45973 - RNA, 17 nt, Artificial Sequence
  Synthetic
cacgcccccacugagcc

SEQ ID NO: 45974 - RNA, 17 nt, Artificial Sequence
  Synthetic
ccggcuggaagaccgcc

SEQ ID NO: 45975 - RNA, 17 nt, Artificial Sequence
  Synthetic
gcgggccgggggucgcc

SEQ ID NO: 45976 - RNA, 17 nt, Artificial Sequence
  Synthetic
gcggcgguggccgggcc

SEQ ID NO: 45977 - RNA, 17 nt, Artificial Sequence
  Synthetic
ucgggaucgugcgggcc

SEQ ID NO: 45978 - RNA, 17 nt, Artificial Sequence
  Synthetic
ggugggcggcgguggcc

SEQ ID NO: 45979 - RNA, 17 nt, Artificial Sequence
  Synthetic
gcuugggucuuacugcc

SEQ ID NO: 45980 - RNA, 17 nt, Artificial Sequence
  Synthetic
uuccucgguguucugcc

SEQ ID NO: 45981 - RNA, 17 nt, Artificial Sequence
  Synthetic
gccuguguuuuugugcc

SEQ ID NO: 45982 - RNA, 17 nt, Artificial Sequence
  Synthetic
gcuuauauguggggucc

SEQ ID NO: 45983 - RNA, 17 nt, Artificial Sequence
  Synthetic
aaagacgccgcguuucc

SEQ ID NO: 45984 - RNA, 17 nt, Artificial Sequence
  Synthetic
cucuauuggggagaagc

SEQ ID NO: 45985 - RNA, 17 nt, Artificial Sequence
  Synthetic
ccuggcggucuuccagc

SEQ ID NO: 45986 - RNA, 17 nt, Artificial Sequence
  Synthetic
ggcggggggcggcgcgc

SEQ ID NO: 45987 - RNA, 17 nt, Artificial Sequence
  Synthetic
cgcgccggacggggcgc

SEQ ID NO: 45988 - RNA, 17 nt, Artificial Sequence
  Synthetic
ucggccacgccacucgc

SEQ ID NO: 45989 - RNA, 17 nt, Artificial Sequence
  Synthetic
cuccguccccccgucgc

SEQ ID NO: 45990 - RNA, 17 nt, Artificial Sequence
  Synthetic
ugcgggccgggggucgc

SEQ ID NO: 45991 - RNA, 17 nt, Artificial Sequence
  Synthetic
ggcacaaaaacacaggc

SEQ ID NO: 45992 - RNA, 17 nt, Artificial Sequence
  Synthetic
cuuaucuaagggccggc

SEQ ID NO: 45993 - RNA, 17 nt, Artificial Sequence
  Synthetic
ccccaacggaaagcggc

SEQ ID NO: 45994 - RNA, 17 nt, Artificial Sequence
  Synthetic
ggaugggguuuagcggc

SEQ ID NO: 45995 - RNA, 17 nt, Artificial Sequence
  Synthetic
accgccagggggucggc

SEQ ID NO: 45996 - RNA, 17 nt, Artificial Sequence
  Synthetic
cccccuuaucuaagggc

SEQ ID NO: 45997 - RNA, 17 nt, Artificial Sequence
  Synthetic
gggggaaaagaacgggc

SEQ ID NO: 45998 - RNA, 17 nt, Artificial Sequence
  Synthetic
cgguggccgggccgggc

SEQ ID NO: 45999 - RNA, 17 nt, Artificial Sequence
  Synthetic
ggcggcgguggccgggc

SEQ ID NO: 46000 - RNA, 17 nt, Artificial Sequence
  Synthetic
gucgggaucgugcgggc

SEQ ID NO: 46001 - RNA, 17 nt, Artificial Sequence
  Synthetic
gucgccggggcaggggc

SEQ ID NO: 46002 - RNA, 17 nt, Artificial Sequence
  Synthetic
gaacgggggaccggggc

SEQ ID NO: 46003 - RNA, 17 nt, Artificial Sequence
  Synthetic
ccgggggucgccggggc

SEQ ID NO: 46004 - RNA, 17 nt, Artificial Sequence
  Synthetic
uguggggucccgggggc

SEQ ID NO: 46005 - RNA, 17 nt, Artificial Sequence
  Synthetic
ggggcgggggcgugggc

SEQ ID NO: 46006 - RNA, 17 nt, Artificial Sequence
  Synthetic
gggugggcggcgguggc

SEQ ID NO: 46007 - RNA, 17 nt, Artificial Sequence
  Synthetic
cuguucuugcguguggc

SEQ ID NO: 46008 - RNA, 17 nt, Artificial Sequence
  Synthetic
uuuccucgguguucugc

SEQ ID NO: 46009 - RNA, 17 nt, Artificial Sequence
  Synthetic
uguugucgggaucgugc

SEQ ID NO: 46010 - RNA, 17 nt, Artificial Sequence
  Synthetic
gcccacccacccaccuc

SEQ ID NO: 46011 - RNA, 17 nt, Artificial Sequence
  Synthetic
uggccgaccuuagccuc

SEQ ID NO: 46012 - RNA, 17 nt, Artificial Sequence
  Synthetic
aucuccagcgccccguc

SEQ ID NO: 46013 - RNA, 17 nt, Artificial Sequence
  Synthetic
ggguuguuauuguuguc

SEQ ID NO: 46014 - RNA, 17 nt, Artificial Sequence
  Synthetic
acaaccccaacggaaag

SEQ ID NO: 46015 - RNA, 17 nt, Artificial Sequence
  Synthetic
uacugggggugaagaag

SEQ ID NO: 46016 - RNA, 17 nt, Artificial Sequence
  Synthetic
gccggcccuuagauaag

SEQ ID NO: 46017 - RNA, 17 nt, Artificial Sequence
  Synthetic
ggggacccaaacgacag

SEQ ID NO: 46018 - RNA, 17 nt, Artificial Sequence
  Synthetic
gacagggggcgccccag

SEQ ID NO: 46019 - RNA, 17 nt, Artificial Sequence
  Synthetic
ggcuggaagaccgccag

SEQ ID NO: 46020 - RNA, 17 nt, Artificial Sequence
  Synthetic
gggggucgccggggcag

SEQ ID NO: 46021 - RNA, 17 nt, Artificial Sequence
  Synthetic
cgaucgaccgggcucag

SEQ ID NO: 46022 - RNA, 17 nt, Artificial Sequence
  Synthetic
gcuucuccccaauagag

SEQ ID NO: 46023 - RNA, 17 nt, Artificial Sequence
  Synthetic
ggggcgcccucgacgag

SEQ ID NO: 46024 - RNA, 17 nt, Artificial Sequence
  Synthetic
acgagcccacccgcgag

SEQ ID NO: 46025 - RNA, 17 nt, Artificial Sequence
  Synthetic
gcgacggggggacggag

SEQ ID NO: 46026 - RNA, 17 nt, Artificial Sequence
  Synthetic
ggaggggacggagggag

SEQ ID NO: 46027 - RNA, 17 nt, Artificial Sequence
  Synthetic
cugacuaagggugggag

SEQ ID NO: 46028 - RNA, 17 nt, Artificial Sequence
  Synthetic
cugcuucuccccaauag

SEQ ID NO: 46029 - RNA, 17 nt, Artificial Sequence
  Synthetic
ggcgggaugggguuuag

SEQ ID NO: 46030 - RNA, 17 nt, Artificial Sequence
  Synthetic
uaaccuaccuggaaacg

SEQ ID NO: 46031 - RNA, 17 nt, Artificial Sequence
  Synthetic
acggcccccggggaacg

SEQ ID NO: 46032 - RNA, 17 nt, Artificial Sequence
  Synthetic
cgacgagugggauaacg

SEQ ID NO: 46033 - RNA, 17 nt, Artificial Sequence
  Synthetic
cacaaacacccgcgacg

SEQ ID NO: 46034 - RNA, 17 nt, Artificial Sequence
  Synthetic
gggcggcgcgccggacg

SEQ ID NO: 46035 - RNA, 17 nt, Artificial Sequence
  Synthetic
ggagggagggggugacg

SEQ ID NO: 46036 - RNA, 17 nt, Artificial Sequence
  Synthetic
ugccuucuuggaguacg

SEQ ID NO: 46037 - RNA, 17 nt, Artificial Sequence
  Synthetic
agcccggcagaacaccg

SEQ ID NO: 46038 - RNA, 17 nt, Artificial Sequence
  Synthetic
uuuguugaacgacaccg

SEQ ID NO: 46039 - RNA, 17 nt, Artificial Sequence
  Synthetic
cggggaacgggggaccg

SEQ ID NO: 46040 - RNA, 17 nt, Artificial Sequence
  Synthetic
ggagauaacggcccccg

SEQ ID NO: 46041 - RNA, 17 nt, Artificial Sequence
  Synthetic
cggucccccguuccccg

SEQ ID NO: 46042 - RNA, 17 nt, Artificial Sequence
  Synthetic
cggggcuggguaucccg

SEQ ID NO: 46043 - RNA, 17 nt, Artificial Sequence
  Synthetic
uuauauguggggucccg

SEQ ID NO: 46044 - RNA, 17 nt, Artificial Sequence
  Synthetic
cgggccgggggucgccg

SEQ ID NO: 46045 - RNA, 17 nt, Artificial Sequence
  Synthetic
cgggaucgugcgggccg

SEQ ID NO: 46046 - RNA, 17 nt, Artificial Sequence
  Synthetic
gugggugggagaaggcg

SEQ ID NO: 46047 - RNA, 17 nt, Artificial Sequence
  Synthetic
gcacaaaaacacaggcg

SEQ ID NO: 46048 - RNA, 17 nt, Artificial Sequence
  Synthetic
cccaacggaaagcggcg

SEQ ID NO: 46049 - RNA, 17 nt, Artificial Sequence
  Synthetic
gaugggguuuagcggcg

SEQ ID NO: 46050 - RNA, 17 nt, Artificial Sequence
  Synthetic
ucgccggggcaggggcg

SEQ ID NO: 46051 - RNA, 17 nt, Artificial Sequence
  Synthetic
gggcaggggcgggggcg

SEQ ID NO: 46052 - RNA, 17 nt, Artificial Sequence
  Synthetic
cgggcucagugggggcg

SEQ ID NO: 46053 - RNA, 17 nt, Artificial Sequence
  Synthetic
gggcgggggcgugggcg

SEQ ID NO: 46054 - RNA, 17 nt, Artificial Sequence
  Synthetic
cccacccgcgaguggcg

SEQ ID NO: 46055 - RNA, 17 nt, Artificial Sequence
  Synthetic
uacgugggucauuggcg

SEQ ID NO: 46056 - RNA, 17 nt, Artificial Sequence
  Synthetic
gucggccacgccacucg

SEQ ID NO: 46057 - RNA, 17 nt, Artificial Sequence
  Synthetic
ccuccguccccccgucg

SEQ ID NO: 46058 - RNA, 17 nt, Artificial Sequence
  Synthetic
cguuaucccacucgucg

SEQ ID NO: 46059 - RNA, 17 nt, Artificial Sequence
  Synthetic
acugggggugaagaagg

SEQ ID NO: 46060 - RNA, 17 nt, Artificial Sequence
  Synthetic
ccggcccuuagauaagg

SEQ ID NO: 46061 - RNA, 17 nt, Artificial Sequence
  Synthetic
aggcacaaaaacacagg

SEQ ID NO: 46062 - RNA, 17 nt, Artificial Sequence
  Synthetic
gggacccaaacgacagg

SEQ ID NO: 46063 - RNA, 17 nt, Artificial Sequence
  Synthetic
gcuggaagaccgccagg

SEQ ID NO: 46064 - RNA, 17 nt, Artificial Sequence
  Synthetic
cuucuccccaauagagg

SEQ ID NO: 46065 - RNA, 17 nt, Artificial Sequence
  Synthetic
ggcuggguaucccgagg

SEQ ID NO: 46066 - RNA, 17 nt, Artificial Sequence
  Synthetic
gaggggacggagggagg

SEQ ID NO: 46067 - RNA, 17 nt, Artificial Sequence
  Synthetic
ggaggaagggagggagg

SEQ ID NO: 46068 - RNA, 17 nt, Artificial Sequence
  Synthetic
ugacuaagggugggagg

SEQ ID NO: 46069 - RNA, 17 nt, Artificial Sequence
  Synthetic
cggcccccggggaacgg

SEQ ID NO: 46070 - RNA, 17 nt, Artificial Sequence
  Synthetic
gacgagugggauaacgg

SEQ ID NO: 46071 - RNA, 17 nt, Artificial Sequence
  Synthetic
acaaacacccgcgacgg

SEQ ID NO: 46072 - RNA, 17 nt, Artificial Sequence
  Synthetic
ggggacggaggggacgg

SEQ ID NO: 46073 - RNA, 17 nt, Artificial Sequence
  Synthetic
ccgcgacggggggacgg

SEQ ID NO: 46074 - RNA, 17 nt, Artificial Sequence
  Synthetic
gagggagggggugacgg

SEQ ID NO: 46075 - RNA, 17 nt, Artificial Sequence
  Synthetic
ggucccccguuccccgg

SEQ ID NO: 46076 - RNA, 17 nt, Artificial Sequence
  Synthetic
uauauguggggucccgg

SEQ ID NO: 46077 - RNA, 17 nt, Artificial Sequence
  Synthetic
gggaucgugcgggccgg

SEQ ID NO: 46078 - RNA, 17 nt, Artificial Sequence
  Synthetic
accccaacggaaagcgg

SEQ ID NO: 46079 - RNA, 17 nt, Artificial Sequence
  Synthetic
gggaugggguuuagcgg

SEQ ID NO: 46080 - RNA, 17 nt, Artificial Sequence
  Synthetic
augggguuuagcggcgg

SEQ ID NO: 46081 - RNA, 17 nt, Artificial Sequence
  Synthetic
gggugggugggcggcgg

SEQ ID NO: 46082 - RNA, 17 nt, Artificial Sequence
  Synthetic
cgccggggcaggggcgg

SEQ ID NO: 46083 - RNA, 17 nt, Artificial Sequence
  Synthetic
ggcgggggcgugggcgg

SEQ ID NO: 46084 - RNA, 17 nt, Artificial Sequence
  Synthetic
ggugggugggugggcgg

SEQ ID NO: 46085 - RNA, 17 nt, Artificial Sequence
  Synthetic
uggggugggggugucgg

SEQ ID NO: 46086 - RNA, 17 nt, Artificial Sequence
  Synthetic
cugggggugaagaaggg

SEQ ID NO: 46087 - RNA, 17 nt, Artificial Sequence
  Synthetic
uaacgggggaggaaggg

SEQ ID NO: 46088 - RNA, 17 nt, Artificial Sequence
  Synthetic
cagagucugacuaaggg

SEQ ID NO: 46089 - RNA, 17 nt, Artificial Sequence
  Synthetic
uucuccccaauagaggg

SEQ ID NO: 46090 - RNA, 17 nt, Artificial Sequence
  Synthetic
acggaggggacggaggg

SEQ ID NO: 46091 - RNA, 17 nt, Artificial Sequence
  Synthetic
gggggaggaagggaggg

SEQ ID NO: 46092 - RNA, 17 nt, Artificial Sequence
  Synthetic
gacuaagggugggaggg

SEQ ID NO: 46093 - RNA, 17 nt, Artificial Sequence
  Synthetic
caaacacccgcgacggg

SEQ ID NO: 46094 - RNA, 17 nt, Artificial Sequence
  Synthetic
gccacgccacucgcggg

SEQ ID NO: 46095 - RNA, 17 nt, Artificial Sequence
  Synthetic
ugggguuuagcggcggg

SEQ ID NO: 46096 - RNA, 17 nt, Artificial Sequence
  Synthetic
ugggggugaagaagggg

SEQ ID NO: 46097 - RNA, 17 nt, Artificial Sequence
  Synthetic
ggucgccggggcagggg

SEQ ID NO: 46098 - RNA, 17 nt, Artificial Sequence
  Synthetic
ucuccccaauagagggg

SEQ ID NO: 46099 - RNA, 17 nt, Artificial Sequence
  Synthetic
acuaagggugggagggg

SEQ ID NO: 46100 - RNA, 17 nt, Artificial Sequence
  Synthetic
caaaaacacaggcgggg

SEQ ID NO: 46101 - RNA, 17 nt, Artificial Sequence
  Synthetic
gggggugaagaaggggg

SEQ ID NO: 46102 - RNA, 17 nt, Artificial Sequence
  Synthetic
cuccccaauagaggggg

SEQ ID NO: 46103 - RNA, 17 nt, Artificial Sequence
  Synthetic
gagugggauaacggggg

SEQ ID NO: 46104 - RNA, 17 nt, Artificial Sequence
  Synthetic
auguggggucccggggg

SEQ ID NO: 46105 - RNA, 17 nt, Artificial Sequence
  Synthetic
ggggugaagaagggggg

SEQ ID NO: 46106 - RNA, 17 nt, Artificial Sequence
  Synthetic
gguuuagcggcgggggg

SEQ ID NO: 46107 - RNA, 17 nt, Artificial Sequence
  Synthetic
gggugaagaaggggggg

SEQ ID NO: 46108 - RNA, 17 nt, Artificial Sequence
  Synthetic
aggcgaggagacugggg

SEQ ID NO: 46109 - RNA, 17 nt, Artificial Sequence
  Synthetic
ucagugggggcgugggg

SEQ ID NO: 46110 - RNA, 17 nt, Artificial Sequence
  Synthetic
aggggcgggggcguggg

SEQ ID NO: 46111 - RNA, 17 nt, Artificial Sequence
  Synthetic
ugggucauuggcguggg

SEQ ID NO: 46112 - RNA, 17 nt, Artificial Sequence
  Synthetic
ggguaucccgagguggg

SEQ ID NO: 46113 - RNA, 17 nt, Artificial Sequence
  Synthetic
gugggggugucgguggg

SEQ ID NO: 46114 - RNA, 17 nt, Artificial Sequence
  Synthetic
gucugacuaaggguggg

SEQ ID NO: 46115 - RNA, 17 nt, Artificial Sequence
  Synthetic
ugggggcgugggguggg

SEQ ID NO: 46116 - RNA, 17 nt, Artificial Sequence
  Synthetic
aucccgagguggguggg

SEQ ID NO: 46117 - RNA, 17 nt, Artificial Sequence
  Synthetic
cgagguggguggguggg

SEQ ID NO: 46118 - RNA, 17 nt, Artificial Sequence
  Synthetic
agggaggaggguacugg

SEQ ID NO: 46119 - RNA, 17 nt, Artificial Sequence
  Synthetic
accggccgacccccugg

SEQ ID NO: 46120 - RNA, 17 nt, Artificial Sequence
  Synthetic
uucuugcguguggcugg

SEQ ID NO: 46121 - RNA, 17 nt, Artificial Sequence
  Synthetic
ucgaccgggcucagugg

SEQ ID NO: 46122 - RNA, 17 nt, Artificial Sequence
  Synthetic
gugggucauuggcgugg

SEQ ID NO: 46123 - RNA, 17 nt, Artificial Sequence
  Synthetic
cgaggagacuggggugg

SEQ ID NO: 46124 - RNA, 17 nt, Artificial Sequence
  Synthetic
gauaagggggcaguugg

SEQ ID NO: 46125 - RNA, 17 nt, Artificial Sequence
  Synthetic
aagcggcgggguguugg

SEQ ID NO: 46126 - RNA, 17 nt, Artificial Sequence
  Synthetic
gucccgggggcgggaug

SEQ ID NO: 46127 - RNA, 17 nt, Artificial Sequence
  Synthetic
ggcugggggcuuauaug

SEQ ID NO: 46128 - RNA, 17 nt, Artificial Sequence
  Synthetic
agaaggcgaggagacug

SEQ ID NO: 46129 - RNA, 17 nt, Artificial Sequence
  Synthetic
gagggaggaggguacug

SEQ ID NO: 46130 - RNA, 17 nt, Artificial Sequence
  Synthetic
guucuugcguguggcug

SEQ ID NO: 46131 - RNA, 17 nt, Artificial Sequence
  Synthetic
gccgaccuuagccucug

SEQ ID NO: 46132 - RNA, 17 nt, Artificial Sequence
  Synthetic
aucgaccgggcucagug

SEQ ID NO: 46133 - RNA, 17 nt, Artificial Sequence
  Synthetic
ggcucagugggggcgug

SEQ ID NO: 46134 - RNA, 17 nt, Artificial Sequence
  Synthetic
cgugggucauuggcgug

SEQ ID NO: 46135 - RNA, 17 nt, Artificial Sequence
  Synthetic
gugucuguucuugcgug

SEQ ID NO: 46136 - RNA, 17 nt, Artificial Sequence
  Synthetic
uuguugucgggaucgug

SEQ ID NO: 46137 - RNA, 17 nt, Artificial Sequence
  Synthetic
gcgaggagacuggggug

SEQ ID NO: 46138 - RNA, 17 nt, Artificial Sequence
  Synthetic
cugggggcuuauaugug

SEQ ID NO: 46139 - RNA, 17 nt, Artificial Sequence
  Synthetic
guccccccccucuauug

SEQ ID NO: 46140 - RNA, 17 nt, Artificial Sequence
  Synthetic
cccgccgcuuuccguug

SEQ ID NO: 46141 - RNA, 17 nt, Artificial Sequence
  Synthetic
aaagcggcgggguguug

SEQ ID NO: 46142 - RNA, 17 nt, Artificial Sequence
  Synthetic
ugggugguuguuuuuug

SEQ ID NO: 46143 - RNA, 17 nt, Artificial Sequence
  Synthetic
uuuguuuauuccgacau

SEQ ID NO: 46144 - RNA, 17 nt, Artificial Sequence
  Synthetic
uggaguacgugggucau

SEQ ID NO: 46145 - RNA, 17 nt, Artificial Sequence
  Synthetic
ggucccgggggcgggau

SEQ ID NO: 46146 - RNA, 17 nt, Artificial Sequence
  Synthetic
ggguccccccccucuau

SEQ ID NO: 46147 - RNA, 17 nt, Artificial Sequence
  Synthetic
gagaaggcgaggagacu

SEQ ID NO: 46148 - RNA, 17 nt, Artificial Sequence
  Synthetic
ggagggaggaggguacu

SEQ ID NO: 46149 - RNA, 17 nt, Artificial Sequence
  Synthetic
cgcccacccacccaccu

SEQ ID NO: 46150 - RNA, 17 nt, Artificial Sequence
  Synthetic
cuugggucuuacugccu

SEQ ID NO: 46151 - RNA, 17 nt, Artificial Sequence
  Synthetic
aacgggggaccggggcu

SEQ ID NO: 46152 - RNA, 17 nt, Artificial Sequence
  Synthetic
uguucuugcguguggcu

SEQ ID NO: 46153 - RNA, 17 nt, Artificial Sequence
  Synthetic
gccuggcucucuaugcu

SEQ ID NO: 46154 - RNA, 17 nt, Artificial Sequence
  Synthetic
ggccgaccuuagccucu

SEQ ID NO: 46155 - RNA, 17 nt, Artificial Sequence
  Synthetic
ugggacacaugccuucu

SEQ ID NO: 46156 - RNA, 17 nt, Artificial Sequence
  Synthetic
uuagauaagggggcagu

SEQ ID NO: 46157 - RNA, 17 nt, Artificial Sequence
  Synthetic
gaucgaccgggcucagu

SEQ ID NO: 46158 - RNA, 17 nt, Artificial Sequence
  Synthetic
gggcgcccucgacgagu

SEQ ID NO: 46159 - RNA, 17 nt, Artificial Sequence
  Synthetic
gccuucuuggaguacgu

SEQ ID NO: 46160 - RNA, 17 nt, Artificial Sequence
  Synthetic
accccgccgcuuuccgu

SEQ ID NO: 46161 - RNA, 17 nt, Artificial Sequence
  Synthetic
ggcaggggcgggggcgu

SEQ ID NO: 46162 - RNA, 17 nt, Artificial Sequence
  Synthetic
gggcucagugggggcgu

SEQ ID NO: 46163 - RNA, 17 nt, Artificial Sequence
  Synthetic
acgugggucauuggcgu

SEQ ID NO: 46164 - RNA, 17 nt, Artificial Sequence
  Synthetic
gccccagaggcuaaggu

SEQ ID NO: 46165 - RNA, 17 nt, Artificial Sequence
  Synthetic
acgccgcguuuccaggu

SEQ ID NO: 46166 - RNA, 17 nt, Artificial Sequence
  Synthetic
gcuggguaucccgaggu

SEQ ID NO: 46167 - RNA, 17 nt, Artificial Sequence
  Synthetic
ggggugggggugucggu

SEQ ID NO: 46168 - RNA, 17 nt, Artificial Sequence
  Synthetic
agagucugacuaagggu

SEQ ID NO: 46169 - RNA, 17 nt, Artificial Sequence
  Synthetic
ccacgccacucgcgggu

SEQ ID NO: 46170 - RNA, 17 nt, Artificial Sequence
  Synthetic
aaaaacacaggcggggu

SEQ ID NO: 46171 - RNA, 17 nt, Artificial Sequence
  Synthetic
gaagaccgccagggggu

SEQ ID NO: 46172 - RNA, 17 nt, Artificial Sequence
  Synthetic
ggcgaggagacuggggu

SEQ ID NO: 46173 - RNA, 17 nt, Artificial Sequence
  Synthetic
cagugggggcguggggu

SEQ ID NO: 46174 - RNA, 17 nt, Artificial Sequence
  Synthetic
gguaucccgaggugggu

SEQ ID NO: 46175 - RNA, 17 nt, Artificial Sequence
  Synthetic
gggggcguggggugggu

SEQ ID NO: 46176 - RNA, 17 nt, Artificial Sequence
  Synthetic
ucccgaggugggugggu

SEQ ID NO: 46177 - RNA, 17 nt, Artificial Sequence
  Synthetic
agggggcaguugguggu

SEQ ID NO: 46178 - RNA, 17 nt, Artificial Sequence
  Synthetic
uuuaaauaaaccaaugu

SEQ ID NO: 46179 - RNA, 17 nt, Artificial Sequence
  Synthetic
gcugggggcuuauaugu

SEQ ID NO: 46180 - RNA, 17 nt, Artificial Sequence
  Synthetic
ggaaagcggcggggugu

SEQ ID NO: 46181 - RNA, 17 nt, Artificial Sequence
  Synthetic
gacuggggugggggugu

SEQ ID NO: 46182 - RNA, 17 nt, Artificial Sequence
  Synthetic
gggguuguuauuguugu

SEQ ID NO: 46183 - RNA, 17 nt, Artificial Sequence
  Synthetic
gguccccccccucuauu

SEQ ID NO: 46184 - RNA, 17 nt, Artificial Sequence
  Synthetic
ccuggcucucuaugcuu

SEQ ID NO: 46185 - RNA, 17 nt, Artificial Sequence
  Synthetic
ccccgccgcuuuccguu

SEQ ID NO: 46186 - RNA, 17 nt, Artificial Sequence
  Synthetic
gggcgcccccugucguu

SEQ ID NO: 46187 - RNA, 17 nt, Artificial Sequence
  Synthetic
gaaagcggcgggguguu

SEQ ID NO: 46188 - RNA, 17 nt, Artificial Sequence
  Synthetic
ggcgcccccugucguuu

SEQ ID NO: 46189 - RNA, 20 nt, Artificial Sequence
  Synthetic
gacaacaauaacaaccccaa

SEQ ID NO: 46190 - RNA, 20 nt, Artificial Sequence
  Synthetic
gugggagggggggaaaagaa

SEQ ID NO: 46191 - RNA, 20 nt, Artificial Sequence
  Synthetic
aggguacugggggugaagaa

SEQ ID NO: 46192 - RNA, 20 nt, Artificial Sequence
  Synthetic
gcaagaacagacacgcagaa

SEQ ID NO: 46193 - RNA, 20 nt, Artificial Sequence
  Synthetic
gggagaagcgagaacaggaa

SEQ ID NO: 46194 - RNA, 20 nt, Artificial Sequence
  Synthetic
gugggauaacgggggaggaa

SEQ ID NO: 46195 - RNA, 20 nt, Artificial Sequence
  Synthetic
agauaacggcccccggggaa

SEQ ID NO: 46196 - RNA, 20 nt, Artificial Sequence
  Synthetic
ggacggggcgcuggagauaa

SEQ ID NO: 46197 - RNA, 20 nt, Artificial Sequence
  Synthetic
uccagccggcccuuagauaa

SEQ ID NO: 46198 - RNA, 20 nt, Artificial Sequence
  Synthetic
gcccucgacgagugggauaa

SEQ ID NO: 46199 - RNA, 20 nt, Artificial Sequence
  Synthetic
aaguaacagagucugacuaa

SEQ ID NO: 46200 - RNA, 20 nt, Artificial Sequence
  Synthetic
ccaacugcccccuuaucuaa

SEQ ID NO: 46201 - RNA, 20 nt, Artificial Sequence
  Synthetic
ggggggggacccaaacgaca

SEQ ID NO: 46202 - RNA, 20 nt, Artificial Sequence
  Synthetic
ggccggcuggaagaccgcca

SEQ ID NO: 46203 - RNA, 20 nt, Artificial Sequence
  Synthetic
ggccgggggucgccggggca

SEQ ID NO: 46204 - RNA, 20 nt, Artificial Sequence
  Synthetic
augacccacguacuccaaga

SEQ ID NO: 46205 - RNA, 20 nt, Artificial Sequence
  Synthetic
gaggguacugggggugaaga

SEQ ID NO: 46206 - RNA, 20 nt, Artificial Sequence
  Synthetic
ggcguggggugggugggaga

SEQ ID NO: 46207 - RNA, 20 nt, Artificial Sequence
  Synthetic
accugcuucuccccaauaga

SEQ ID NO: 46208 - RNA, 20 nt, Artificial Sequence
  Synthetic
acaaacacaaacacccgcga

SEQ ID NO: 46209 - RNA, 20 nt, Artificial Sequence
  Synthetic
agcgagaacaggaaaggcga

SEQ ID NO: 46210 - RNA, 20 nt, Artificial Sequence
  Synthetic
cccguuaucccacucgucga

SEQ ID NO: 46211 - RNA, 20 nt, Artificial Sequence
  Synthetic
ggggaggaagggagggagga

SEQ ID NO: 46212 - RNA, 20 nt, Artificial Sequence
  Synthetic
agugggauaacgggggagga

SEQ ID NO: 46213 - RNA, 20 nt, Artificial Sequence
  Synthetic
ggggggacggaggggacgga

SEQ ID NO: 46214 - RNA, 20 nt, Artificial Sequence
  Synthetic
acccgcgacggggggacgga

SEQ ID NO: 46215 - RNA, 20 nt, Artificial Sequence
  Synthetic
gcggggggcggcgcgccgga

SEQ ID NO: 46216 - RNA, 20 nt, Artificial Sequence
  Synthetic
gggggcaguugguggucgga

SEQ ID NO: 46217 - RNA, 20 nt, Artificial Sequence
  Synthetic
gauaacgggggaggaaggga

SEQ ID NO: 46218 - RNA, 20 nt, Artificial Sequence
  Synthetic
ggacggaggggacggaggga

SEQ ID NO: 46219 - RNA, 20 nt, Artificial Sequence
  Synthetic
guggggucccgggggcggga

SEQ ID NO: 46220 - RNA, 20 nt, Artificial Sequence
  Synthetic
cgacggggggacggagggga

SEQ ID NO: 46221 - RNA, 20 nt, Artificial Sequence
  Synthetic
agggagggggugacggggga

SEQ ID NO: 46222 - RNA, 20 nt, Artificial Sequence
  Synthetic
aaacacccgcgacgggggga

SEQ ID NO: 46223 - RNA, 20 nt, Artificial Sequence
  Synthetic
gagucugacuaaggguggga

SEQ ID NO: 46224 - RNA, 20 nt, Artificial Sequence
  Synthetic
gggacggagggaggggguga

SEQ ID NO: 46225 - RNA, 20 nt, Artificial Sequence
  Synthetic
uuccagccggcccuuagaua

SEQ ID NO: 46226 - RNA, 20 nt, Artificial Sequence
  Synthetic
uaaguaacagagucugacua

SEQ ID NO: 46227 - RNA, 20 nt, Artificial Sequence
  Synthetic
agggggcgccccagaggcua

SEQ ID NO: 46228 - RNA, 20 nt, Artificial Sequence
  Synthetic
accaacugcccccuuaucua

SEQ ID NO: 46229 - RNA, 20 nt, Artificial Sequence
  Synthetic
ugggagggggggaaaagaac

SEQ ID NO: 46230 - RNA, 20 nt, Artificial Sequence
  Synthetic
ggggggggagaagcgagaac

SEQ ID NO: 46231 - RNA, 20 nt, Artificial Sequence
  Synthetic
gauaacggcccccggggaac

SEQ ID NO: 46232 - RNA, 20 nt, Artificial Sequence
  Synthetic
cccucgacgagugggauaac

SEQ ID NO: 46233 - RNA, 20 nt, Artificial Sequence
  Synthetic
agagccaggcacaaaaacac

SEQ ID NO: 46234 - RNA, 20 nt, Artificial Sequence
  Synthetic
gcgucuuuguugaacgacac

SEQ ID NO: 46235 - RNA, 20 nt, Artificial Sequence
  Synthetic
gugggggguuacagcgacac

SEQ ID NO: 46236 - RNA, 20 nt, Artificial Sequence
  Synthetic
gugggagaaggcgaggagac

SEQ ID NO: 46237 - RNA, 20 nt, Artificial Sequence
  Synthetic
aggggggggacccaaacgac

SEQ ID NO: 46238 - RNA, 20 nt, Artificial Sequence
  Synthetic
caaacacaaacacccgcgac

SEQ ID NO: 46239 - RNA, 20 nt, Artificial Sequence
  Synthetic
gggggugcucgucgaucgac

SEQ ID NO: 46240 - RNA, 20 nt, Artificial Sequence
  Synthetic
cggggggcggcgcgccggac

SEQ ID NO: 46241 - RNA, 20 nt, Artificial Sequence
  Synthetic
ggggcaguugguggucggac

SEQ ID NO: 46242 - RNA, 20 nt, Artificial Sequence
  Synthetic
gcccccggggaacgggggac

SEQ ID NO: 46243 - RNA, 20 nt, Artificial Sequence
  Synthetic
gggagggggugacgggggac

SEQ ID NO: 46244 - RNA, 20 nt, Artificial Sequence
  Synthetic
ggacggagggagggggugac

SEQ ID NO: 46245 - RNA, 20 nt, Artificial Sequence
  Synthetic
gaagggagggaggaggguac

SEQ ID NO: 46246 - RNA, 20 nt, Artificial Sequence
  Synthetic
cgucuuuguugaacgacacc

SEQ ID NO: 46247 - RNA, 20 nt, Artificial Sequence
  Synthetic
ggggugcucgucgaucgacc

SEQ ID NO: 46248 - RNA, 20 nt, Artificial Sequence
  Synthetic
cccccggggaacgggggacc

SEQ ID NO: 46249 - RNA, 20 nt, Artificial Sequence
  Synthetic
aagcaggugucuaaccuacc

SEQ ID NO: 46250 - RNA, 20 nt, Artificial Sequence
  Synthetic
gccccugccccggcgacccc

SEQ ID NO: 46251 - RNA, 20 nt, Artificial Sequence
  Synthetic
agcgacaccggccgaccccc

SEQ ID NO: 46252 - RNA, 20 nt, Artificial Sequence
  Synthetic
cuaaaccccaucccgccccc

SEQ ID NO: 46253 - RNA, 20 nt, Artificial Sequence
  Synthetic
cgcuggagauaacggccccc

SEQ ID NO: 46254 - RNA, 20 nt, Artificial Sequence
  Synthetic
gcuaaaccccaucccgcccc

SEQ ID NO: 46255 - RNA, 20 nt, Artificial Sequence
  Synthetic
gcgcuggagauaacggcccc

SEQ ID NO: 46256 - RNA, 20 nt, Artificial Sequence
  Synthetic
gccccggucccccguucccc

SEQ ID NO: 46257 - RNA, 20 nt, Artificial Sequence
  Synthetic
caccucgggauacccagccc

SEQ ID NO: 46258 - RNA, 20 nt, Artificial Sequence
  Synthetic
cccacucgucgagggcgccc

SEQ ID NO: 46259 - RNA, 20 nt, Artificial Sequence
  Synthetic
ccacgcccccgccccugccc

SEQ ID NO: 46260 - RNA, 20 nt, Artificial Sequence
  Synthetic
gggcuuauaugugggguccc

SEQ ID NO: 46261 - RNA, 20 nt, Artificial Sequence
  Synthetic
agccccggucccccguuccc

SEQ ID NO: 46262 - RNA, 20 nt, Artificial Sequence
  Synthetic
agacccaagcauagagagcc

SEQ ID NO: 46263 - RNA, 20 nt, Artificial Sequence
  Synthetic
acaggaaaggcgauggagcc

SEQ ID NO: 46264 - RNA, 20 nt, Artificial Sequence
  Synthetic
ccccacgcccccacugagcc

SEQ ID NO: 46265 - RNA, 20 nt, Artificial Sequence
  Synthetic
gggccggcuggaagaccgcc

SEQ ID NO: 46266 - RNA, 20 nt, Artificial Sequence
  Synthetic
cgugcgggccgggggucgcc

SEQ ID NO: 46267 - RNA, 20 nt, Artificial Sequence
  Synthetic
ugggcggcgguggccgggcc

SEQ ID NO: 46268 - RNA, 20 nt, Artificial Sequence
  Synthetic
uugucgggaucgugcgggcc

SEQ ID NO: 46269 - RNA, 20 nt, Artificial Sequence
  Synthetic
gugggugggcggcgguggcc

SEQ ID NO: 46270 - RNA, 20 nt, Artificial Sequence
  Synthetic
uaugcuugggucuuacugcc

SEQ ID NO: 46271 - RNA, 20 nt, Artificial Sequence
  Synthetic
uuuuuccucgguguucugcc

SEQ ID NO: 46272 - RNA, 20 nt, Artificial Sequence
  Synthetic
cccgccuguguuuuugugcc

SEQ ID NO: 46273 - RNA, 20 nt, Artificial Sequence
  Synthetic
ggggcuuauauguggggucc

SEQ ID NO: 46274 - RNA, 20 nt, Artificial Sequence
  Synthetic
aacaaagacgccgcguuucc

SEQ ID NO: 46275 - RNA, 20 nt, Artificial Sequence
  Synthetic
ccccucuauuggggagaagc

SEQ ID NO: 46276 - RNA, 20 nt, Artificial Sequence
  Synthetic
cccccuggcggucuuccagc

SEQ ID NO: 46277 - RNA, 20 nt, Artificial Sequence
  Synthetic
agcggcggggggcggcgcgc

SEQ ID NO: 46278 - RNA, 20 nt, Artificial Sequence
  Synthetic
cggcgcgccggacggggcgc

SEQ ID NO: 46279 - RNA, 20 nt, Artificial Sequence
  Synthetic
aggucggccacgccacucgc

SEQ ID NO: 46280 - RNA, 20 nt, Artificial Sequence
  Synthetic
ccccuccguccccccgucgc

SEQ ID NO: 46281 - RNA, 20 nt, Artificial Sequence
  Synthetic
ucgugcgggccgggggucgc

SEQ ID NO: 46282 - RNA, 20 nt, Artificial Sequence
  Synthetic
ccaggcacaaaaacacaggc

SEQ ID NO: 46283 - RNA, 20 nt, Artificial Sequence
  Synthetic
ccccuuaucuaagggccggc

SEQ ID NO: 46284 - RNA, 20 nt, Artificial Sequence
  Synthetic
caaccccaacggaaagcggc

SEQ ID NO: 46285 - RNA, 20 nt, Artificial Sequence
  Synthetic
gcgggaugggguuuagcggc

SEQ ID NO: 46286 - RNA, 20 nt, Artificial Sequence
  Synthetic
aagaccgccagggggucggc

SEQ ID NO: 46287 - RNA, 20 nt, Artificial Sequence
  Synthetic
cugcccccuuaucuaagggc

SEQ ID NO: 46288 - RNA, 20 nt, Artificial Sequence
  Synthetic
agggggggaaaagaacgggc

SEQ ID NO: 46289 - RNA, 20 nt, Artificial Sequence
  Synthetic
cggcgguggccgggccgggc

SEQ ID NO: 46290 - RNA, 20 nt, Artificial Sequence
  Synthetic
gugggcggcgguggccgggc

SEQ ID NO: 46291 - RNA, 20 nt, Artificial Sequence
  Synthetic
guugucgggaucgugcgggc

SEQ ID NO: 46292 - RNA, 20 nt, Artificial Sequence
  Synthetic
ggggucgccggggcaggggc

SEQ ID NO: 46293 - RNA, 20 nt, Artificial Sequence
  Synthetic
ggggaacgggggaccggggc

SEQ ID NO: 46294 - RNA, 20 nt, Artificial Sequence
  Synthetic
gggccgggggucgccggggc

SEQ ID NO: 46295 - RNA, 20 nt, Artificial Sequence
  Synthetic
auauguggggucccgggggc

SEQ ID NO: 46296 - RNA, 20 nt, Artificial Sequence
  Synthetic
gcaggggcgggggcgugggc

SEQ ID NO: 46297 - RNA, 20 nt, Artificial Sequence
  Synthetic
ggugggugggcggcgguggc

SEQ ID NO: 46298 - RNA, 20 nt, Artificial Sequence
  Synthetic
ugucuguucuugcguguggc

SEQ ID NO: 46299 - RNA, 20 nt, Artificial Sequence
  Synthetic
uuuuuuccucgguguucugc

SEQ ID NO: 46300 - RNA, 20 nt, Artificial Sequence
  Synthetic
uauuguugucgggaucgugc

SEQ ID NO: 46301 - RNA, 20 nt, Artificial Sequence
  Synthetic
gccgcccacccacccaccuc

SEQ ID NO: 46302 - RNA, 20 nt, Artificial Sequence
  Synthetic
gcguggccgaccuuagccuc

SEQ ID NO: 46303 - RNA, 20 nt, Artificial Sequence
  Synthetic
guuaucuccagcgccccguc

SEQ ID NO: 46304 - RNA, 20 nt, Artificial Sequence
  Synthetic
uugggguuguuauuguuguc

SEQ ID NO: 46305 - RNA, 20 nt, Artificial Sequence
  Synthetic
auaacaaccccaacggaaag

SEQ ID NO: 46306 - RNA, 20 nt, Artificial Sequence
  Synthetic
ggguacugggggugaagaag

SEQ ID NO: 46307 - RNA, 20 nt, Artificial Sequence
  Synthetic
ccagccggcccuuagauaag

SEQ ID NO: 46308 - RNA, 20 nt, Artificial Sequence
  Synthetic
gggggggacccaaacgacag

SEQ ID NO: 46309 - RNA, 20 nt, Artificial Sequence
  Synthetic
aacgacagggggcgccccag

SEQ ID NO: 46310 - RNA, 20 nt, Artificial Sequence
  Synthetic
gccggcuggaagaccgccag

SEQ ID NO: 46311 - RNA, 20 nt, Artificial Sequence
  Synthetic
gccgggggucgccggggcag

SEQ ID NO: 46312 - RNA, 20 nt, Artificial Sequence
  Synthetic
cgucgaucgaccgggcucag

SEQ ID NO: 46313 - RNA, 20 nt, Artificial Sequence
  Synthetic
ccugcuucuccccaauagag

SEQ ID NO: 46314 - RNA, 20 nt, Artificial Sequence
  Synthetic
accggggcgcccucgacgag

SEQ ID NO: 46315 - RNA, 20 nt, Artificial Sequence
  Synthetic
aacacgagcccacccgcgag

SEQ ID NO: 46316 - RNA, 20 nt, Artificial Sequence
  Synthetic
cccgcgacggggggacggag

SEQ ID NO: 46317 - RNA, 20 nt, Artificial Sequence
  Synthetic
gacggaggggacggagggag

SEQ ID NO: 46318 - RNA, 20 nt, Artificial Sequence
  Synthetic
agucugacuaagggugggag

SEQ ID NO: 46319 - RNA, 20 nt, Artificial Sequence
  Synthetic
caccugcuucuccccaauag

SEQ ID NO: 46320 - RNA, 20 nt, Artificial Sequence
  Synthetic
gggggcgggaugggguuuag

SEQ ID NO: 46321 - RNA, 20 nt, Artificial Sequence
  Synthetic
gucuaaccuaccuggaaacg

SEQ ID NO: 46322 - RNA, 20 nt, Artificial Sequence
  Synthetic
auaacggcccccggggaacg

SEQ ID NO: 46323 - RNA, 20 nt, Artificial Sequence
  Synthetic
ccucgacgagugggauaacg

SEQ ID NO: 46324 - RNA, 20 nt, Artificial Sequence
  Synthetic
aaacacaaacacccgcgacg

SEQ ID NO: 46325 - RNA, 20 nt, Artificial Sequence
  Synthetic
ggggggcggcgcgccggacg

SEQ ID NO: 46326 - RNA, 20 nt, Artificial Sequence
  Synthetic
gacggagggagggggugacg

SEQ ID NO: 46327 - RNA, 20 nt, Artificial Sequence
  Synthetic
acaugccuucuuggaguacg

SEQ ID NO: 46328 - RNA, 20 nt, Artificial Sequence
  Synthetic
uggagcccggcagaacaccg

SEQ ID NO: 46329 - RNA, 20 nt, Artificial Sequence
  Synthetic
gucuuuguugaacgacaccg

SEQ ID NO: 46330 - RNA, 20 nt, Artificial Sequence
  Synthetic
ccccggggaacgggggaccg

SEQ ID NO: 46331 - RNA, 20 nt, Artificial Sequence
  Synthetic
gcuggagauaacggcccccg

SEQ ID NO: 46332 - RNA, 20 nt, Artificial Sequence
  Synthetic
ccccggucccccguuccccg

SEQ ID NO: 46333 - RNA, 20 nt, Artificial Sequence
  Synthetic
gaccggggcuggguaucccg

SEQ ID NO: 46334 - RNA, 20 nt, Artificial Sequence
  Synthetic
ggcuuauauguggggucccg

SEQ ID NO: 46335 - RNA, 20 nt, Artificial Sequence
  Synthetic
gugcgggccgggggucgccg

SEQ ID NO: 46336 - RNA, 20 nt, Artificial Sequence
  Synthetic
ugucgggaucgugcgggccg

SEQ ID NO: 46337 - RNA, 20 nt, Artificial Sequence
  Synthetic
ggggugggugggagaaggcg

SEQ ID NO: 46338 - RNA, 20 nt, Artificial Sequence
  Synthetic
caggcacaaaaacacaggcg

SEQ ID NO: 46339 - RNA, 20 nt, Artificial Sequence
  Synthetic
aaccccaacggaaagcggcg

SEQ ID NO: 46340 - RNA, 20 nt, Artificial Sequence
  Synthetic
cgggaugggguuuagcggcg

SEQ ID NO: 46341 - RNA, 20 nt, Artificial Sequence
  Synthetic
gggucgccggggcaggggcg

SEQ ID NO: 46342 - RNA, 20 nt, Artificial Sequence
  Synthetic
ccggggcaggggcgggggcg

SEQ ID NO: 46343 - RNA, 20 nt, Artificial Sequence
  Synthetic
gaccgggcucagugggggcg

SEQ ID NO: 46344 - RNA, 20 nt, Artificial Sequence
  Synthetic
caggggcgggggcgugggcg

SEQ ID NO: 46345 - RNA, 20 nt, Artificial Sequence
  Synthetic
gagcccacccgcgaguggcg

SEQ ID NO: 46346 - RNA, 20 nt, Artificial Sequence
  Synthetic
gaguacgugggucauuggcg

SEQ ID NO: 46347 - RNA, 20 nt, Artificial Sequence
  Synthetic
aaggucggccacgccacucg

SEQ ID NO: 46348 - RNA, 20 nt, Artificial Sequence
  Synthetic
uccccuccguccccccgucg

SEQ ID NO: 46349 - RNA, 20 nt, Artificial Sequence
  Synthetic
ccccguuaucccacucgucg

SEQ ID NO: 46350 - RNA, 20 nt, Artificial Sequence
  Synthetic
gguacugggggugaagaagg

SEQ ID NO: 46351 - RNA, 20 nt, Artificial Sequence
  Synthetic
cagccggcccuuagauaagg

SEQ ID NO: 46352 - RNA, 20 nt, Artificial Sequence
  Synthetic
gccaggcacaaaaacacagg

SEQ ID NO: 46353 - RNA, 20 nt, Artificial Sequence
  Synthetic
ggggggacccaaacgacagg

SEQ ID NO: 46354 - RNA, 20 nt, Artificial Sequence
  Synthetic
ccggcuggaagaccgccagg

SEQ ID NO: 46355 - RNA, 20 nt, Artificial Sequence
  Synthetic
cugcuucuccccaauagagg

SEQ ID NO: 46356 - RNA, 20 nt, Artificial Sequence
  Synthetic
cggggcuggguaucccgagg

SEQ ID NO: 46357 - RNA, 20 nt, Artificial Sequence
  Synthetic
acggaggggacggagggagg

SEQ ID NO: 46358 - RNA, 20 nt, Artificial Sequence
  Synthetic
gggggaggaagggagggagg

SEQ ID NO: 46359 - RNA, 20 nt, Artificial Sequence
  Synthetic
gucugacuaagggugggagg

SEQ ID NO: 46360 - RNA, 20 nt, Artificial Sequence
  Synthetic
uaacggcccccggggaacgg

SEQ ID NO: 46361 - RNA, 20 nt, Artificial Sequence
  Synthetic
cucgacgagugggauaacgg

SEQ ID NO: 46362 - RNA, 20 nt, Artificial Sequence
  Synthetic
aacacaaacacccgcgacgg

SEQ ID NO: 46363 - RNA, 20 nt, Artificial Sequence
  Synthetic
cggggggacggaggggacgg

SEQ ID NO: 46364 - RNA, 20 nt, Artificial Sequence
  Synthetic
cacccgcgacggggggacgg

SEQ ID NO: 46365 - RNA, 20 nt, Artificial Sequence
  Synthetic
acggagggagggggugacgg

SEQ ID NO: 46366 - RNA, 20 nt, Artificial Sequence
  Synthetic
cccggucccccguuccccgg

SEQ ID NO: 46367 - RNA, 20 nt, Artificial Sequence
  Synthetic
gcuuauauguggggucccgg

SEQ ID NO: 46368 - RNA, 20 nt, Artificial Sequence
  Synthetic
gucgggaucgugcgggccgg

SEQ ID NO: 46369 - RNA, 20 nt, Artificial Sequence
  Synthetic
acaaccccaacggaaagcgg

SEQ ID NO: 46370 - RNA, 20 nt, Artificial Sequence
  Synthetic
ggcgggaugggguuuagcgg

SEQ ID NO: 46371 - RNA, 20 nt, Artificial Sequence
  Synthetic
gggaugggguuuagcggcgg

SEQ ID NO: 46372 - RNA, 20 nt, Artificial Sequence
  Synthetic
ggugggugggugggcggcgg

SEQ ID NO: 46373 - RNA, 20 nt, Artificial Sequence
  Synthetic
ggucgccggggcaggggcgg

SEQ ID NO: 46374 - RNA, 20 nt, Artificial Sequence
  Synthetic
aggggcgggggcgugggcgg

SEQ ID NO: 46375 - RNA, 20 nt, Artificial Sequence
  Synthetic
cgaggugggugggugggcgg

SEQ ID NO: 46376 - RNA, 20 nt, Artificial Sequence
  Synthetic
gacuggggugggggugucgg

SEQ ID NO: 46377 - RNA, 20 nt, Artificial Sequence
  Synthetic
guacugggggugaagaaggg

SEQ ID NO: 46378 - RNA, 20 nt, Artificial Sequence
  Synthetic
ggauaacgggggaggaaggg

SEQ ID NO: 46379 - RNA, 20 nt, Artificial Sequence
  Synthetic
uaacagagucugacuaaggg

SEQ ID NO: 46380 - RNA, 20 nt, Artificial Sequence
  Synthetic
ugcuucuccccaauagaggg

SEQ ID NO: 46381 - RNA, 20 nt, Artificial Sequence
  Synthetic
gggacggaggggacggaggg

SEQ ID NO: 46382 - RNA, 20 nt, Artificial Sequence
  Synthetic
aacgggggaggaagggaggg

SEQ ID NO: 46383 - RNA, 20 nt, Artificial Sequence
  Synthetic
ucugacuaagggugggaggg

SEQ ID NO: 46384 - RNA, 20 nt, Artificial Sequence
  Synthetic
acacaaacacccgcgacggg

SEQ ID NO: 46385 - RNA, 20 nt, Artificial Sequence
  Synthetic
ucggccacgccacucgcggg

SEQ ID NO: 46386 - RNA, 20 nt, Artificial Sequence
  Synthetic
ggaugggguuuagcggcggg

SEQ ID NO: 46387 - RNA, 20 nt, Artificial Sequence
  Synthetic
uacugggggugaagaagggg

SEQ ID NO: 46388 - RNA, 20 nt, Artificial Sequence
  Synthetic
gggggucgccggggcagggg

SEQ ID NO: 46389 - RNA, 20 nt, Artificial Sequence
  Synthetic
gcuucuccccaauagagggg

SEQ ID NO: 46390 - RNA, 20 nt, Artificial Sequence
  Synthetic
cugacuaagggugggagggg

SEQ ID NO: 46391 - RNA, 20 nt, Artificial Sequence
  Synthetic
gcacaaaaacacaggcgggg

SEQ ID NO: 46392 - RNA, 20 nt, Artificial Sequence
  Synthetic
acugggggugaagaaggggg

SEQ ID NO: 46393 - RNA, 20 nt, Artificial Sequence
  Synthetic
cuucuccccaauagaggggg

SEQ ID NO: 46394 - RNA, 20 nt, Artificial Sequence
  Synthetic
gacgagugggauaacggggg

SEQ ID NO: 46395 - RNA, 20 nt, Artificial Sequence
  Synthetic
uauauguggggucccggggg

SEQ ID NO: 46396 - RNA, 20 nt, Artificial Sequence
  Synthetic
cugggggugaagaagggggg

SEQ ID NO: 46397 - RNA, 20 nt, Artificial Sequence
  Synthetic
ugggguuuagcggcgggggg

SEQ ID NO: 46398 - RNA, 20 nt, Artificial Sequence
  Synthetic
ugggggugaagaaggggggg

SEQ ID NO: 46399 - RNA, 20 nt, Artificial Sequence
  Synthetic
agaaggcgaggagacugggg

SEQ ID NO: 46400 - RNA, 20 nt, Artificial Sequence
  Synthetic
ggcucagugggggcgugggg

SEQ ID NO: 46401 - RNA, 20 nt, Artificial Sequence
  Synthetic
ggcaggggcgggggcguggg

SEQ ID NO: 46402 - RNA, 20 nt, Artificial Sequence
  Synthetic
acgugggucauuggcguggg

SEQ ID NO: 46403 - RNA, 20 nt, Artificial Sequence
  Synthetic
gcuggguaucccgagguggg

SEQ ID NO: 46404 - RNA, 20 nt, Artificial Sequence
  Synthetic
ggggugggggugucgguggg

SEQ ID NO: 46405 - RNA, 20 nt, Artificial Sequence
  Synthetic
agagucugacuaaggguggg

SEQ ID NO: 46406 - RNA, 20 nt, Artificial Sequence
  Synthetic
cagugggggcgugggguggg

SEQ ID NO: 46407 - RNA, 20 nt, Artificial Sequence
  Synthetic
gguaucccgagguggguggg

SEQ ID NO: 46408 - RNA, 20 nt, Artificial Sequence
  Synthetic
ucccgagguggguggguggg

SEQ ID NO: 46409 - RNA, 20 nt, Artificial Sequence
  Synthetic
gggagggaggaggguacugg

SEQ ID NO: 46410 - RNA, 20 nt, Artificial Sequence
  Synthetic
gacaccggccgacccccugg

SEQ ID NO: 46411 - RNA, 20 nt, Artificial Sequence
  Synthetic
cuguucuugcguguggcugg

SEQ ID NO: 46412 - RNA, 20 nt, Artificial Sequence
  Synthetic
cgaucgaccgggcucagugg

SEQ ID NO: 46413 - RNA, 20 nt, Artificial Sequence
  Synthetic
uacgugggucauuggcgugg

SEQ ID NO: 46414 - RNA, 20 nt, Artificial Sequence
  Synthetic
aggcgaggagacuggggugg

SEQ ID NO: 46415 - RNA, 20 nt, Artificial Sequence
  Synthetic
uuagauaagggggcaguugg

SEQ ID NO: 46416 - RNA, 20 nt, Artificial Sequence
  Synthetic
ggaaagcggcgggguguugg

SEQ ID NO: 46417 - RNA, 20 nt, Artificial Sequence
  Synthetic
ggggucccgggggcgggaug

SEQ ID NO: 46418 - RNA, 20 nt, Artificial Sequence
  Synthetic
uguggcugggggcuuauaug

SEQ ID NO: 46419 - RNA, 20 nt, Artificial Sequence
  Synthetic
gggagaaggcgaggagacug

SEQ ID NO: 46420 - RNA, 20 nt, Artificial Sequence
  Synthetic
agggagggaggaggguacug

SEQ ID NO: 46421 - RNA, 20 nt, Artificial Sequence
  Synthetic
ucuguucuugcguguggcug

SEQ ID NO: 46422 - RNA, 20 nt, Artificial Sequence
  Synthetic
guggccgaccuuagccucug

SEQ ID NO: 46423 - RNA, 20 nt, Artificial Sequence
  Synthetic
ucgaucgaccgggcucagug

SEQ ID NO: 46424 - RNA, 20 nt, Artificial Sequence
  Synthetic
ccgggcucagugggggcgug

SEQ ID NO: 46425 - RNA, 20 nt, Artificial Sequence
  Synthetic
guacgugggucauuggcgug

SEQ ID NO: 46426 - RNA, 20 nt, Artificial Sequence
  Synthetic
ugcgugucuguucuugcgug

SEQ ID NO: 46427 - RNA, 20 nt, Artificial Sequence
  Synthetic
uuauuguugucgggaucgug

SEQ ID NO: 46428 - RNA, 20 nt, Artificial Sequence
  Synthetic
aaggcgaggagacuggggug

SEQ ID NO: 46429 - RNA, 20 nt, Artificial Sequence
  Synthetic
uggcugggggcuuauaugug

SEQ ID NO: 46430 - RNA, 20 nt, Artificial Sequence
  Synthetic
uggguccccccccucuauug

SEQ ID NO: 46431 - RNA, 20 nt, Artificial Sequence
  Synthetic
caccccgccgcuuuccguug

SEQ ID NO: 46432 - RNA, 20 nt, Artificial Sequence
  Synthetic
cggaaagcggcgggguguug

SEQ ID NO: 46433 - RNA, 20 nt, Artificial Sequence
  Synthetic
cggugggugguuguuuuuug

SEQ ID NO: 46434 - RNA, 20 nt, Artificial Sequence
  Synthetic
guguuuguuuauuccgacau

SEQ ID NO: 46435 - RNA, 20 nt, Artificial Sequence
  Synthetic
ucuuggaguacgugggucau

SEQ ID NO: 46436 - RNA, 20 nt, Artificial Sequence
  Synthetic
uggggucccgggggcgggau

SEQ ID NO: 46437 - RNA, 20 nt, Artificial Sequence
  Synthetic
uuuggguccccccccucuau

SEQ ID NO: 46438 - RNA, 20 nt, Artificial Sequence
  Synthetic
ugggagaaggcgaggagacu

SEQ ID NO: 46439 - RNA, 20 nt, Artificial Sequence
  Synthetic
aagggagggaggaggguacu

SEQ ID NO: 46440 - RNA, 20 nt, Artificial Sequence
  Synthetic
cgccgcccacccacccaccu

SEQ ID NO: 46441 - RNA, 20 nt, Artificial Sequence
  Synthetic
augcuugggucuuacugccu

SEQ ID NO: 46442 - RNA, 20 nt, Artificial Sequence
  Synthetic
gggaacgggggaccggggcu

SEQ ID NO: 46443 - RNA, 20 nt, Artificial Sequence
  Synthetic
gucuguucuugcguguggcu

SEQ ID NO: 46444 - RNA, 20 nt, Artificial Sequence
  Synthetic
ugugccuggcucucuaugcu

SEQ ID NO: 46445 - RNA, 20 nt, Artificial Sequence
  Synthetic
cguggccgaccuuagccucu

SEQ ID NO: 46446 - RNA, 20 nt, Artificial Sequence
  Synthetic
gggugggacacaugccuucu

SEQ ID NO: 46447 - RNA, 20 nt, Artificial Sequence
  Synthetic
cccuuagauaagggggcagu

SEQ ID NO: 46448 - RNA, 20 nt, Artificial Sequence
  Synthetic
gucgaucgaccgggcucagu

SEQ ID NO: 46449 - RNA, 20 nt, Artificial Sequence
  Synthetic
ccggggcgcccucgacgagu

SEQ ID NO: 46450 - RNA, 20 nt, Artificial Sequence
  Synthetic
caugccuucuuggaguacgu

SEQ ID NO: 46451 - RNA, 20 nt, Artificial Sequence
  Synthetic
aacaccccgccgcuuuccgu

SEQ ID NO: 46452 - RNA, 20 nt, Artificial Sequence
  Synthetic
cggggcaggggcgggggcgu

SEQ ID NO: 46453 - RNA, 20 nt, Artificial Sequence
  Synthetic
accgggcucagugggggcgu

SEQ ID NO: 46454 - RNA, 20 nt, Artificial Sequence
  Synthetic
aguacgugggucauuggcgu

SEQ ID NO: 46455 - RNA, 20 nt, Artificial Sequence
  Synthetic
ggcgccccagaggcuaaggu

SEQ ID NO: 46456 - RNA, 20 nt, Artificial Sequence
  Synthetic
aagacgccgcguuuccaggu

SEQ ID NO: 46457 - RNA, 20 nt, Artificial Sequence
  Synthetic
ggggcuggguaucccgaggu

SEQ ID NO: 46458 - RNA, 20 nt, Artificial Sequence
  Synthetic
acuggggugggggugucggu

SEQ ID NO: 46459 - RNA, 20 nt, Artificial Sequence
  Synthetic
aacagagucugacuaagggu

SEQ ID NO: 46460 - RNA, 20 nt, Artificial Sequence
  Synthetic
cggccacgccacucgcgggu

SEQ ID NO: 46461 - RNA, 20 nt, Artificial Sequence
  Synthetic
cacaaaaacacaggcggggu

SEQ ID NO: 46462 - RNA, 20 nt, Artificial Sequence
  Synthetic
cuggaagaccgccagggggu

SEQ ID NO: 46463 - RNA, 20 nt, Artificial Sequence
  Synthetic
gaaggcgaggagacuggggu

SEQ ID NO: 46464 - RNA, 20 nt, Artificial Sequence
  Synthetic
gcucagugggggcguggggu

SEQ ID NO: 46465 - RNA, 20 nt, Artificial Sequence
  Synthetic
cuggguaucccgaggugggu

SEQ ID NO: 46466 - RNA, 20 nt, Artificial Sequence
  Synthetic
agugggggcguggggugggu

SEQ ID NO: 46467 - RNA, 20 nt, Artificial Sequence
  Synthetic
guaucccgaggugggugggu

SEQ ID NO: 46468 - RNA, 20 nt, Artificial Sequence
  Synthetic
auaagggggcaguugguggu

SEQ ID NO: 46469 - RNA, 20 nt, Artificial Sequence
  Synthetic
uuauuuaaauaaaccaaugu

SEQ ID NO: 46470 - RNA, 20 nt, Artificial Sequence
  Synthetic
guggcugggggcuuauaugu

SEQ ID NO: 46471 - RNA, 20 nt, Artificial Sequence
  Synthetic
aacggaaagcggcggggugu

SEQ ID NO: 46472 - RNA, 20 nt, Artificial Sequence
  Synthetic
ggagacuggggugggggugu

SEQ ID NO: 46473 - RNA, 20 nt, Artificial Sequence
  Synthetic
guugggguuguuauuguugu

SEQ ID NO: 46474 - RNA, 20 nt, Artificial Sequence
  Synthetic
uuggguccccccccucuauu

SEQ ID NO: 46475 - RNA, 20 nt, Artificial Sequence
  Synthetic
gugccuggcucucuaugcuu

SEQ ID NO: 46476 - RNA, 20 nt, Artificial Sequence
  Synthetic
acaccccgccgcuuuccguu

SEQ ID NO: 46477 - RNA, 20 nt, Artificial Sequence
  Synthetic
cuggggcgcccccugucguu

SEQ ID NO: 46478 - RNA, 20 nt, Artificial Sequence
  Synthetic
acggaaagcggcgggguguu

SEQ ID NO: 46479 - RNA, 20 nt, Artificial Sequence
  Synthetic
uggggcgcccccugucguuu

SEQ ID NO: 46480 - RNA, 22 nt, Artificial Sequence
  Synthetic
gccccugucugcagagcacuua

SEQ ID NO: 46481 - RNA, 24 nt, Artificial Sequence
  Synthetic
gugccccugucugcagagcacuua

SEQ ID NO: 46482 - RNA, 23 nt, Artificial Sequence
  Synthetic
gcaaaaacaggccacagcaccac

SEQ ID NO: 46483 - RNA, 20 nt, Artificial Sequence
  Synthetic
gccggccguuggcgguaacc

SEQ ID NO: 46484 - RNA, 21 nt, Artificial Sequence
  Synthetic
ggccggccguuggcgguaacc

SEQ ID NO: 46485 - RNA, 22 nt, Artificial Sequence
  Synthetic
gggccggccguuggcgguaacc

SEQ ID NO: 46486 - RNA, 23 nt, Artificial Sequence
  Synthetic
ggggccggccguuggcgguaacc

SEQ ID NO: 46487 - RNA, 24 nt, Artificial Sequence
  Synthetic
gggggccggccguuggcgguaacc

SEQ ID NO: 46488 - RNA, 21 nt, Artificial Sequence
  Synthetic
ggggccccgggccggggcccc

SEQ ID NO: 46489 - RNA, 23 nt, Artificial Sequence
  Synthetic
guggggccccgggccggggcccc

SEQ ID NO: 46490 - RNA, 22 nt, Artificial Sequence
  Synthetic
gacggaacgaaaaacaccccag

SEQ ID NO: 46491 - RNA, 24 nt, Artificial Sequence
  Synthetic
gcgacggaacgaaaaacaccccag

SEQ ID NO: 46492 - RNA, 21 nt, Artificial Sequence
  Synthetic
gggccggaggguggaaggcag

SEQ ID NO: 46493 - RNA, 22 nt, Artificial Sequence
  Synthetic
ggggccggaggguggaaggcag

SEQ ID NO: 46494 - RNA, 23 nt, Artificial Sequence
  Synthetic
gggggccggaggguggaaggcag

SEQ ID NO: 46495 - RNA, 24 nt, Artificial Sequence
  Synthetic
ggggggccggaggguggaaggcag

SEQ ID NO: 46496 - RNA, 18 nt, Artificial Sequence
  Synthetic
ggucucgguagccggccg

SEQ ID NO: 46497 - RNA, 22 nt, Artificial Sequence
  Synthetic
guucggucucgguagccggccg

SEQ ID NO: 46498 - RNA, 24 nt, Artificial Sequence
  Synthetic
guguucggucucgguagccggccg

SEQ ID NO: 46499 - RNA, 21 nt, Artificial Sequence
  Synthetic
ggguggacucgcggggggccg

SEQ ID NO: 46500 - RNA, 23 nt, Artificial Sequence
  Synthetic
gcggguggacucgcggggggccg

SEQ ID NO: 46501 - RNA, 24 nt, Artificial Sequence
  Synthetic
ggcggguggacucgcggggggccg

SEQ ID NO: 46502 - RNA, 22 nt, Artificial Sequence
  Synthetic
guggaaggcagggggguguagg

SEQ ID NO: 46503 - RNA, 23 nt, Artificial Sequence
  Synthetic
gguggaaggcagggggguguagg

SEQ ID NO: 46504 - RNA, 24 nt, Artificial Sequence
  Synthetic
ggguggaaggcagggggguguagg

SEQ ID NO: 46505 - RNA, 22 nt, Artificial Sequence
  Synthetic
gcggccggccggcgcuuagggg

SEQ ID NO: 46506 - RNA, 20 nt, Artificial Sequence
  Synthetic
gauacccacacgggcggggg

SEQ ID NO: 46507 - RNA, 21 nt, Artificial Sequence
  Synthetic
ggauacccacacgggcggggg

SEQ ID NO: 46508 - RNA, 24 nt, Artificial Sequence
  Synthetic
gccggauacccacacgggcggggg

SEQ ID NO: 46509 - RNA, 21 nt, Artificial Sequence
  Synthetic
ggaccggcgcggggcgggggg

SEQ ID NO: 46510 - RNA, 22 nt, Artificial Sequence
  Synthetic
gaggguggaaggcaggggggug

SEQ ID NO: 46511 - RNA, 23 nt, Artificial Sequence
  Synthetic
ggaggguggaaggcaggggggug

SEQ ID NO: 46512 - RNA, 21 nt, Artificial Sequence
  Synthetic
gccuuucugccucugccgcuu

SEQ ID NO: 46513 - RNA, 22 nt, Artificial Sequence
  Synthetic
ggccuuucugccucugccgcuu

SEQ ID NO: 46514 - RNA, 23 nt, Artificial Sequence
  Synthetic
gggccuuucugccucugccgcuu

SEQ ID NO: 46515 - RNA, 22 nt, Artificial Sequence
  Synthetic
gccuuccacccuccggcccccc

SEQ ID NO: 46516 - RNA, 19 nt, Artificial Sequence
  Synthetic
guguuuuucguuccgucgc

SEQ ID NO: 46517 - RNA, 20 nt, Artificial Sequence
  Synthetic
gguguuuuucguuccgucgc

SEQ ID NO: 46518 - RNA, 21 nt, Artificial Sequence
  Synthetic
ggguguuuuucguuccgucgc

SEQ ID NO: 46519 - RNA, 22 nt, Artificial Sequence
  Synthetic
gggguguuuuucguuccgucgc

SEQ ID NO: 46520 - RNA, 22 nt, Artificial Sequence
  Synthetic
guuucuguuucuuuaacccguc

SEQ ID NO: 46521 - RNA, 23 nt, Artificial Sequence
  Synthetic
gguuucuguuucuuuaacccguc

SEQ ID NO: 46522 - RNA, 22 nt, Artificial Sequence
  Synthetic
guuuuuucguuuuccccguuuc

SEQ ID NO: 46523 - RNA, 18 nt, Artificial Sequence
  Synthetic
gaacaaccgaggggaacg

SEQ ID NO: 46524 - RNA, 19 nt, Artificial Sequence
  Synthetic
ggaacaaccgaggggaacg

SEQ ID NO: 46525 - RNA, 23 nt, Artificial Sequence
  Synthetic
gcccggggccugagaugaacacu

SEQ ID NO: 46526 - RNA, 24 nt, Artificial Sequence
  Synthetic
ggcccggggccugagaugaacacu

SEQ ID NO: 46527 - RNA, 22 nt, Artificial Sequence
  Synthetic
gcgacaccccccccccgcccgu

SEQ ID NO: 46528 - RNA, 20 nt, Artificial Sequence
  Synthetic
gaaagacuuuccgggcgcgu

SEQ ID NO: 46529 - RNA, 22 nt, Artificial Sequence
  Synthetic
gcgaaagacuuuccgggcgcgu

SEQ ID NO: 46530 - RNA, 24 nt, Artificial Sequence
  Synthetic
gugcgaaagacuuuccgggcgcgu

SEQ ID NO: 46531 - RNA, 23 nt, Artificial Sequence
  Synthetic
guuuuccccguuucggggguggu

SEQ ID NO: 46532 - RNA, 18 nt, Artificial Sequence
  Synthetic
ggccccccggaggcuuuu

SEQ ID NO: 46533 - RNA, 24 nt, Artificial Sequence
  Synthetic
gaaaaaggccccccggaggcuuuu

SEQ ID NO: 46534 - RNA, 18 nt, Artificial Sequence
  Synthetic
cgcgucgcgugccggcga

SEQ ID NO: 46535 - RNA, 19 nt, Artificial Sequence
  Synthetic
ucgcgucgcgugccggcga

SEQ ID NO: 46536 - RNA, 20 nt, Artificial Sequence
  Synthetic
uucgcgucgcgugccggcga

SEQ ID NO: 46537 - RNA, 21 nt, Artificial Sequence
  Synthetic
uuucgcgucgcgugccggcga

SEQ ID NO: 46538 - RNA, 22 nt, Artificial Sequence
  Synthetic
uuuucgcgucgcgugccggcga

SEQ ID NO: 46539 - RNA, 23 nt, Artificial Sequence
  Synthetic
uuuuucgcgucgcgugccggcga

SEQ ID NO: 46540 - RNA, 24 nt, Artificial Sequence
  Synthetic
cuuuuucgcgucgcgugccggcga

SEQ ID NO: 46541 - RNA, 18 nt, Artificial Sequence
  Synthetic
uuccucgucugcggccua

SEQ ID NO: 46542 - RNA, 19 nt, Artificial Sequence
  Synthetic
uuuccucgucugcggccua

SEQ ID NO: 46543 - RNA, 20 nt, Artificial Sequence
  Synthetic
uuuuccucgucugcggccua

SEQ ID NO: 46544 - RNA, 21 nt, Artificial Sequence
  Synthetic
auuuuccucgucugcggccua

SEQ ID NO: 46545 - RNA, 22 nt, Artificial Sequence
  Synthetic
uauuuuccucgucugcggccua

SEQ ID NO: 46546 - RNA, 23 nt, Artificial Sequence
  Synthetic
uuauuuuccucgucugcggccua

SEQ ID NO: 46547 - RNA, 24 nt, Artificial Sequence
  Synthetic
uuuauuuuccucgucugcggccua

SEQ ID NO: 46548 - RNA, 21 nt, Artificial Sequence
  Synthetic
ccccugucugcagagcacuua

SEQ ID NO: 46549 - RNA, 23 nt, Artificial Sequence
  Synthetic
ugccccugucugcagagcacuua

SEQ ID NO: 46550 - RNA, 21 nt, Artificial Sequence
  Synthetic
aaaaacaggccacagcaccac

SEQ ID NO: 46551 - RNA, 22 nt, Artificial Sequence
  Synthetic
caaaaacaggccacagcaccac

SEQ ID NO: 46552 - RNA, 24 nt, Artificial Sequence
  Synthetic
agcaaaaacaggccacagcaccac

SEQ ID NO: 46553 - RNA, 18 nt, Artificial Sequence
  Synthetic
cggccguuggcgguaacc

SEQ ID NO: 46554 - RNA, 19 nt, Artificial Sequence
  Synthetic
ccggccguuggcgguaacc

SEQ ID NO: 46555 - RNA, 22 nt, Artificial Sequence
  Synthetic
uggggccccgggccggggcccc

SEQ ID NO: 46556 - RNA, 24 nt, Artificial Sequence
  Synthetic
uguggggccccgggccggggcccc

SEQ ID NO: 46557 - RNA, 21 nt, Artificial Sequence
  Synthetic
acggaacgaaaaacaccccag

SEQ ID NO: 46558 - RNA, 23 nt, Artificial Sequence
  Synthetic
cgacggaacgaaaaacaccccag

SEQ ID NO: 46559 - RNA, 19 nt, Artificial Sequence
  Synthetic
cggucucgguagccggccg

SEQ ID NO: 46560 - RNA, 20 nt, Artificial Sequence
  Synthetic
ucggucucgguagccggccg

SEQ ID NO: 46561 - RNA, 21 nt, Artificial Sequence
  Synthetic
uucggucucgguagccggccg

SEQ ID NO: 46562 - RNA, 23 nt, Artificial Sequence
  Synthetic
uguucggucucgguagccggccg

SEQ ID NO: 46563 - RNA, 22 nt, Artificial Sequence
  Synthetic
cggguggacucgcggggggccg

SEQ ID NO: 46564 - RNA, 21 nt, Artificial Sequence
  Synthetic
uggaaggcagggggguguagg

SEQ ID NO: 46565 - RNA, 21 nt, Artificial Sequence
  Synthetic
cggccggccggcgcuuagggg

SEQ ID NO: 46566 - RNA, 23 nt, Artificial Sequence
  Synthetic
agcggccggccggcgcuuagggg

SEQ ID NO: 46567 - RNA, 24 nt, Artificial Sequence
  Synthetic
cagcggccggccggcgcuuagggg

SEQ ID NO: 46568 - RNA, 18 nt, Artificial Sequence
  Synthetic
uacccacacgggcggggg

SEQ ID NO: 46569 - RNA, 19 nt, Artificial Sequence
  Synthetic
auacccacacgggcggggg

SEQ ID NO: 46570 - RNA, 22 nt, Artificial Sequence
  Synthetic
cggauacccacacgggcggggg

SEQ ID NO: 46571 - RNA, 23 nt, Artificial Sequence
  Synthetic
ccggauacccacacgggcggggg

SEQ ID NO: 46572 - RNA, 22 nt, Artificial Sequence
  Synthetic
uggaccggcgcggggcgggggg

SEQ ID NO: 46573 - RNA, 23 nt, Artificial Sequence
  Synthetic
auggaccggcgcggggcgggggg

SEQ ID NO: 46574 - RNA, 24 nt, Artificial Sequence
  Synthetic
aauggaccggcgcggggcgggggg

SEQ ID NO: 46575 - RNA, 21 nt, Artificial Sequence
  Synthetic
aggguggaaggcaggggggug

SEQ ID NO: 46576 - RNA, 24 nt, Artificial Sequence
  Synthetic
cggaggguggaaggcaggggggug

SEQ ID NO: 46577 - RNA, 24 nt, Artificial Sequence
  Synthetic
ugggccuuucugccucugccgcuu

SEQ ID NO: 46578 - RNA, 21 nt, Artificial Sequence
  Synthetic
ccuuccacccuccggcccccc

SEQ ID NO: 46579 - RNA, 23 nt, Artificial Sequence
  Synthetic
ugccuuccacccuccggcccccc

SEQ ID NO: 46580 - RNA, 24 nt, Artificial Sequence
  Synthetic
cugccuuccacccuccggcccccc

SEQ ID NO: 46581 - RNA, 21 nt, Artificial Sequence
  Synthetic
agcggcagaggcagaaaggcc

SEQ ID NO: 46582 - RNA, 22 nt, Artificial Sequence
  Synthetic
aagcggcagaggcagaaaggcc

SEQ ID NO: 46583 - RNA, 23 nt, Artificial Sequence
  Synthetic
caagcggcagaggcagaaaggcc

SEQ ID NO: 46584 - RNA, 24 nt, Artificial Sequence
  Synthetic
acaagcggcagaggcagaaaggcc

SEQ ID NO: 46585 - RNA, 18 nt, Artificial Sequence
  Synthetic
uguuuuucguuccgucgc

SEQ ID NO: 46586 - RNA, 23 nt, Artificial Sequence
  Synthetic
ugggguguuuuucguuccgucgc

SEQ ID NO: 46587 - RNA, 24 nt, Artificial Sequence
  Synthetic
cugggguguuuuucguuccgucgc

SEQ ID NO: 46588 - RNA, 18 nt, Artificial Sequence
  Synthetic
cuguuucuuuaacccguc

SEQ ID NO: 46589 - RNA, 19 nt, Artificial Sequence
  Synthetic
ucuguuucuuuaacccguc

SEQ ID NO: 46590 - RNA, 20 nt, Artificial Sequence
  Synthetic
uucuguuucuuuaacccguc

SEQ ID NO: 46591 - RNA, 21 nt, Artificial Sequence
  Synthetic
uuucuguuucuuuaacccguc

SEQ ID NO: 46592 - RNA, 24 nt, Artificial Sequence
  Synthetic
cgguuucuguuucuuuaacccguc

SEQ ID NO: 46593 - RNA, 18 nt, Artificial Sequence
  Synthetic
uuucguuuuccccguuuc

SEQ ID NO: 46594 - RNA, 19 nt, Artificial Sequence
  Synthetic
uuuucguuuuccccguuuc

SEQ ID NO: 46595 - RNA, 20 nt, Artificial Sequence
  Synthetic
uuuuucguuuuccccguuuc

SEQ ID NO: 46596 - RNA, 21 nt, Artificial Sequence
  Synthetic
uuuuuucguuuuccccguuuc

SEQ ID NO: 46597 - RNA, 23 nt, Artificial Sequence
  Synthetic
uguuuuuucguuuuccccguuuc

SEQ ID NO: 46598 - RNA, 24 nt, Artificial Sequence
  Synthetic
cuguuuuuucguuuuccccguuuc

SEQ ID NO: 46599 - RNA, 20 nt, Artificial Sequence
  Synthetic
aggaacaaccgaggggaacg

SEQ ID NO: 46600 - RNA, 21 nt, Artificial Sequence
  Synthetic
ccggggccugagaugaacacu

SEQ ID NO: 46601 - RNA, 22 nt, Artificial Sequence
  Synthetic
cccggggccugagaugaacacu

SEQ ID NO: 46602 - RNA, 21 nt, Artificial Sequence
  Synthetic
cgacaccccccccccgcccgu

SEQ ID NO: 46603 - RNA, 23 nt, Artificial Sequence
  Synthetic
cgcgacaccccccccccgcccgu

SEQ ID NO: 46604 - RNA, 24 nt, Artificial Sequence
  Synthetic
ccgcgacaccccccccccgcccgu

SEQ ID NO: 46605 - RNA, 18 nt, Artificial Sequence
  Synthetic
aagacuuuccgggcgcgu

SEQ ID NO: 46606 - RNA, 19 nt, Artificial Sequence
  Synthetic
aaagacuuuccgggcgcgu

SEQ ID NO: 46607 - RNA, 21 nt, Artificial Sequence
  Synthetic
cgaaagacuuuccgggcgcgu

SEQ ID NO: 46608 - RNA, 23 nt, Artificial Sequence
  Synthetic
ugcgaaagacuuuccgggcgcgu

SEQ ID NO: 46609 - RNA, 18 nt, Artificial Sequence
  Synthetic
ccccguuucggggguggu

SEQ ID NO: 46610 - RNA, 19 nt, Artificial Sequence
  Synthetic
uccccguuucggggguggu

SEQ ID NO: 46611 - RNA, 20 nt, Artificial Sequence
  Synthetic
uuccccguuucggggguggu

SEQ ID NO: 46612 - RNA, 21 nt, Artificial Sequence
  Synthetic
uuuccccguuucggggguggu

SEQ ID NO: 46613 - RNA, 22 nt, Artificial Sequence
  Synthetic
uuuuccccguuucggggguggu

SEQ ID NO: 46614 - RNA, 24 nt, Artificial Sequence
  Synthetic
cguuuuccccguuucggggguggu

SEQ ID NO: 46615 - RNA, 19 nt, Artificial Sequence
  Synthetic
aggccccccggaggcuuuu

SEQ ID NO: 46616 - RNA, 20 nt, Artificial Sequence
  Synthetic
aaggccccccggaggcuuuu

SEQ ID NO: 46617 - RNA, 21 nt, Artificial Sequence
  Synthetic
aaaggccccccggaggcuuuu

SEQ ID NO: 46618 - RNA, 22 nt, Artificial Sequence
  Synthetic
aaaaggccccccggaggcuuuu

SEQ ID NO: 46619 - RNA, 23 nt, Artificial Sequence
  Synthetic
aaaaaggccccccggaggcuuuu

SEQ ID NO: 46620 - RNA, 18 nt, Artificial Sequence
  Synthetic
cugucugcagagcacuua

SEQ ID NO: 46621 - RNA, 19 nt, Artificial Sequence
  Synthetic
ccugucugcagagcacuua

SEQ ID NO: 46622 - RNA, 20 nt, Artificial Sequence
  Synthetic
cccugucugcagagcacuua

SEQ ID NO: 46623 - RNA, 18 nt, Artificial Sequence
  Synthetic
aacaggccacagcaccac

SEQ ID NO: 46624 - RNA, 19 nt, Artificial Sequence
  Synthetic
aaacaggccacagcaccac

SEQ ID NO: 46625 - RNA, 20 nt, Artificial Sequence
  Synthetic
aaaacaggccacagcaccac

SEQ ID NO: 46626 - RNA, 18 nt, Artificial Sequence
  Synthetic
gccccgggccggggcccc

SEQ ID NO: 46627 - RNA, 19 nt, Artificial Sequence
  Synthetic
ggccccgggccggggcccc

SEQ ID NO: 46628 - RNA, 20 nt, Artificial Sequence
  Synthetic
gggccccgggccggggcccc

SEQ ID NO: 46629 - RNA, 18 nt, Artificial Sequence
  Synthetic
gaacgaaaaacaccccag

SEQ ID NO: 46630 - RNA, 19 nt, Artificial Sequence
  Synthetic
ggaacgaaaaacaccccag

SEQ ID NO: 46631 - RNA, 20 nt, Artificial Sequence
  Synthetic
cggaacgaaaaacaccccag

SEQ ID NO: 46632 - RNA, 18 nt, Artificial Sequence
  Synthetic
ccggaggguggaaggcag

SEQ ID NO: 46633 - RNA, 19 nt, Artificial Sequence
  Synthetic
gccggaggguggaaggcag

SEQ ID NO: 46634 - RNA, 20 nt, Artificial Sequence
  Synthetic
ggccggaggguggaaggcag

SEQ ID NO: 46635 - RNA, 18 nt, Artificial Sequence
  Synthetic
uggacucgcggggggccg

SEQ ID NO: 46636 - RNA, 19 nt, Artificial Sequence
  Synthetic
guggacucgcggggggccg

SEQ ID NO: 46637 - RNA, 20 nt, Artificial Sequence
  Synthetic
gguggacucgcggggggccg

SEQ ID NO: 46638 - RNA, 18 nt, Artificial Sequence
  Synthetic
aaggcagggggguguagg

SEQ ID NO: 46639 - RNA, 19 nt, Artificial Sequence
  Synthetic
gaaggcagggggguguagg

SEQ ID NO: 46640 - RNA, 20 nt, Artificial Sequence
  Synthetic
ggaaggcagggggguguagg

SEQ ID NO: 46641 - RNA, 18 nt, Artificial Sequence
  Synthetic
ccggccggcgcuuagggg

SEQ ID NO: 46642 - RNA, 19 nt, Artificial Sequence
  Synthetic
gccggccggcgcuuagggg

SEQ ID NO: 46643 - RNA, 20 nt, Artificial Sequence
  Synthetic
ggccggccggcgcuuagggg

SEQ ID NO: 46644 - RNA, 18 nt, Artificial Sequence
  Synthetic
ccggcgcggggcgggggg

SEQ ID NO: 46645 - RNA, 19 nt, Artificial Sequence
  Synthetic
accggcgcggggcgggggg

SEQ ID NO: 46646 - RNA, 20 nt, Artificial Sequence
  Synthetic
gaccggcgcggggcgggggg

SEQ ID NO: 46647 - RNA, 18 nt, Artificial Sequence
  Synthetic
guggaaggcaggggggug

SEQ ID NO: 46648 - RNA, 19 nt, Artificial Sequence
  Synthetic
gguggaaggcaggggggug

SEQ ID NO: 46649 - RNA, 20 nt, Artificial Sequence
  Synthetic
ggguggaaggcaggggggug

SEQ ID NO: 46650 - RNA, 18 nt, Artificial Sequence
  Synthetic
uuucugccucugccgcuu

SEQ ID NO: 46651 - RNA, 19 nt, Artificial Sequence
  Synthetic
cuuucugccucugccgcuu

SEQ ID NO: 46652 - RNA, 20 nt, Artificial Sequence
  Synthetic
ccuuucugccucugccgcuu

SEQ ID NO: 46653 - RNA, 18 nt, Artificial Sequence
  Synthetic
uccacccuccggcccccc

SEQ ID NO: 46654 - RNA, 19 nt, Artificial Sequence
  Synthetic
uuccacccuccggcccccc

SEQ ID NO: 46655 - RNA, 20 nt, Artificial Sequence
  Synthetic
cuuccacccuccggcccccc

SEQ ID NO: 46656 - RNA, 18 nt, Artificial Sequence
  Synthetic
ggcagaggcagaaaggcc

SEQ ID NO: 46657 - RNA, 19 nt, Artificial Sequence
  Synthetic
cggcagaggcagaaaggcc

SEQ ID NO: 46658 - RNA, 20 nt, Artificial Sequence
  Synthetic
gcggcagaggcagaaaggcc

SEQ ID NO: 46659 - RNA, 18 nt, Artificial Sequence
  Synthetic
gggccugagaugaacacu

SEQ ID NO: 46660 - RNA, 19 nt, Artificial Sequence
  Synthetic
ggggccugagaugaacacu

SEQ ID NO: 46661 - RNA, 20 nt, Artificial Sequence
  Synthetic
cggggccugagaugaacacu

SEQ ID NO: 46662 - RNA, 18 nt, Artificial Sequence
  Synthetic
caccccccccccgcccgu

SEQ ID NO: 46663 - RNA, 19 nt, Artificial Sequence
  Synthetic
acaccccccccccgcccgu

SEQ ID NO: 46664 - RNA, 20 nt, Artificial Sequence
  Synthetic
gacaccccccccccgcccgu

SEQ ID NO: 46665 - RNA, 18 nt, Artificial Sequence
  Synthetic
ccagacggguuaaagaaa

SEQ ID NO: 46666 - RNA, 19 nt, Artificial Sequence
  Synthetic
cccagacggguuaaagaaa

SEQ ID NO: 46667 - RNA, 20 nt, Artificial Sequence
  Synthetic
ccccagacggguuaaagaaa

SEQ ID NO: 46668 - RNA, 21 nt, Artificial Sequence
  Synthetic
accccagacggguuaaagaaa

SEQ ID NO: 46669 - RNA, 22 nt, Artificial Sequence
  Synthetic
caccccagacggguuaaagaaa

SEQ ID NO: 46670 - RNA, 23 nt, Artificial Sequence
  Synthetic
acaccccagacggguuaaagaaa

SEQ ID NO: 46671 - RNA, 24 nt, Artificial Sequence
  Synthetic
aacaccccagacggguuaaagaaa

SEQ ID NO: 46672 - RNA, 18 nt, Artificial Sequence
  Synthetic
cccccaccacccccgaaa

SEQ ID NO: 46673 - RNA, 19 nt, Artificial Sequence
  Synthetic
acccccaccacccccgaaa

SEQ ID NO: 46674 - RNA, 20 nt, Artificial Sequence
  Synthetic
aacccccaccacccccgaaa

SEQ ID NO: 46675 - RNA, 21 nt, Artificial Sequence
  Synthetic
caacccccaccacccccgaaa

SEQ ID NO: 46676 - RNA, 22 nt, Artificial Sequence
  Synthetic
gcaacccccaccacccccgaaa

SEQ ID NO: 46677 - RNA, 23 nt, Artificial Sequence
  Synthetic
cgcaacccccaccacccccgaaa

SEQ ID NO: 46678 - RNA, 24 nt, Artificial Sequence
  Synthetic
ccgcaacccccaccacccccgaaa

SEQ ID NO: 46679 - RNA, 18 nt, Artificial Sequence
  Synthetic
acccccgaaacggggaaa

SEQ ID NO: 46680 - RNA, 19 nt, Artificial Sequence
  Synthetic
cacccccgaaacggggaaa

SEQ ID NO: 46681 - RNA, 20 nt, Artificial Sequence
  Synthetic
ccacccccgaaacggggaaa

SEQ ID NO: 46682 - RNA, 21 nt, Artificial Sequence
  Synthetic
accacccccgaaacggggaaa

SEQ ID NO: 46683 - RNA, 22 nt, Artificial Sequence
  Synthetic
caccacccccgaaacggggaaa

SEQ ID NO: 46684 - RNA, 23 nt, Artificial Sequence
  Synthetic
ccaccacccccgaaacggggaaa

SEQ ID NO: 46685 - RNA, 24 nt, Artificial Sequence
  Synthetic
cccaccacccccgaaacggggaaa

SEQ ID NO: 46686 - RNA, 18 nt, Artificial Sequence
  Synthetic
acccccaccacccccgaa

SEQ ID NO: 46687 - RNA, 19 nt, Artificial Sequence
  Synthetic
aacccccaccacccccgaa

SEQ ID NO: 46688 - RNA, 20 nt, Artificial Sequence
  Synthetic
caacccccaccacccccgaa

SEQ ID NO: 46689 - RNA, 21 nt, Artificial Sequence
  Synthetic
gcaacccccaccacccccgaa

SEQ ID NO: 46690 - RNA, 22 nt, Artificial Sequence
  Synthetic
cgcaacccccaccacccccgaa

SEQ ID NO: 46691 - RNA, 23 nt, Artificial Sequence
  Synthetic
ccgcaacccccaccacccccgaa

SEQ ID NO: 46692 - RNA, 24 nt, Artificial Sequence
  Synthetic
accgcaacccccaccacccccgaa

SEQ ID NO: 46693 - RNA, 18 nt, Artificial Sequence
  Synthetic
ccccgggccgggccgcca

SEQ ID NO: 46694 - RNA, 19 nt, Artificial Sequence
  Synthetic
gccccgggccgggccgcca

SEQ ID NO: 46695 - RNA, 20 nt, Artificial Sequence
  Synthetic
ggccccgggccgggccgcca

SEQ ID NO: 46696 - RNA, 21 nt, Artificial Sequence
  Synthetic
gggccccgggccgggccgcca

SEQ ID NO: 46697 - RNA, 22 nt, Artificial Sequence
  Synthetic
ggggccccgggccgggccgcca

SEQ ID NO: 46698 - RNA, 23 nt, Artificial Sequence
  Synthetic
cggggccccgggccgggccgcca

SEQ ID NO: 46699 - RNA, 24 nt, Artificial Sequence
  Synthetic
ccggggccccgggccgggccgcca

SEQ ID NO: 46700 - RNA, 18 nt, Artificial Sequence
  Synthetic
gccggaggguggaaggca

SEQ ID NO: 46701 - RNA, 19 nt, Artificial Sequence
  Synthetic
ggccggaggguggaaggca

SEQ ID NO: 46702 - RNA, 20 nt, Artificial Sequence
  Synthetic
gggccggaggguggaaggca

SEQ ID NO: 46703 - RNA, 21 nt, Artificial Sequence
  Synthetic
ggggccggaggguggaaggca

SEQ ID NO: 46704 - RNA, 22 nt, Artificial Sequence
  Synthetic
gggggccggaggguggaaggca

SEQ ID NO: 46705 - RNA, 23 nt, Artificial Sequence
  Synthetic
ggggggccggaggguggaaggca

SEQ ID NO: 46706 - RNA, 24 nt, Artificial Sequence
  Synthetic
cggggggccggaggguggaaggca

SEQ ID NO: 46707 - RNA, 18 nt, Artificial Sequence
  Synthetic
uuggccgccccggcugca

SEQ ID NO: 46708 - RNA, 19 nt, Artificial Sequence
  Synthetic
cuuggccgccccggcugca

SEQ ID NO: 46709 - RNA, 20 nt, Artificial Sequence
  Synthetic
ccuuggccgccccggcugca

SEQ ID NO: 46710 - RNA, 21 nt, Artificial Sequence
  Synthetic
cccuuggccgccccggcugca

SEQ ID NO: 46711 - RNA, 22 nt, Artificial Sequence
  Synthetic
ccccuuggccgccccggcugca

SEQ ID NO: 46712 - RNA, 23 nt, Artificial Sequence
  Synthetic
gccccuuggccgccccggcugca

SEQ ID NO: 46713 - RNA, 24 nt, Artificial Sequence
  Synthetic
cgccccuuggccgccccggcugca

SEQ ID NO: 46714 - RNA, 18 nt, Artificial Sequence
  Synthetic
ccgugaggggacagacga

SEQ ID NO: 46715 - RNA, 19 nt, Artificial Sequence
  Synthetic
cccgugaggggacagacga

SEQ ID NO: 46716 - RNA, 20 nt, Artificial Sequence
  Synthetic
ccccgugaggggacagacga

SEQ ID NO: 46717 - RNA, 21 nt, Artificial Sequence
  Synthetic
gccccgugaggggacagacga

SEQ ID NO: 46718 - RNA, 22 nt, Artificial Sequence
  Synthetic
cgccccgugaggggacagacga

SEQ ID NO: 46719 - RNA, 23 nt, Artificial Sequence
  Synthetic
ucgccccgugaggggacagacga

SEQ ID NO: 46720 - RNA, 24 nt, Artificial Sequence
  Synthetic
uucgccccgugaggggacagacga

SEQ ID NO: 46721 - RNA, 18 nt, Artificial Sequence
  Synthetic
aacgaaacauuccggcga

SEQ ID NO: 46722 - RNA, 19 nt, Artificial Sequence
  Synthetic
gaacgaaacauuccggcga

SEQ ID NO: 46723 - RNA, 20 nt, Artificial Sequence
  Synthetic
cgaacgaaacauuccggcga

SEQ ID NO: 46724 - RNA, 21 nt, Artificial Sequence
  Synthetic
acgaacgaaacauuccggcga

SEQ ID NO: 46725 - RNA, 22 nt, Artificial Sequence
  Synthetic
gacgaacgaaacauuccggcga

SEQ ID NO: 46726 - RNA, 23 nt, Artificial Sequence
  Synthetic
agacgaacgaaacauuccggcga

SEQ ID NO: 46727 - RNA, 24 nt, Artificial Sequence
  Synthetic
cagacgaacgaaacauuccggcga

SEQ ID NO: 46728 - RNA, 18 nt, Artificial Sequence
  Synthetic
aaacauuccggcgacgga

SEQ ID NO: 46729 - RNA, 19 nt, Artificial Sequence
  Synthetic
gaaacauuccggcgacgga

SEQ ID NO: 46730 - RNA, 20 nt, Artificial Sequence
  Synthetic
cgaaacauuccggcgacgga

SEQ ID NO: 46731 - RNA, 21 nt, Artificial Sequence
  Synthetic
acgaaacauuccggcgacgga

SEQ ID NO: 46732 - RNA, 22 nt, Artificial Sequence
  Synthetic
aacgaaacauuccggcgacgga

SEQ ID NO: 46733 - RNA, 23 nt, Artificial Sequence
  Synthetic
gaacgaaacauuccggcgacgga

SEQ ID NO: 46734 - RNA, 24 nt, Artificial Sequence
  Synthetic
cgaacgaaacauuccggcgacgga

SEQ ID NO: 46735 - RNA, 18 nt, Artificial Sequence
  Synthetic
ccggcgagcggguccgga

SEQ ID NO: 46736 - RNA, 19 nt, Artificial Sequence
  Synthetic
gccggcgagcggguccgga

SEQ ID NO: 46737 - RNA, 20 nt, Artificial Sequence
  Synthetic
ugccggcgagcggguccgga

SEQ ID NO: 46738 - RNA, 21 nt, Artificial Sequence
  Synthetic
gugccggcgagcggguccgga

SEQ ID NO: 46739 - RNA, 22 nt, Artificial Sequence
  Synthetic
cgugccggcgagcggguccgga

SEQ ID NO: 46740 - RNA, 23 nt, Artificial Sequence
  Synthetic
gcgugccggcgagcggguccgga

SEQ ID NO: 46741 - RNA, 24 nt, Artificial Sequence
  Synthetic
cgcgugccggcgagcggguccgga

SEQ ID NO: 46742 - RNA, 18 nt, Artificial Sequence
  Synthetic
gcggccuucgccccguga

SEQ ID NO: 46743 - RNA, 19 nt, Artificial Sequence
  Synthetic
cgcggccuucgccccguga

SEQ ID NO: 46744 - RNA, 20 nt, Artificial Sequence
  Synthetic
acgcggccuucgccccguga

SEQ ID NO: 46745 - RNA, 21 nt, Artificial Sequence
  Synthetic
uacgcggccuucgccccguga

SEQ ID NO: 46746 - RNA, 22 nt, Artificial Sequence
  Synthetic
guacgcggccuucgccccguga

SEQ ID NO: 46747 - RNA, 23 nt, Artificial Sequence
  Synthetic
cguacgcggccuucgccccguga

SEQ ID NO: 46748 - RNA, 24 nt, Artificial Sequence
  Synthetic
ccguacgcggccuucgccccguga

SEQ ID NO: 46749 - RNA, 18 nt, Artificial Sequence
  Synthetic
cgggcacgcgcgcccuua

SEQ ID NO: 46750 - RNA, 19 nt, Artificial Sequence
  Synthetic
gcgggcacgcgcgcccuua

SEQ ID NO: 46751 - RNA, 20 nt, Artificial Sequence
  Synthetic
cgcgggcacgcgcgcccuua

SEQ ID NO: 46752 - RNA, 21 nt, Artificial Sequence
  Synthetic
ucgcgggcacgcgcgcccuua

SEQ ID NO: 46753 - RNA, 22 nt, Artificial Sequence
  Synthetic
cucgcgggcacgcgcgcccuua

SEQ ID NO: 46754 - RNA, 23 nt, Artificial Sequence
  Synthetic
ucucgcgggcacgcgcgcccuua

SEQ ID NO: 46755 - RNA, 24 nt, Artificial Sequence
  Synthetic
aucucgcgggcacgcgcgcccuua

SEQ ID NO: 46756 - RNA, 18 nt, Artificial Sequence
  Synthetic
gcggccggccggcgcuua

SEQ ID NO: 46757 - RNA, 19 nt, Artificial Sequence
  Synthetic
agcggccggccggcgcuua

SEQ ID NO: 46758 - RNA, 20 nt, Artificial Sequence
  Synthetic
cagcggccggccggcgcuua

SEQ ID NO: 46759 - RNA, 21 nt, Artificial Sequence
  Synthetic
ccagcggccggccggcgcuua

SEQ ID NO: 46760 - RNA, 22 nt, Artificial Sequence
  Synthetic
accagcggccggccggcgcuua

SEQ ID NO: 46761 - RNA, 23 nt, Artificial Sequence
  Synthetic
gaccagcggccggccggcgcuua

SEQ ID NO: 46762 - RNA, 24 nt, Artificial Sequence
  Synthetic
agaccagcggccggccggcgcuua

SEQ ID NO: 46763 - RNA, 18 nt, Artificial Sequence
  Synthetic
aacaccccagacggguua

SEQ ID NO: 46764 - RNA, 19 nt, Artificial Sequence
  Synthetic
aaacaccccagacggguua

SEQ ID NO: 46765 - RNA, 20 nt, Artificial Sequence
  Synthetic
aaaacaccccagacggguua

SEQ ID NO: 46766 - RNA, 21 nt, Artificial Sequence
  Synthetic
aaaaacaccccagacggguua

SEQ ID NO: 46767 - RNA, 22 nt, Artificial Sequence
  Synthetic
gaaaaacaccccagacggguua

SEQ ID NO: 46768 - RNA, 23 nt, Artificial Sequence
  Synthetic
cgaaaaacaccccagacggguua

SEQ ID NO: 46769 - RNA, 24 nt, Artificial Sequence
  Synthetic
acgaaaaacaccccagacggguua

SEQ ID NO: 46770 - RNA, 18 nt, Artificial Sequence
  Synthetic
ccccaccacccccgaaac

SEQ ID NO: 46771 - RNA, 19 nt, Artificial Sequence
  Synthetic
cccccaccacccccgaaac

SEQ ID NO: 46772 - RNA, 20 nt, Artificial Sequence
  Synthetic
acccccaccacccccgaaac

SEQ ID NO: 46773 - RNA, 21 nt, Artificial Sequence
  Synthetic
aacccccaccacccccgaaac

SEQ ID NO: 46774 - RNA, 22 nt, Artificial Sequence
  Synthetic
caacccccaccacccccgaaac

SEQ ID NO: 46775 - RNA, 23 nt, Artificial Sequence
  Synthetic
gcaacccccaccacccccgaaac

SEQ ID NO: 46776 - RNA, 24 nt, Artificial Sequence
  Synthetic
cgcaacccccaccacccccgaaac

SEQ ID NO: 46777 - RNA, 18 nt, Artificial Sequence
  Synthetic
aggccccgggccgggaac

SEQ ID NO: 46778 - RNA, 19 nt, Artificial Sequence
  Synthetic
caggccccgggccgggaac

SEQ ID NO: 46779 - RNA, 20 nt, Artificial Sequence
  Synthetic
ucaggccccgggccgggaac

SEQ ID NO: 46780 - RNA, 21 nt, Artificial Sequence
  Synthetic
cucaggccccgggccgggaac

SEQ ID NO: 46781 - RNA, 22 nt, Artificial Sequence
  Synthetic
ucucaggccccgggccgggaac

SEQ ID NO: 46782 - RNA, 23 nt, Artificial Sequence
  Synthetic
aucucaggccccgggccgggaac

SEQ ID NO: 46783 - RNA, 24 nt, Artificial Sequence
  Synthetic
caucucaggccccgggccgggaac

SEQ ID NO: 46784 - RNA, 18 nt, Artificial Sequence
  Synthetic
ggggggccggauacccac

SEQ ID NO: 46785 - RNA, 19 nt, Artificial Sequence
  Synthetic
cggggggccggauacccac

SEQ ID NO: 46786 - RNA, 20 nt, Artificial Sequence
  Synthetic
gcggggggccggauacccac

SEQ ID NO: 46787 - RNA, 21 nt, Artificial Sequence
  Synthetic
ggcggggggccggauacccac

SEQ ID NO: 46788 - RNA, 22 nt, Artificial Sequence
  Synthetic
gggcggggggccggauacccac

SEQ ID NO: 46789 - RNA, 23 nt, Artificial Sequence
  Synthetic
ggggcggggggccggauacccac

SEQ ID NO: 46790 - RNA, 24 nt, Artificial Sequence
  Synthetic
cggggcggggggccggauacccac

SEQ ID NO: 46791 - RNA, 18 nt, Artificial Sequence
  Synthetic
cccgggccgggccgccac

SEQ ID NO: 46792 - RNA, 19 nt, Artificial Sequence
  Synthetic
ccccgggccgggccgccac

SEQ ID NO: 46793 - RNA, 20 nt, Artificial Sequence
  Synthetic
gccccgggccgggccgccac

SEQ ID NO: 46794 - RNA, 21 nt, Artificial Sequence
  Synthetic
ggccccgggccgggccgccac

SEQ ID NO: 46795 - RNA, 22 nt, Artificial Sequence
  Synthetic
gggccccgggccgggccgccac

SEQ ID NO: 46796 - RNA, 23 nt, Artificial Sequence
  Synthetic
ggggccccgggccgggccgccac

SEQ ID NO: 46797 - RNA, 24 nt, Artificial Sequence
  Synthetic
cggggccccgggccgggccgccac

SEQ ID NO: 46798 - RNA, 18 nt, Artificial Sequence
  Synthetic
cccggagagccgcggcac

SEQ ID NO: 46799 - RNA, 19 nt, Artificial Sequence
  Synthetic
gcccggagagccgcggcac

SEQ ID NO: 46800 - RNA, 20 nt, Artificial Sequence
  Synthetic
ggcccggagagccgcggcac

SEQ ID NO: 46801 - RNA, 21 nt, Artificial Sequence
  Synthetic
gggcccggagagccgcggcac

SEQ ID NO: 46802 - RNA, 22 nt, Artificial Sequence
  Synthetic
ggggcccggagagccgcggcac

SEQ ID NO: 46803 - RNA, 23 nt, Artificial Sequence
  Synthetic
gggggcccggagagccgcggcac

SEQ ID NO: 46804 - RNA, 24 nt, Artificial Sequence
  Synthetic
ggggggcccggagagccgcggcac

SEQ ID NO: 46805 - RNA, 18 nt, Artificial Sequence
  Synthetic
ggccccgggccgggaacc

SEQ ID NO: 46806 - RNA, 19 nt, Artificial Sequence
  Synthetic
aggccccgggccgggaacc

SEQ ID NO: 46807 - RNA, 20 nt, Artificial Sequence
  Synthetic
caggccccgggccgggaacc

SEQ ID NO: 46808 - RNA, 21 nt, Artificial Sequence
  Synthetic
ucaggccccgggccgggaacc

SEQ ID NO: 46809 - RNA, 22 nt, Artificial Sequence
  Synthetic
cucaggccccgggccgggaacc

SEQ ID NO: 46810 - RNA, 23 nt, Artificial Sequence
  Synthetic
ucucaggccccgggccgggaacc

SEQ ID NO: 46811 - RNA, 24 nt, Artificial Sequence
  Synthetic
aucucaggccccgggccgggaacc

SEQ ID NO: 46812 - RNA, 18 nt, Artificial Sequence
  Synthetic
ccgcaacccccaccaccc

SEQ ID NO: 46813 - RNA, 19 nt, Artificial Sequence
  Synthetic
accgcaacccccaccaccc

SEQ ID NO: 46814 - RNA, 20 nt, Artificial Sequence
  Synthetic
aaccgcaacccccaccaccc

SEQ ID NO: 46815 - RNA, 21 nt, Artificial Sequence
  Synthetic
aaaccgcaacccccaccaccc

SEQ ID NO: 46816 - RNA, 22 nt, Artificial Sequence
  Synthetic
gaaaccgcaacccccaccaccc

SEQ ID NO: 46817 - RNA, 23 nt, Artificial Sequence
  Synthetic
agaaaccgcaacccccaccaccc

SEQ ID NO: 46818 - RNA, 24 nt, Artificial Sequence
  Synthetic
cagaaaccgcaacccccaccaccc

SEQ ID NO: 46819 - RNA, 18 nt, Artificial Sequence
  Synthetic
guacgcggccuucgcccc

SEQ ID NO: 46820 - RNA, 19 nt, Artificial Sequence
  Synthetic
cguacgcggccuucgcccc

SEQ ID NO: 46821 - RNA, 20 nt, Artificial Sequence
  Synthetic
ccguacgcggccuucgcccc

SEQ ID NO: 46822 - RNA, 21 nt, Artificial Sequence
  Synthetic
gccguacgcggccuucgcccc

SEQ ID NO: 46823 - RNA, 22 nt, Artificial Sequence
  Synthetic
ggccguacgcggccuucgcccc

SEQ ID NO: 46824 - RNA, 23 nt, Artificial Sequence
  Synthetic
gggccguacgcggccuucgcccc

SEQ ID NO: 46825 - RNA, 24 nt, Artificial Sequence
  Synthetic
cgggccguacgcggccuucgcccc

SEQ ID NO: 46826 - RNA, 18 nt, Artificial Sequence
  Synthetic
gccccgggccgggccgcc

SEQ ID NO: 46827 - RNA, 19 nt, Artificial Sequence
  Synthetic
ggccccgggccgggccgcc

SEQ ID NO: 46828 - RNA, 20 nt, Artificial Sequence
  Synthetic
gggccccgggccgggccgcc

SEQ ID NO: 46829 - RNA, 21 nt, Artificial Sequence
  Synthetic
ggggccccgggccgggccgcc

SEQ ID NO: 46830 - RNA, 22 nt, Artificial Sequence
  Synthetic
cggggccccgggccgggccgcc

SEQ ID NO: 46831 - RNA, 23 nt, Artificial Sequence
  Synthetic
ccggggccccgggccgggccgcc

SEQ ID NO: 46832 - RNA, 24 nt, Artificial Sequence
  Synthetic
gccggggccccgggccgggccgcc

SEQ ID NO: 46833 - RNA, 18 nt, Artificial Sequence
  Synthetic
gcggcacccggacgcgcc

SEQ ID NO: 46834 - RNA, 19 nt, Artificial Sequence
  Synthetic
cgcggcacccggacgcgcc

SEQ ID NO: 46835 - RNA, 20 nt, Artificial Sequence
  Synthetic
ccgcggcacccggacgcgcc

SEQ ID NO: 46836 - RNA, 21 nt, Artificial Sequence
  Synthetic
gccgcggcacccggacgcgcc

SEQ ID NO: 46837 - RNA, 22 nt, Artificial Sequence
  Synthetic
agccgcggcacccggacgcgcc

SEQ ID NO: 46838 - RNA, 23 nt, Artificial Sequence
  Synthetic
gagccgcggcacccggacgcgcc

SEQ ID NO: 46839 - RNA, 24 nt, Artificial Sequence
  Synthetic
agagccgcggcacccggacgcgcc

SEQ ID NO: 46840 - RNA, 18 nt, Artificial Sequence
  Synthetic
gaguguucaucucaggcc

SEQ ID NO: 46841 - RNA, 19 nt, Artificial Sequence
  Synthetic
cgaguguucaucucaggcc

SEQ ID NO: 46842 - RNA, 20 nt, Artificial Sequence
  Synthetic
ccgaguguucaucucaggcc

SEQ ID NO: 46843 - RNA, 21 nt, Artificial Sequence
  Synthetic
cccgaguguucaucucaggcc

SEQ ID NO: 46844 - RNA, 22 nt, Artificial Sequence
  Synthetic
ccccgaguguucaucucaggcc

SEQ ID NO: 46845 - RNA, 23 nt, Artificial Sequence
  Synthetic
accccgaguguucaucucaggcc

SEQ ID NO: 46846 - RNA, 24 nt, Artificial Sequence
  Synthetic
aaccccgaguguucaucucaggcc

SEQ ID NO: 46847 - RNA, 18 nt, Artificial Sequence
  Synthetic
caucucaggccccgggcc

SEQ ID NO: 46848 - RNA, 19 nt, Artificial Sequence
  Synthetic
ucaucucaggccccgggcc

SEQ ID NO: 46849 - RNA, 20 nt, Artificial Sequence
  Synthetic
uucaucucaggccccgggcc

SEQ ID NO: 46850 - RNA, 21 nt, Artificial Sequence
  Synthetic
guucaucucaggccccgggcc

SEQ ID NO: 46851 - RNA, 22 nt, Artificial Sequence
  Synthetic
uguucaucucaggccccgggcc

SEQ ID NO: 46852 - RNA, 23 nt, Artificial Sequence
  Synthetic
guguucaucucaggccccgggcc

SEQ ID NO: 46853 - RNA, 24 nt, Artificial Sequence
  Synthetic
aguguucaucucaggccccgggcc

SEQ ID NO: 46854 - RNA, 18 nt, Artificial Sequence
  Synthetic
cuuggguccgccggggcc

SEQ ID NO: 46855 - RNA, 19 nt, Artificial Sequence
  Synthetic
ccuuggguccgccggggcc

SEQ ID NO: 46856 - RNA, 20 nt, Artificial Sequence
  Synthetic
cccuuggguccgccggggcc

SEQ ID NO: 46857 - RNA, 21 nt, Artificial Sequence
  Synthetic
ccccuuggguccgccggggcc

SEQ ID NO: 46858 - RNA, 22 nt, Artificial Sequence
  Synthetic
gccccuuggguccgccggggcc

SEQ ID NO: 46859 - RNA, 23 nt, Artificial Sequence
  Synthetic
ggccccuuggguccgccggggcc

SEQ ID NO: 46860 - RNA, 24 nt, Artificial Sequence
  Synthetic
gggccccuuggguccgccggggcc

SEQ ID NO: 46861 - RNA, 18 nt, Artificial Sequence
  Synthetic
cccggcugcaggggggcc

SEQ ID NO: 46862 - RNA, 19 nt, Artificial Sequence
  Synthetic
ccccggcugcaggggggcc

SEQ ID NO: 46863 - RNA, 20 nt, Artificial Sequence
  Synthetic
gccccggcugcaggggggcc

SEQ ID NO: 46864 - RNA, 21 nt, Artificial Sequence
  Synthetic
cgccccggcugcaggggggcc

SEQ ID NO: 46865 - RNA, 22 nt, Artificial Sequence
  Synthetic
ccgccccggcugcaggggggcc

SEQ ID NO: 46866 - RNA, 23 nt, Artificial Sequence
  Synthetic
gccgccccggcugcaggggggcc

SEQ ID NO: 46867 - RNA, 24 nt, Artificial Sequence
  Synthetic
ggccgccccggcugcaggggggcc

SEQ ID NO: 46868 - RNA, 18 nt, Artificial Sequence
  Synthetic
ccgggccguuguggggcc

SEQ ID NO: 46869 - RNA, 19 nt, Artificial Sequence
  Synthetic
gccgggccguuguggggcc

SEQ ID NO: 46870 - RNA, 20 nt, Artificial Sequence
  Synthetic
cgccgggccguuguggggcc

SEQ ID NO: 46871 - RNA, 21 nt, Artificial Sequence
  Synthetic
gcgccgggccguuguggggcc

SEQ ID NO: 46872 - RNA, 22 nt, Artificial Sequence
  Synthetic
ugcgccgggccguuguggggcc

SEQ ID NO: 46873 - RNA, 23 nt, Artificial Sequence
  Synthetic
augcgccgggccguuguggggcc

SEQ ID NO: 46874 - RNA, 24 nt, Artificial Sequence
  Synthetic
caugcgccgggccguuguggggcc

SEQ ID NO: 46875 - RNA, 18 nt, Artificial Sequence
  Synthetic
gaacccggaaaagccucc

SEQ ID NO: 46876 - RNA, 19 nt, Artificial Sequence
  Synthetic
ggaacccggaaaagccucc

SEQ ID NO: 46877 - RNA, 20 nt, Artificial Sequence
  Synthetic
gggaacccggaaaagccucc

SEQ ID NO: 46878 - RNA, 21 nt, Artificial Sequence
  Synthetic
cgggaacccggaaaagccucc

SEQ ID NO: 46879 - RNA, 22 nt, Artificial Sequence
  Synthetic
ccgggaacccggaaaagccucc

SEQ ID NO: 46880 - RNA, 23 nt, Artificial Sequence
  Synthetic
gccgggaacccggaaaagccucc

SEQ ID NO: 46881 - RNA, 24 nt, Artificial Sequence
  Synthetic
ggccgggaacccggaaaagccucc

SEQ ID NO: 46882 - RNA, 18 nt, Artificial Sequence
  Synthetic
ggggccccuuggguccgc

SEQ ID NO: 46883 - RNA, 19 nt, Artificial Sequence
  Synthetic
cggggccccuuggguccgc

SEQ ID NO: 46884 - RNA, 20 nt, Artificial Sequence
  Synthetic
ccggggccccuuggguccgc

SEQ ID NO: 46885 - RNA, 21 nt, Artificial Sequence
  Synthetic
gccggggccccuuggguccgc

SEQ ID NO: 46886 - RNA, 22 nt, Artificial Sequence
  Synthetic
ggccggggccccuuggguccgc

SEQ ID NO: 46887 - RNA, 23 nt, Artificial Sequence
  Synthetic
gggccggggccccuuggguccgc

SEQ ID NO: 46888 - RNA, 24 nt, Artificial Sequence
  Synthetic
cgggccggggccccuuggguccgc

SEQ ID NO: 46889 - RNA, 18 nt, Artificial Sequence
  Synthetic
cgcggcacccggacgcgc

SEQ ID NO: 46890 - RNA, 19 nt, Artificial Sequence
  Synthetic
ccgcggcacccggacgcgc

SEQ ID NO: 46891 - RNA, 20 nt, Artificial Sequence
  Synthetic
gccgcggcacccggacgcgc

SEQ ID NO: 46892 - RNA, 21 nt, Artificial Sequence
  Synthetic
agccgcggcacccggacgcgc

SEQ ID NO: 46893 - RNA, 22 nt, Artificial Sequence
  Synthetic
gagccgcggcacccggacgcgc

SEQ ID NO: 46894 - RNA, 23 nt, Artificial Sequence
  Synthetic
agagccgcggcacccggacgcgc

SEQ ID NO: 46895 - RNA, 24 nt, Artificial Sequence
  Synthetic
gagagccgcggcacccggacgcgc

SEQ ID NO: 46896 - RNA, 18 nt, Artificial Sequence
  Synthetic
gccggcggguggacucgc

SEQ ID NO: 46897 - RNA, 19 nt, Artificial Sequence
  Synthetic
ggccggcggguggacucgc

SEQ ID NO: 46898 - RNA, 20 nt, Artificial Sequence
  Synthetic
cggccggcggguggacucgc

SEQ ID NO: 46899 - RNA, 21 nt, Artificial Sequence
  Synthetic
ccggccggcggguggacucgc

SEQ ID NO: 46900 - RNA, 22 nt, Artificial Sequence
  Synthetic
gccggccggcggguggacucgc

SEQ ID NO: 46901 - RNA, 23 nt, Artificial Sequence
  Synthetic
agccggccggcggguggacucgc

SEQ ID NO: 46902 - RNA, 24 nt, Artificial Sequence
  Synthetic
uagccggccggcggguggacucgc

SEQ ID NO: 46903 - RNA, 18 nt, Artificial Sequence
  Synthetic
ggccggaggguggaaggc

SEQ ID NO: 46904 - RNA, 19 nt, Artificial Sequence
  Synthetic
gggccggaggguggaaggc

SEQ ID NO: 46905 - RNA, 20 nt, Artificial Sequence
  Synthetic
ggggccggaggguggaaggc

SEQ ID NO: 46906 - RNA, 21 nt, Artificial Sequence
  Synthetic
gggggccggaggguggaaggc

SEQ ID NO: 46907 - RNA, 22 nt, Artificial Sequence
  Synthetic
ggggggccggaggguggaaggc

SEQ ID NO: 46908 - RNA, 23 nt, Artificial Sequence
  Synthetic
cggggggccggaggguggaaggc

SEQ ID NO: 46909 - RNA, 24 nt, Artificial Sequence
  Synthetic
gcggggggccggaggguggaaggc

SEQ ID NO: 46910 - RNA, 18 nt, Artificial Sequence
  Synthetic
cgcccuuaauggaccggc

SEQ ID NO: 46911 - RNA, 19 nt, Artificial Sequence
  Synthetic
gcgcccuuaauggaccggc

SEQ ID NO: 46912 - RNA, 20 nt, Artificial Sequence
  Synthetic
cgcgcccuuaauggaccggc

SEQ ID NO: 46913 - RNA, 21 nt, Artificial Sequence
  Synthetic
gcgcgcccuuaauggaccggc

SEQ ID NO: 46914 - RNA, 22 nt, Artificial Sequence
  Synthetic
cgcgcgcccuuaauggaccggc

SEQ ID NO: 46915 - RNA, 23 nt, Artificial Sequence
  Synthetic
acgcgcgcccuuaauggaccggc

SEQ ID NO: 46916 - RNA, 24 nt, Artificial Sequence
  Synthetic
cacgcgcgcccuuaauggaccggc

SEQ ID NO: 46917 - RNA, 18 nt, Artificial Sequence
  Synthetic
ccggauacccacacgggc

SEQ ID NO: 46918 - RNA, 19 nt, Artificial Sequence
  Synthetic
gccggauacccacacgggc

SEQ ID NO: 46919 - RNA, 20 nt, Artificial Sequence
  Synthetic
ggccggauacccacacgggc

SEQ ID NO: 46920 - RNA, 21 nt, Artificial Sequence
  Synthetic
gggccggauacccacacgggc

SEQ ID NO: 46921 - RNA, 22 nt, Artificial Sequence
  Synthetic
ggggccggauacccacacgggc

SEQ ID NO: 46922 - RNA, 23 nt, Artificial Sequence
  Synthetic
gggggccggauacccacacgggc

SEQ ID NO: 46923 - RNA, 24 nt, Artificial Sequence
  Synthetic
ggggggccggauacccacacgggc

SEQ ID NO: 46924 - RNA, 18 nt, Artificial Sequence
  Synthetic
ucaucucaggccccgggc

SEQ ID NO: 46925 - RNA, 19 nt, Artificial Sequence
  Synthetic
uucaucucaggccccgggc

SEQ ID NO: 46926 - RNA, 20 nt, Artificial Sequence
  Synthetic
guucaucucaggccccgggc

SEQ ID NO: 46927 - RNA, 21 nt, Artificial Sequence
  Synthetic
uguucaucucaggccccgggc

SEQ ID NO: 46928 - RNA, 22 nt, Artificial Sequence
  Synthetic
guguucaucucaggccccgggc

SEQ ID NO: 46929 - RNA, 23 nt, Artificial Sequence
  Synthetic
aguguucaucucaggccccgggc

SEQ ID NO: 46930 - RNA, 24 nt, Artificial Sequence
  Synthetic
gaguguucaucucaggccccgggc

SEQ ID NO: 46931 - RNA, 18 nt, Artificial Sequence
  Synthetic
cguuguggggccccgggc

SEQ ID NO: 46932 - RNA, 19 nt, Artificial Sequence
  Synthetic
ccguuguggggccccgggc

SEQ ID NO: 46933 - RNA, 20 nt, Artificial Sequence
  Synthetic
gccguuguggggccccgggc

SEQ ID NO: 46934 - RNA, 21 nt, Artificial Sequence
  Synthetic
ggccguuguggggccccgggc

SEQ ID NO: 46935 - RNA, 22 nt, Artificial Sequence
  Synthetic
gggccguuguggggccccgggc

SEQ ID NO: 46936 - RNA, 23 nt, Artificial Sequence
  Synthetic
cgggccguuguggggccccgggc

SEQ ID NO: 46937 - RNA, 24 nt, Artificial Sequence
  Synthetic
ccgggccguuguggggccccgggc

SEQ ID NO: 46938 - RNA, 18 nt, Artificial Sequence
  Synthetic
agcggguccggacggggc

SEQ ID NO: 46939 - RNA, 19 nt, Artificial Sequence
  Synthetic
gagcggguccggacggggc

SEQ ID NO: 46940 - RNA, 20 nt, Artificial Sequence
  Synthetic
cgagcggguccggacggggc

SEQ ID NO: 46941 - RNA, 21 nt, Artificial Sequence
  Synthetic
gcgagcggguccggacggggc

SEQ ID NO: 46942 - RNA, 22 nt, Artificial Sequence
  Synthetic
ggcgagcggguccggacggggc

SEQ ID NO: 46943 - RNA, 23 nt, Artificial Sequence
  Synthetic
cggcgagcggguccggacggggc

SEQ ID NO: 46944 - RNA, 24 nt, Artificial Sequence
  Synthetic
ccggcgagcggguccggacggggc

SEQ ID NO: 46945 - RNA, 18 nt, Artificial Sequence
  Synthetic
aauggaccggcgcggggc

SEQ ID NO: 46946 - RNA, 19 nt, Artificial Sequence
  Synthetic
uaauggaccggcgcggggc

SEQ ID NO: 46947 - RNA, 20 nt, Artificial Sequence
  Synthetic
uuaauggaccggcgcggggc

SEQ ID NO: 46948 - RNA, 21 nt, Artificial Sequence
  Synthetic
cuuaauggaccggcgcggggc

SEQ ID NO: 46949 - RNA, 22 nt, Artificial Sequence
  Synthetic
ccuuaauggaccggcgcggggc

SEQ ID NO: 46950 - RNA, 23 nt, Artificial Sequence
  Synthetic
cccuuaauggaccggcgcggggc

SEQ ID NO: 46951 - RNA, 24 nt, Artificial Sequence
  Synthetic
gcccuuaauggaccggcgcggggc

SEQ ID NO: 46952 - RNA, 18 nt, Artificial Sequence
  Synthetic
ccccggcugcaggggggc

SEQ ID NO: 46953 - RNA, 19 nt, Artificial Sequence
  Synthetic
gccccggcugcaggggggc

SEQ ID NO: 46954 - RNA, 20 nt, Artificial Sequence
  Synthetic
cgccccggcugcaggggggc

SEQ ID NO: 46955 - RNA, 21 nt, Artificial Sequence
  Synthetic
ccgccccggcugcaggggggc

SEQ ID NO: 46956 - RNA, 22 nt, Artificial Sequence
  Synthetic
gccgccccggcugcaggggggc

SEQ ID NO: 46957 - RNA, 23 nt, Artificial Sequence
  Synthetic
ggccgccccggcugcaggggggc

SEQ ID NO: 46958 - RNA, 24 nt, Artificial Sequence
  Synthetic
uggccgccccggcugcaggggggc

SEQ ID NO: 46959 - RNA, 18 nt, Artificial Sequence
  Synthetic
gguggacucgcggggggc

SEQ ID NO: 46960 - RNA, 19 nt, Artificial Sequence
  Synthetic
ggguggacucgcggggggc

SEQ ID NO: 46961 - RNA, 20 nt, Artificial Sequence
  Synthetic
cggguggacucgcggggggc

SEQ ID NO: 46962 - RNA, 21 nt, Artificial Sequence
  Synthetic
gcggguggacucgcggggggc

SEQ ID NO: 46963 - RNA, 22 nt, Artificial Sequence
  Synthetic
ggcggguggacucgcggggggc

SEQ ID NO: 46964 - RNA, 23 nt, Artificial Sequence
  Synthetic
cggcggguggacucgcggggggc

SEQ ID NO: 46965 - RNA, 24 nt, Artificial Sequence
  Synthetic
ccggcggguggacucgcggggggc

SEQ ID NO: 46966 - RNA, 18 nt, Artificial Sequence
  Synthetic
cuuggccgccccggcugc

SEQ ID NO: 46967 - RNA, 19 nt, Artificial Sequence
  Synthetic
ccuuggccgccccggcugc

SEQ ID NO: 46968 - RNA, 20 nt, Artificial Sequence
  Synthetic
cccuuggccgccccggcugc

SEQ ID NO: 46969 - RNA, 21 nt, Artificial Sequence
  Synthetic
ccccuuggccgccccggcugc

SEQ ID NO: 46970 - RNA, 22 nt, Artificial Sequence
  Synthetic
gccccuuggccgccccggcugc

SEQ ID NO: 46971 - RNA, 23 nt, Artificial Sequence
  Synthetic
cgccccuuggccgccccggcugc

SEQ ID NO: 46972 - RNA, 24 nt, Artificial Sequence
  Synthetic
acgccccuuggccgccccggcugc

SEQ ID NO: 46973 - RNA, 18 nt, Artificial Sequence
  Synthetic
cggccggcggguggacuc

SEQ ID NO: 46974 - RNA, 19 nt, Artificial Sequence
  Synthetic
ccggccggcggguggacuc

SEQ ID NO: 46975 - RNA, 20 nt, Artificial Sequence
  Synthetic
gccggccggcggguggacuc

SEQ ID NO: 46976 - RNA, 21 nt, Artificial Sequence
  Synthetic
agccggccggcggguggacuc

SEQ ID NO: 46977 - RNA, 22 nt, Artificial Sequence
  Synthetic
uagccggccggcggguggacuc

SEQ ID NO: 46978 - RNA, 23 nt, Artificial Sequence
  Synthetic
guagccggccggcggguggacuc

SEQ ID NO: 46979 - RNA, 24 nt, Artificial Sequence
  Synthetic
gguagccggccggcggguggacuc

SEQ ID NO: 46980 - RNA, 18 nt, Artificial Sequence
  Synthetic
ggaacccggaaaagccuc

SEQ ID NO: 46981 - RNA, 19 nt, Artificial Sequence
  Synthetic
gggaacccggaaaagccuc

SEQ ID NO: 46982 - RNA, 20 nt, Artificial Sequence
  Synthetic
cgggaacccggaaaagccuc

SEQ ID NO: 46983 - RNA, 21 nt, Artificial Sequence
  Synthetic
ccgggaacccggaaaagccuc

SEQ ID NO: 46984 - RNA, 22 nt, Artificial Sequence
  Synthetic
gccgggaacccggaaaagccuc

SEQ ID NO: 46985 - RNA, 23 nt, Artificial Sequence
  Synthetic
ggccgggaacccggaaaagccuc

SEQ ID NO: 46986 - RNA, 24 nt, Artificial Sequence
  Synthetic
gggccgggaacccggaaaagccuc

SEQ ID NO: 46987 - RNA, 18 nt, Artificial Sequence
  Synthetic
uuaacggauugauaucuc

SEQ ID NO: 46988 - RNA, 19 nt, Artificial Sequence
  Synthetic
cuuaacggauugauaucuc

SEQ ID NO: 46989 - RNA, 20 nt, Artificial Sequence
  Synthetic
acuuaacggauugauaucuc

SEQ ID NO: 46990 - RNA, 21 nt, Artificial Sequence
  Synthetic
cacuuaacggauugauaucuc

SEQ ID NO: 46991 - RNA, 22 nt, Artificial Sequence
  Synthetic
gcacuuaacggauugauaucuc

SEQ ID NO: 46992 - RNA, 23 nt, Artificial Sequence
  Synthetic
agcacuuaacggauugauaucuc

SEQ ID NO: 46993 - RNA, 24 nt, Artificial Sequence
  Synthetic
gagcacuuaacggauugauaucuc

SEQ ID NO: 46994 - RNA, 18 nt, Artificial Sequence
  Synthetic
ggucgggggccccucguc

SEQ ID NO: 46995 - RNA, 19 nt, Artificial Sequence
  Synthetic
cggucgggggccccucguc

SEQ ID NO: 46996 - RNA, 20 nt, Artificial Sequence
  Synthetic
gcggucgggggccccucguc

SEQ ID NO: 46997 - RNA, 21 nt, Artificial Sequence
  Synthetic
cgcggucgggggccccucguc

SEQ ID NO: 46998 - RNA, 22 nt, Artificial Sequence
  Synthetic
ccgcggucgggggccccucguc

SEQ ID NO: 46999 - RNA, 23 nt, Artificial Sequence
  Synthetic
gccgcggucgggggccccucguc

SEQ ID NO: 47000 - RNA, 24 nt, Artificial Sequence
  Synthetic
cgccgcggucgggggccccucguc

SEQ ID NO: 47001 - RNA, 18 nt, Artificial Sequence
  Synthetic
gcccggaccgccgcgguc

SEQ ID NO: 47002 - RNA, 19 nt, Artificial Sequence
  Synthetic
ggcccggaccgccgcgguc

SEQ ID NO: 47003 - RNA, 20 nt, Artificial Sequence
  Synthetic
gggcccggaccgccgcgguc

SEQ ID NO: 47004 - RNA, 21 nt, Artificial Sequence
  Synthetic
ggggcccggaccgccgcgguc

SEQ ID NO: 47005 - RNA, 22 nt, Artificial Sequence
  Synthetic
cggggcccggaccgccgcgguc

SEQ ID NO: 47006 - RNA, 23 nt, Artificial Sequence
  Synthetic
acggggcccggaccgccgcgguc

SEQ ID NO: 47007 - RNA, 24 nt, Artificial Sequence
  Synthetic
gacggggcccggaccgccgcgguc

SEQ ID NO: 47008 - RNA, 18 nt, Artificial Sequence
  Synthetic
gggcgggggggggguguc

SEQ ID NO: 47009 - RNA, 19 nt, Artificial Sequence
  Synthetic
cgggcgggggggggguguc

SEQ ID NO: 47010 - RNA, 20 nt, Artificial Sequence
  Synthetic
acgggcgggggggggguguc

SEQ ID NO: 47011 - RNA, 21 nt, Artificial Sequence
  Synthetic
cacgggcgggggggggguguc

SEQ ID NO: 47012 - RNA, 22 nt, Artificial Sequence
  Synthetic
acacgggcgggggggggguguc

SEQ ID NO: 47013 - RNA, 23 nt, Artificial Sequence
  Synthetic
cacacgggcgggggggggguguc

SEQ ID NO: 47014 - RNA, 24 nt, Artificial Sequence
  Synthetic
ccacacgggcgggggggggguguc

SEQ ID NO: 47015 - RNA, 18 nt, Artificial Sequence
  Synthetic
cgccccgugaggggacag

SEQ ID NO: 47016 - RNA, 19 nt, Artificial Sequence
  Synthetic
ucgccccgugaggggacag

SEQ ID NO: 47017 - RNA, 20 nt, Artificial Sequence
  Synthetic
uucgccccgugaggggacag

SEQ ID NO: 47018 - RNA, 21 nt, Artificial Sequence
  Synthetic
cuucgccccgugaggggacag

SEQ ID NO: 47019 - RNA, 22 nt, Artificial Sequence
  Synthetic
ccuucgccccgugaggggacag

SEQ ID NO: 47020 - RNA, 23 nt, Artificial Sequence
  Synthetic
gccuucgccccgugaggggacag

SEQ ID NO: 47021 - RNA, 24 nt, Artificial Sequence
  Synthetic
ggccuucgccccgugaggggacag

SEQ ID NO: 47022 - RNA, 18 nt, Artificial Sequence
  Synthetic
uggccgccccggcugcag

SEQ ID NO: 47023 - RNA, 19 nt, Artificial Sequence
  Synthetic
uuggccgccccggcugcag

SEQ ID NO: 47024 - RNA, 20 nt, Artificial Sequence
  Synthetic
cuuggccgccccggcugcag

SEQ ID NO: 47025 - RNA, 21 nt, Artificial Sequence
  Synthetic
ccuuggccgccccggcugcag

SEQ ID NO: 47026 - RNA, 22 nt, Artificial Sequence
  Synthetic
cccuuggccgccccggcugcag

SEQ ID NO: 47027 - RNA, 23 nt, Artificial Sequence
  Synthetic
ccccuuggccgccccggcugcag

SEQ ID NO: 47028 - RNA, 24 nt, Artificial Sequence
  Synthetic
gccccuuggccgccccggcugcag

SEQ ID NO: 47029 - RNA, 18 nt, Artificial Sequence
  Synthetic
cggccggccggcgcuuag

SEQ ID NO: 47030 - RNA, 19 nt, Artificial Sequence
  Synthetic
gcggccggccggcgcuuag

SEQ ID NO: 47031 - RNA, 20 nt, Artificial Sequence
  Synthetic
agcggccggccggcgcuuag

SEQ ID NO: 47032 - RNA, 21 nt, Artificial Sequence
  Synthetic
cagcggccggccggcgcuuag

SEQ ID NO: 47033 - RNA, 22 nt, Artificial Sequence
  Synthetic
ccagcggccggccggcgcuuag

SEQ ID NO: 47034 - RNA, 23 nt, Artificial Sequence
  Synthetic
accagcggccggccggcgcuuag

SEQ ID NO: 47035 - RNA, 24 nt, Artificial Sequence
  Synthetic
gaccagcggccggccggcgcuuag

SEQ ID NO: 47036 - RNA, 18 nt, Artificial Sequence
  Synthetic
cccaccacccccgaaacg

SEQ ID NO: 47037 - RNA, 19 nt, Artificial Sequence
  Synthetic
ccccaccacccccgaaacg

SEQ ID NO: 47038 - RNA, 20 nt, Artificial Sequence
  Synthetic
cccccaccacccccgaaacg

SEQ ID NO: 47039 - RNA, 21 nt, Artificial Sequence
  Synthetic
acccccaccacccccgaaacg

SEQ ID NO: 47040 - RNA, 22 nt, Artificial Sequence
  Synthetic
aacccccaccacccccgaaacg

SEQ ID NO: 47041 - RNA, 23 nt, Artificial Sequence
  Synthetic
caacccccaccacccccgaaacg

SEQ ID NO: 47042 - RNA, 24 nt, Artificial Sequence
  Synthetic
gcaacccccaccacccccgaaacg

SEQ ID NO: 47043 - RNA, 18 nt, Artificial Sequence
  Synthetic
cggcugcaggggggcccg

SEQ ID NO: 47044 - RNA, 19 nt, Artificial Sequence
  Synthetic
ccggcugcaggggggcccg

SEQ ID NO: 47045 - RNA, 20 nt, Artificial Sequence
  Synthetic
cccggcugcaggggggcccg

SEQ ID NO: 47046 - RNA, 21 nt, Artificial Sequence
  Synthetic
ccccggcugcaggggggcccg

SEQ ID NO: 47047 - RNA, 22 nt, Artificial Sequence
  Synthetic
gccccggcugcaggggggcccg

SEQ ID NO: 47048 - RNA, 23 nt, Artificial Sequence
  Synthetic
cgccccggcugcaggggggcccg

SEQ ID NO: 47049 - RNA, 24 nt, Artificial Sequence
  Synthetic
ccgccccggcugcaggggggcccg

SEQ ID NO: 47050 - RNA, 18 nt, Artificial Sequence
  Synthetic
uuuucgcgucgcgugccg

SEQ ID NO: 47051 - RNA, 19 nt, Artificial Sequence
  Synthetic
uuuuucgcgucgcgugccg

SEQ ID NO: 47052 - RNA, 20 nt, Artificial Sequence
  Synthetic
cuuuuucgcgucgcgugccg

SEQ ID NO: 47053 - RNA, 21 nt, Artificial Sequence
  Synthetic
ccuuuuucgcgucgcgugccg

SEQ ID NO: 47054 - RNA, 22 nt, Artificial Sequence
  Synthetic
gccuuuuucgcgucgcgugccg

SEQ ID NO: 47055 - RNA, 23 nt, Artificial Sequence
  Synthetic
ggccuuuuucgcgucgcgugccg

SEQ ID NO: 47056 - RNA, 24 nt, Artificial Sequence
  Synthetic
gggccuuuuucgcgucgcgugccg

SEQ ID NO: 47057 - RNA, 18 nt, Artificial Sequence
  Synthetic
aacccggaaaagccuccg

SEQ ID NO: 47058 - RNA, 19 nt, Artificial Sequence
  Synthetic
gaacccggaaaagccuccg

SEQ ID NO: 47059 - RNA, 20 nt, Artificial Sequence
  Synthetic
ggaacccggaaaagccuccg

SEQ ID NO: 47060 - RNA, 21 nt, Artificial Sequence
  Synthetic
gggaacccggaaaagccuccg

SEQ ID NO: 47061 - RNA, 22 nt, Artificial Sequence
  Synthetic
cgggaacccggaaaagccuccg

SEQ ID NO: 47062 - RNA, 23 nt, Artificial Sequence
  Synthetic
ccgggaacccggaaaagccuccg

SEQ ID NO: 47063 - RNA, 24 nt, Artificial Sequence
  Synthetic
gccgggaacccggaaaagccuccg

SEQ ID NO: 47064 - RNA, 18 nt, Artificial Sequence
  Synthetic
cggggccccuuggguccg

SEQ ID NO: 47065 - RNA, 19 nt, Artificial Sequence
  Synthetic
ccggggccccuuggguccg

SEQ ID NO: 47066 - RNA, 20 nt, Artificial Sequence
  Synthetic
gccggggccccuuggguccg

SEQ ID NO: 47067 - RNA, 21 nt, Artificial Sequence
  Synthetic
ggccggggccccuuggguccg

SEQ ID NO: 47068 - RNA, 22 nt, Artificial Sequence
  Synthetic
gggccggggccccuuggguccg

SEQ ID NO: 47069 - RNA, 23 nt, Artificial Sequence
  Synthetic
cgggccggggccccuuggguccg

SEQ ID NO: 47070 - RNA, 24 nt, Artificial Sequence
  Synthetic
ccgggccggggccccuuggguccg

SEQ ID NO: 47071 - RNA, 18 nt, Artificial Sequence
  Synthetic
ccggcggguggacucgcg

SEQ ID NO: 47072 - RNA, 19 nt, Artificial Sequence
  Synthetic
gccggcggguggacucgcg

SEQ ID NO: 47073 - RNA, 20 nt, Artificial Sequence
  Synthetic
ggccggcggguggacucgcg

SEQ ID NO: 47074 - RNA, 21 nt, Artificial Sequence
  Synthetic
cggccggcggguggacucgcg

SEQ ID NO: 47075 - RNA, 22 nt, Artificial Sequence
  Synthetic
ccggccggcggguggacucgcg

SEQ ID NO: 47076 - RNA, 23 nt, Artificial Sequence
  Synthetic
gccggccggcggguggacucgcg

SEQ ID NO: 47077 - RNA, 24 nt, Artificial Sequence
  Synthetic
agccggccggcggguggacucgcg

SEQ ID NO: 47078 - RNA, 18 nt, Artificial Sequence
  Synthetic
gcccuuaauggaccggcg

SEQ ID NO: 47079 - RNA, 19 nt, Artificial Sequence
  Synthetic
cgcccuuaauggaccggcg

SEQ ID NO: 47080 - RNA, 20 nt, Artificial Sequence
  Synthetic
gcgcccuuaauggaccggcg

SEQ ID NO: 47081 - RNA, 21 nt, Artificial Sequence
  Synthetic
cgcgcccuuaauggaccggcg

SEQ ID NO: 47082 - RNA, 22 nt, Artificial Sequence
  Synthetic
gcgcgcccuuaauggaccggcg

SEQ ID NO: 47083 - RNA, 23 nt, Artificial Sequence
  Synthetic
cgcgcgcccuuaauggaccggcg

SEQ ID NO: 47084 - RNA, 24 nt, Artificial Sequence
  Synthetic
acgcgcgcccuuaauggaccggcg

SEQ ID NO: 47085 - RNA, 18 nt, Artificial Sequence
  Synthetic
gaacgaaacauuccggcg

SEQ ID NO: 47086 - RNA, 19 nt, Artificial Sequence
  Synthetic
cgaacgaaacauuccggcg

SEQ ID NO: 47087 - RNA, 20 nt, Artificial Sequence
  Synthetic
acgaacgaaacauuccggcg

SEQ ID NO: 47088 - RNA, 21 nt, Artificial Sequence
  Synthetic
gacgaacgaaacauuccggcg

SEQ ID NO: 47089 - RNA, 22 nt, Artificial Sequence
  Synthetic
agacgaacgaaacauuccggcg

SEQ ID NO: 47090 - RNA, 23 nt, Artificial Sequence
  Synthetic
cagacgaacgaaacauuccggcg

SEQ ID NO: 47091 - RNA, 24 nt, Artificial Sequence
  Synthetic
acagacgaacgaaacauuccggcg

SEQ ID NO: 47092 - RNA, 18 nt, Artificial Sequence
  Synthetic
cggauacccacacgggcg

SEQ ID NO: 47093 - RNA, 19 nt, Artificial Sequence
  Synthetic
ccggauacccacacgggcg

SEQ ID NO: 47094 - RNA, 20 nt, Artificial Sequence
  Synthetic
gccggauacccacacgggcg

SEQ ID NO: 47095 - RNA, 21 nt, Artificial Sequence
  Synthetic
ggccggauacccacacgggcg

SEQ ID NO: 47096 - RNA, 22 nt, Artificial Sequence
  Synthetic
gggccggauacccacacgggcg

SEQ ID NO: 47097 - RNA, 23 nt, Artificial Sequence
  Synthetic
ggggccggauacccacacgggcg

SEQ ID NO: 47098 - RNA, 24 nt, Artificial Sequence
  Synthetic
gggggccggauacccacacgggcg

SEQ ID NO: 47099 - RNA, 18 nt, Artificial Sequence
  Synthetic
auggaccggcgcggggcg

SEQ ID NO: 47100 - RNA, 19 nt, Artificial Sequence
  Synthetic
aauggaccggcgcggggcg

SEQ ID NO: 47101 - RNA, 20 nt, Artificial Sequence
  Synthetic
uaauggaccggcgcggggcg

SEQ ID NO: 47102 - RNA, 21 nt, Artificial Sequence
  Synthetic
uuaauggaccggcgcggggcg

SEQ ID NO: 47103 - RNA, 22 nt, Artificial Sequence
  Synthetic
cuuaauggaccggcgcggggcg

SEQ ID NO: 47104 - RNA, 23 nt, Artificial Sequence
  Synthetic
ccuuaauggaccggcgcggggcg

SEQ ID NO: 47105 - RNA, 24 nt, Artificial Sequence
  Synthetic
cccuuaauggaccggcgcggggcg

SEQ ID NO: 47106 - RNA, 18 nt, Artificial Sequence
  Synthetic
ggccggcggguggacucg

SEQ ID NO: 47107 - RNA, 19 nt, Artificial Sequence
  Synthetic
cggccggcggguggacucg

SEQ ID NO: 47108 - RNA, 20 nt, Artificial Sequence
  Synthetic
ccggccggcggguggacucg

SEQ ID NO: 47109 - RNA, 21 nt, Artificial Sequence
  Synthetic
gccggccggcggguggacucg

SEQ ID NO: 47110 - RNA, 22 nt, Artificial Sequence
  Synthetic
agccggccggcggguggacucg

SEQ ID NO: 47111 - RNA, 23 nt, Artificial Sequence
  Synthetic
uagccggccggcggguggacucg

SEQ ID NO: 47112 - RNA, 24 nt, Artificial Sequence
  Synthetic
guagccggccggcggguggacucg

SEQ ID NO: 47113 - RNA, 18 nt, Artificial Sequence
  Synthetic
cccccgcuuuuauaaagg

SEQ ID NO: 47114 - RNA, 19 nt, Artificial Sequence
  Synthetic
gcccccgcuuuuauaaagg

SEQ ID NO: 47115 - RNA, 20 nt, Artificial Sequence
  Synthetic
cgcccccgcuuuuauaaagg

SEQ ID NO: 47116 - RNA, 21 nt, Artificial Sequence
  Synthetic
gcgcccccgcuuuuauaaagg

SEQ ID NO: 47117 - RNA, 22 nt, Artificial Sequence
  Synthetic
cgcgcccccgcuuuuauaaagg

SEQ ID NO: 47118 - RNA, 23 nt, Artificial Sequence
  Synthetic
ccgcgcccccgcuuuuauaaagg

SEQ ID NO: 47119 - RNA, 24 nt, Artificial Sequence
  Synthetic
gccgcgcccccgcuuuuauaaagg

SEQ ID NO: 47120 - RNA, 18 nt, Artificial Sequence
  Synthetic
gggccggaggguggaagg

SEQ ID NO: 47121 - RNA, 19 nt, Artificial Sequence
  Synthetic
ggggccggaggguggaagg

SEQ ID NO: 47122 - RNA, 20 nt, Artificial Sequence
  Synthetic
gggggccggaggguggaagg

SEQ ID NO: 47123 - RNA, 21 nt, Artificial Sequence
  Synthetic
ggggggccggaggguggaagg

SEQ ID NO: 47124 - RNA, 22 nt, Artificial Sequence
  Synthetic
cggggggccggaggguggaagg

SEQ ID NO: 47125 - RNA, 23 nt, Artificial Sequence
  Synthetic
gcggggggccggaggguggaagg

SEQ ID NO: 47126 - RNA, 24 nt, Artificial Sequence
  Synthetic
cgcggggggccggaggguggaagg

SEQ ID NO: 47127 - RNA, 18 nt, Artificial Sequence
  Synthetic
cucgcggggggccggagg

SEQ ID NO: 47128 - RNA, 19 nt, Artificial Sequence
  Synthetic
acucgcggggggccggagg

SEQ ID NO: 47129 - RNA, 20 nt, Artificial Sequence
  Synthetic
gacucgcggggggccggagg

SEQ ID NO: 47130 - RNA, 21 nt, Artificial Sequence
  Synthetic
ggacucgcggggggccggagg

SEQ ID NO: 47131 - RNA, 22 nt, Artificial Sequence
  Synthetic
uggacucgcggggggccggagg

SEQ ID NO: 47132 - RNA, 23 nt, Artificial Sequence
  Synthetic
guggacucgcggggggccggagg

SEQ ID NO: 47133 - RNA, 24 nt, Artificial Sequence
  Synthetic
gguggacucgcggggggccggagg

SEQ ID NO: 47134 - RNA, 18 nt, Artificial Sequence
  Synthetic
ggccggccggcgcuuagg

SEQ ID NO: 47135 - RNA, 19 nt, Artificial Sequence
  Synthetic
cggccggccggcgcuuagg

SEQ ID NO: 47136 - RNA, 20 nt, Artificial Sequence
  Synthetic
gcggccggccggcgcuuagg

SEQ ID NO: 47137 - RNA, 21 nt, Artificial Sequence
  Synthetic
agcggccggccggcgcuuagg

SEQ ID NO: 47138 - RNA, 22 nt, Artificial Sequence
  Synthetic
cagcggccggccggcgcuuagg

SEQ ID NO: 47139 - RNA, 23 nt, Artificial Sequence
  Synthetic
ccagcggccggccggcgcuuagg

SEQ ID NO: 47140 - RNA, 24 nt, Artificial Sequence
  Synthetic
accagcggccggccggcgcuuagg

SEQ ID NO: 47141 - RNA, 18 nt, Artificial Sequence
  Synthetic
ggccggauacccacacgg

SEQ ID NO: 47142 - RNA, 19 nt, Artificial Sequence
  Synthetic
gggccggauacccacacgg

SEQ ID NO: 47143 - RNA, 20 nt, Artificial Sequence
  Synthetic
ggggccggauacccacacgg

SEQ ID NO: 47144 - RNA, 21 nt, Artificial Sequence
  Synthetic
gggggccggauacccacacgg

SEQ ID NO: 47145 - RNA, 22 nt, Artificial Sequence
  Synthetic
ggggggccggauacccacacgg

SEQ ID NO: 47146 - RNA, 23 nt, Artificial Sequence
  Synthetic
cggggggccggauacccacacgg

SEQ ID NO: 47147 - RNA, 24 nt, Artificial Sequence
  Synthetic
gcggggggccggauacccacacgg

SEQ ID NO: 47148 - RNA, 18 nt, Artificial Sequence
  Synthetic
gccggcgagcggguccgg

SEQ ID NO: 47149 - RNA, 19 nt, Artificial Sequence
  Synthetic
ugccggcgagcggguccgg

SEQ ID NO: 47150 - RNA, 20 nt, Artificial Sequence
  Synthetic
gugccggcgagcggguccgg

SEQ ID NO: 47151 - RNA, 21 nt, Artificial Sequence
  Synthetic
cgugccggcgagcggguccgg

SEQ ID NO: 47152 - RNA, 22 nt, Artificial Sequence
  Synthetic
gcgugccggcgagcggguccgg

SEQ ID NO: 47153 - RNA, 23 nt, Artificial Sequence
  Synthetic
cgcgugccggcgagcggguccgg

SEQ ID NO: 47154 - RNA, 24 nt, Artificial Sequence
  Synthetic
ucgcgugccggcgagcggguccgg

SEQ ID NO: 47155 - RNA, 18 nt, Artificial Sequence
  Synthetic
gggcccggaccgccgcgg

SEQ ID NO: 47156 - RNA, 19 nt, Artificial Sequence
  Synthetic
ggggcccggaccgccgcgg

SEQ ID NO: 47157 - RNA, 20 nt, Artificial Sequence
  Synthetic
cggggcccggaccgccgcgg

SEQ ID NO: 47158 - RNA, 21 nt, Artificial Sequence
  Synthetic
acggggcccggaccgccgcgg

SEQ ID NO: 47159 - RNA, 22 nt, Artificial Sequence
  Synthetic
gacggggcccggaccgccgcgg

SEQ ID NO: 47160 - RNA, 23 nt, Artificial Sequence
  Synthetic
ggacggggcccggaccgccgcgg

SEQ ID NO: 47161 - RNA, 24 nt, Artificial Sequence
  Synthetic
cggacggggcccggaccgccgcgg

SEQ ID NO: 47162 - RNA, 18 nt, Artificial Sequence
  Synthetic
ucgguagccggccggcgg

SEQ ID NO: 47163 - RNA, 19 nt, Artificial Sequence
  Synthetic
cucgguagccggccggcgg

SEQ ID NO: 47164 - RNA, 20 nt, Artificial Sequence
  Synthetic
ucucgguagccggccggcgg

SEQ ID NO: 47165 - RNA, 21 nt, Artificial Sequence
  Synthetic
gucucgguagccggccggcgg

SEQ ID NO: 47166 - RNA, 22 nt, Artificial Sequence
  Synthetic
ggucucgguagccggccggcgg

SEQ ID NO: 47167 - RNA, 23 nt, Artificial Sequence
  Synthetic
cggucucgguagccggccggcgg

SEQ ID NO: 47168 - RNA, 24 nt, Artificial Sequence
  Synthetic
ucggucucgguagccggccggcgg

SEQ ID NO: 47169 - RNA, 18 nt, Artificial Sequence
  Synthetic
ggauacccacacgggcgg

SEQ ID NO: 47170 - RNA, 19 nt, Artificial Sequence
  Synthetic
cggauacccacacgggcgg

SEQ ID NO: 47171 - RNA, 20 nt, Artificial Sequence
  Synthetic
ccggauacccacacgggcgg

SEQ ID NO: 47172 - RNA, 21 nt, Artificial Sequence
  Synthetic
gccggauacccacacgggcgg

SEQ ID NO: 47173 - RNA, 22 nt, Artificial Sequence
  Synthetic
ggccggauacccacacgggcgg

SEQ ID NO: 47174 - RNA, 23 nt, Artificial Sequence
  Synthetic
gggccggauacccacacgggcgg

SEQ ID NO: 47175 - RNA, 24 nt, Artificial Sequence
  Synthetic
ggggccggauacccacacgggcgg

SEQ ID NO: 47176 - RNA, 18 nt, Artificial Sequence
  Synthetic
ucgcggggggccggaggg

SEQ ID NO: 47177 - RNA, 19 nt, Artificial Sequence
  Synthetic
cucgcggggggccggaggg

SEQ ID NO: 47178 - RNA, 20 nt, Artificial Sequence
  Synthetic
acucgcggggggccggaggg

SEQ ID NO: 47179 - RNA, 21 nt, Artificial Sequence
  Synthetic
gacucgcggggggccggaggg

SEQ ID NO: 47180 - RNA, 22 nt, Artificial Sequence
  Synthetic
ggacucgcggggggccggaggg

SEQ ID NO: 47181 - RNA, 23 nt, Artificial Sequence
  Synthetic
uggacucgcggggggccggaggg

SEQ ID NO: 47182 - RNA, 24 nt, Artificial Sequence
  Synthetic
guggacucgcggggggccggaggg

SEQ ID NO: 47183 - RNA, 18 nt, Artificial Sequence
  Synthetic
gccggauacccacacggg

SEQ ID NO: 47184 - RNA, 19 nt, Artificial Sequence
  Synthetic
ggccggauacccacacggg

SEQ ID NO: 47185 - RNA, 20 nt, Artificial Sequence
  Synthetic
gggccggauacccacacggg

SEQ ID NO: 47186 - RNA, 21 nt, Artificial Sequence
  Synthetic
ggggccggauacccacacggg

SEQ ID NO: 47187 - RNA, 22 nt, Artificial Sequence
  Synthetic
gggggccggauacccacacggg

SEQ ID NO: 47188 - RNA, 23 nt, Artificial Sequence
  Synthetic
ggggggccggauacccacacggg

SEQ ID NO: 47189 - RNA, 24 nt, Artificial Sequence
  Synthetic
cggggggccggauacccacacggg

SEQ ID NO: 47190 - RNA, 18 nt, Artificial Sequence
  Synthetic
uucaucucaggccccggg

SEQ ID NO: 47191 - RNA, 19 nt, Artificial Sequence
  Synthetic
guucaucucaggccccggg

SEQ ID NO: 47192 - RNA, 20 nt, Artificial Sequence
  Synthetic
uguucaucucaggccccggg

SEQ ID NO: 47193 - RNA, 21 nt, Artificial Sequence
  Synthetic
guguucaucucaggccccggg

SEQ ID NO: 47194 - RNA, 22 nt, Artificial Sequence
  Synthetic
aguguucaucucaggccccggg

SEQ ID NO: 47195 - RNA, 23 nt, Artificial Sequence
  Synthetic
gaguguucaucucaggccccggg

SEQ ID NO: 47196 - RNA, 24 nt, Artificial Sequence
  Synthetic
cgaguguucaucucaggccccggg

SEQ ID NO: 47197 - RNA, 18 nt, Artificial Sequence
  Synthetic
guccgccggggccccggg

SEQ ID NO: 47198 - RNA, 19 nt, Artificial Sequence
  Synthetic
gguccgccggggccccggg

SEQ ID NO: 47199 - RNA, 20 nt, Artificial Sequence
  Synthetic
ggguccgccggggccccggg

SEQ ID NO: 47200 - RNA, 21 nt, Artificial Sequence
  Synthetic
uggguccgccggggccccggg

SEQ ID NO: 47201 - RNA, 22 nt, Artificial Sequence
  Synthetic
uuggguccgccggggccccggg

SEQ ID NO: 47202 - RNA, 23 nt, Artificial Sequence
  Synthetic
cuuggguccgccggggccccggg

SEQ ID NO: 47203 - RNA, 24 nt, Artificial Sequence
  Synthetic
ccuuggguccgccggggccccggg

SEQ ID NO: 47204 - RNA, 18 nt, Artificial Sequence
  Synthetic
ccguuguggggccccggg

SEQ ID NO: 47205 - RNA, 19 nt, Artificial Sequence
  Synthetic
gccguuguggggccccggg

SEQ ID NO: 47206 - RNA, 20 nt, Artificial Sequence
  Synthetic
ggccguuguggggccccggg

SEQ ID NO: 47207 - RNA, 21 nt, Artificial Sequence
  Synthetic
gggccguuguggggccccggg

SEQ ID NO: 47208 - RNA, 22 nt, Artificial Sequence
  Synthetic
cgggccguuguggggccccggg

SEQ ID NO: 47209 - RNA, 23 nt, Artificial Sequence
  Synthetic
ccgggccguuguggggccccggg

SEQ ID NO: 47210 - RNA, 24 nt, Artificial Sequence
  Synthetic
gccgggccguuguggggccccggg

SEQ ID NO: 47211 - RNA, 18 nt, Artificial Sequence
  Synthetic
uuaauggaccggcgcggg

SEQ ID NO: 47212 - RNA, 19 nt, Artificial Sequence
  Synthetic
cuuaauggaccggcgcggg

SEQ ID NO: 47213 - RNA, 20 nt, Artificial Sequence
  Synthetic
ccuuaauggaccggcgcggg

SEQ ID NO: 47214 - RNA, 21 nt, Artificial Sequence
  Synthetic
cccuuaauggaccggcgcggg

SEQ ID NO: 47215 - RNA, 22 nt, Artificial Sequence
  Synthetic
gcccuuaauggaccggcgcggg

SEQ ID NO: 47216 - RNA, 23 nt, Artificial Sequence
  Synthetic
cgcccuuaauggaccggcgcggg

SEQ ID NO: 47217 - RNA, 24 nt, Artificial Sequence
  Synthetic
gcgcccuuaauggaccggcgcggg

SEQ ID NO: 47218 - RNA, 18 nt, Artificial Sequence
  Synthetic
gauacccacacgggcggg

SEQ ID NO: 47219 - RNA, 19 nt, Artificial Sequence
  Synthetic
ggauacccacacgggcggg

SEQ ID NO: 47220 - RNA, 20 nt, Artificial Sequence
  Synthetic
cggauacccacacgggcggg

SEQ ID NO: 47221 - RNA, 21 nt, Artificial Sequence
  Synthetic
ccggauacccacacgggcggg

SEQ ID NO: 47222 - RNA, 22 nt, Artificial Sequence
  Synthetic
gccggauacccacacgggcggg

SEQ ID NO: 47223 - RNA, 23 nt, Artificial Sequence
  Synthetic
ggccggauacccacacgggcggg

SEQ ID NO: 47224 - RNA, 24 nt, Artificial Sequence
  Synthetic
gggccggauacccacacgggcggg

SEQ ID NO: 47225 - RNA, 18 nt, Artificial Sequence
  Synthetic
uaauggaccggcgcgggg

SEQ ID NO: 47226 - RNA, 19 nt, Artificial Sequence
  Synthetic
uuaauggaccggcgcgggg

SEQ ID NO: 47227 - RNA, 20 nt, Artificial Sequence
  Synthetic
cuuaauggaccggcgcgggg

SEQ ID NO: 47228 - RNA, 21 nt, Artificial Sequence
  Synthetic
ccuuaauggaccggcgcgggg

SEQ ID NO: 47229 - RNA, 22 nt, Artificial Sequence
  Synthetic
cccuuaauggaccggcgcgggg

SEQ ID NO: 47230 - RNA, 23 nt, Artificial Sequence
  Synthetic
gcccuuaauggaccggcgcgggg

SEQ ID NO: 47231 - RNA, 24 nt, Artificial Sequence
  Synthetic
cgcccuuaauggaccggcgcgggg

SEQ ID NO: 47232 - RNA, 18 nt, Artificial Sequence
  Synthetic
auacccacacgggcgggg

SEQ ID NO: 47233 - RNA, 19 nt, Artificial Sequence
  Synthetic
gauacccacacgggcgggg

SEQ ID NO: 47234 - RNA, 20 nt, Artificial Sequence
  Synthetic
ggauacccacacgggcgggg

SEQ ID NO: 47235 - RNA, 21 nt, Artificial Sequence
  Synthetic
cggauacccacacgggcgggg

SEQ ID NO: 47236 - RNA, 22 nt, Artificial Sequence
  Synthetic
ccggauacccacacgggcgggg

SEQ ID NO: 47237 - RNA, 23 nt, Artificial Sequence
  Synthetic
gccggauacccacacgggcgggg

SEQ ID NO: 47238 - RNA, 24 nt, Artificial Sequence
  Synthetic
ggccggauacccacacgggcgggg

SEQ ID NO: 47239 - RNA, 18 nt, Artificial Sequence
  Synthetic
ggguggacucgcgggggg

SEQ ID NO: 47240 - RNA, 19 nt, Artificial Sequence
  Synthetic
cggguggacucgcgggggg

SEQ ID NO: 47241 - RNA, 20 nt, Artificial Sequence
  Synthetic
gcggguggacucgcgggggg

SEQ ID NO: 47242 - RNA, 21 nt, Artificial Sequence
  Synthetic
ggcggguggacucgcgggggg

SEQ ID NO: 47243 - RNA, 22 nt, Artificial Sequence
  Synthetic
cggcggguggacucgcgggggg

SEQ ID NO: 47244 - RNA, 23 nt, Artificial Sequence
  Synthetic
ccggcggguggacucgcgggggg

SEQ ID NO: 47245 - RNA, 24 nt, Artificial Sequence
  Synthetic
gccggcggguggacucgcgggggg

SEQ ID NO: 47246 - RNA, 18 nt, Artificial Sequence
  Synthetic
ccuuggccgccccggcug

SEQ ID NO: 47247 - RNA, 19 nt, Artificial Sequence
  Synthetic
cccuuggccgccccggcug

SEQ ID NO: 47248 - RNA, 20 nt, Artificial Sequence
  Synthetic
ccccuuggccgccccggcug

SEQ ID NO: 47249 - RNA, 21 nt, Artificial Sequence
  Synthetic
gccccuuggccgccccggcug

SEQ ID NO: 47250 - RNA, 22 nt, Artificial Sequence
  Synthetic
cgccccuuggccgccccggcug

SEQ ID NO: 47251 - RNA, 23 nt, Artificial Sequence
  Synthetic
acgccccuuggccgccccggcug

SEQ ID NO: 47252 - RNA, 24 nt, Artificial Sequence
  Synthetic
gacgccccuuggccgccccggcug

SEQ ID NO: 47253 - RNA, 18 nt, Artificial Sequence
  Synthetic
gcgcggugccccugucug

SEQ ID NO: 47254 - RNA, 19 nt, Artificial Sequence
  Synthetic
ggcgcggugccccugucug

SEQ ID NO: 47255 - RNA, 20 nt, Artificial Sequence
  Synthetic
gggcgcggugccccugucug

SEQ ID NO: 47256 - RNA, 21 nt, Artificial Sequence
  Synthetic
cgggcgcggugccccugucug

SEQ ID NO: 47257 - RNA, 22 nt, Artificial Sequence
  Synthetic
ccgggcgcggugccccugucug

SEQ ID NO: 47258 - RNA, 23 nt, Artificial Sequence
  Synthetic
uccgggcgcggugccccugucug

SEQ ID NO: 47259 - RNA, 24 nt, Artificial Sequence
  Synthetic
uuccgggcgcggugccccugucug

SEQ ID NO: 47260 - RNA, 18 nt, Artificial Sequence
  Synthetic
cgcggccuucgccccgug

SEQ ID NO: 47261 - RNA, 19 nt, Artificial Sequence
  Synthetic
acgcggccuucgccccgug

SEQ ID NO: 47262 - RNA, 20 nt, Artificial Sequence
  Synthetic
uacgcggccuucgccccgug

SEQ ID NO: 47263 - RNA, 21 nt, Artificial Sequence
  Synthetic
guacgcggccuucgccccgug

SEQ ID NO: 47264 - RNA, 22 nt, Artificial Sequence
  Synthetic
cguacgcggccuucgccccgug

SEQ ID NO: 47265 - RNA, 23 nt, Artificial Sequence
  Synthetic
ccguacgcggccuucgccccgug

SEQ ID NO: 47266 - RNA, 24 nt, Artificial Sequence
  Synthetic
gccguacgcggccuucgccccgug

SEQ ID NO: 47267 - RNA, 18 nt, Artificial Sequence
  Synthetic
gcaugcgccgggccguug

SEQ ID NO: 47268 - RNA, 19 nt, Artificial Sequence
  Synthetic
cgcaugcgccgggccguug

SEQ ID NO: 47269 - RNA, 20 nt, Artificial Sequence
  Synthetic
gcgcaugcgccgggccguug

SEQ ID NO: 47270 - RNA, 21 nt, Artificial Sequence
  Synthetic
agcgcaugcgccgggccguug

SEQ ID NO: 47271 - RNA, 22 nt, Artificial Sequence
  Synthetic
cagcgcaugcgccgggccguug

SEQ ID NO: 47272 - RNA, 23 nt, Artificial Sequence
  Synthetic
acagcgcaugcgccgggccguug

SEQ ID NO: 47273 - RNA, 24 nt, Artificial Sequence
  Synthetic
cacagcgcaugcgccgggccguug

SEQ ID NO: 47274 - RNA, 18 nt, Artificial Sequence
  Synthetic
gggguguaggauggguau

SEQ ID NO: 47275 - RNA, 19 nt, Artificial Sequence
  Synthetic
ggggguguaggauggguau

SEQ ID NO: 47276 - RNA, 20 nt, Artificial Sequence
  Synthetic
gggggguguaggauggguau

SEQ ID NO: 47277 - RNA, 21 nt, Artificial Sequence
  Synthetic
agggggguguaggauggguau

SEQ ID NO: 47278 - RNA, 22 nt, Artificial Sequence
  Synthetic
cagggggguguaggauggguau

SEQ ID NO: 47279 - RNA, 23 nt, Artificial Sequence
  Synthetic
gcagggggguguaggauggguau

SEQ ID NO: 47280 - RNA, 24 nt, Artificial Sequence
  Synthetic
ggcagggggguguaggauggguau

SEQ ID NO: 47281 - RNA, 18 nt, Artificial Sequence
  Synthetic
gccacauaaacaaugacu

SEQ ID NO: 47282 - RNA, 19 nt, Artificial Sequence
  Synthetic
ggccacauaaacaaugacu

SEQ ID NO: 47283 - RNA, 20 nt, Artificial Sequence
  Synthetic
cggccacauaaacaaugacu

SEQ ID NO: 47284 - RNA, 21 nt, Artificial Sequence
  Synthetic
gcggccacauaaacaaugacu

SEQ ID NO: 47285 - RNA, 22 nt, Artificial Sequence
  Synthetic
cgcggccacauaaacaaugacu

SEQ ID NO: 47286 - RNA, 23 nt, Artificial Sequence
  Synthetic
ccgcggccacauaaacaaugacu

SEQ ID NO: 47287 - RNA, 24 nt, Artificial Sequence
  Synthetic
cccgcggccacauaaacaaugacu

SEQ ID NO: 47288 - RNA, 18 nt, Artificial Sequence
  Synthetic
gggaacccggaaaagccu

SEQ ID NO: 47289 - RNA, 19 nt, Artificial Sequence
  Synthetic
cgggaacccggaaaagccu

SEQ ID NO: 47290 - RNA, 20 nt, Artificial Sequence
  Synthetic
ccgggaacccggaaaagccu

SEQ ID NO: 47291 - RNA, 21 nt, Artificial Sequence
  Synthetic
gccgggaacccggaaaagccu

SEQ ID NO: 47292 - RNA, 22 nt, Artificial Sequence
  Synthetic
ggccgggaacccggaaaagccu

SEQ ID NO: 47293 - RNA, 23 nt, Artificial Sequence
  Synthetic
gggccgggaacccggaaaagccu

SEQ ID NO: 47294 - RNA, 24 nt, Artificial Sequence
  Synthetic
cgggccgggaacccggaaaagccu

SEQ ID NO: 47295 - RNA, 18 nt, Artificial Sequence
  Synthetic
cagcggccggccggcgcu

SEQ ID NO: 47296 - RNA, 19 nt, Artificial Sequence
  Synthetic
ccagcggccggccggcgcu

SEQ ID NO: 47297 - RNA, 20 nt, Artificial Sequence
  Synthetic
accagcggccggccggcgcu

SEQ ID NO: 47298 - RNA, 21 nt, Artificial Sequence
  Synthetic
gaccagcggccggccggcgcu

SEQ ID NO: 47299 - RNA, 22 nt, Artificial Sequence
  Synthetic
agaccagcggccggccggcgcu

SEQ ID NO: 47300 - RNA, 23 nt, Artificial Sequence
  Synthetic
cagaccagcggccggccggcgcu

SEQ ID NO: 47301 - RNA, 24 nt, Artificial Sequence
  Synthetic
acagaccagcggccggccggcgcu

SEQ ID NO: 47302 - RNA, 18 nt, Artificial Sequence
  Synthetic
acgcggccuucgccccgu

SEQ ID NO: 47303 - RNA, 19 nt, Artificial Sequence
  Synthetic
uacgcggccuucgccccgu

SEQ ID NO: 47304 - RNA, 20 nt, Artificial Sequence
  Synthetic
guacgcggccuucgccccgu

SEQ ID NO: 47305 - RNA, 21 nt, Artificial Sequence
  Synthetic
cguacgcggccuucgccccgu

SEQ ID NO: 47306 - RNA, 22 nt, Artificial Sequence
  Synthetic
ccguacgcggccuucgccccgu

SEQ ID NO: 47307 - RNA, 23 nt, Artificial Sequence
  Synthetic
gccguacgcggccuucgccccgu

SEQ ID NO: 47308 - RNA, 24 nt, Artificial Sequence
  Synthetic
ggccguacgcggccuucgccccgu

SEQ ID NO: 47309 - RNA, 18 nt, Artificial Sequence
  Synthetic
ggcccggaccgccgcggu

SEQ ID NO: 47310 - RNA, 19 nt, Artificial Sequence
  Synthetic
gggcccggaccgccgcggu

SEQ ID NO: 47311 - RNA, 20 nt, Artificial Sequence
  Synthetic
ggggcccggaccgccgcggu

SEQ ID NO: 47312 - RNA, 21 nt, Artificial Sequence
  Synthetic
cggggcccggaccgccgcggu

SEQ ID NO: 47313 - RNA, 22 nt, Artificial Sequence
  Synthetic
acggggcccggaccgccgcggu

SEQ ID NO: 47314 - RNA, 23 nt, Artificial Sequence
  Synthetic
gacggggcccggaccgccgcggu

SEQ ID NO: 47315 - RNA, 24 nt, Artificial Sequence
  Synthetic
ggacggggcccggaccgccgcggu

SEQ ID NO: 47316 - RNA, 18 nt, Artificial Sequence
  Synthetic
gcgugccggcgagcgggu

SEQ ID NO: 47317 - RNA, 19 nt, Artificial Sequence
  Synthetic
cgcgugccggcgagcgggu

SEQ ID NO: 47318 - RNA, 20 nt, Artificial Sequence
  Synthetic
ucgcgugccggcgagcgggu

SEQ ID NO: 47319 - RNA, 21 nt, Artificial Sequence
  Synthetic
gucgcgugccggcgagcgggu

SEQ ID NO: 47320 - RNA, 22 nt, Artificial Sequence
  Synthetic
cgucgcgugccggcgagcgggu

SEQ ID NO: 47321 - RNA, 23 nt, Artificial Sequence
  Synthetic
gcgucgcgugccggcgagcgggu

SEQ ID NO: 47322 - RNA, 24 nt, Artificial Sequence
  Synthetic
cgcgucgcgugccggcgagcgggu

SEQ ID NO: 47323 - RNA, 18 nt, Artificial Sequence
  Synthetic
agcggccggccggcgcuu

SEQ ID NO: 47324 - RNA, 19 nt, Artificial Sequence
  Synthetic
cagcggccggccggcgcuu

SEQ ID NO: 47325 - RNA, 20 nt, Artificial Sequence
  Synthetic
ccagcggccggccggcgcuu

SEQ ID NO: 47326 - RNA, 21 nt, Artificial Sequence
  Synthetic
accagcggccggccggcgcuu

SEQ ID NO: 47327 - RNA, 22 nt, Artificial Sequence
  Synthetic
gaccagcggccggccggcgcuu

SEQ ID NO: 47328 - RNA, 23 nt, Artificial Sequence
  Synthetic
agaccagcggccggccggcgcuu

SEQ ID NO: 47329 - RNA, 24 nt, Artificial Sequence
  Synthetic
cagaccagcggccggccggcgcuu

SEQ ID NO: 47330 - RNA, 18 nt, Artificial Sequence
  Synthetic
cgcaugcgccgggccguu

SEQ ID NO: 47331 - RNA, 19 nt, Artificial Sequence
  Synthetic
gcgcaugcgccgggccguu

SEQ ID NO: 47332 - RNA, 20 nt, Artificial Sequence
  Synthetic
agcgcaugcgccgggccguu

SEQ ID NO: 47333 - RNA, 21 nt, Artificial Sequence
  Synthetic
cagcgcaugcgccgggccguu

SEQ ID NO: 47334 - RNA, 22 nt, Artificial Sequence
  Synthetic
acagcgcaugcgccgggccguu

SEQ ID NO: 47335 - RNA, 23 nt, Artificial Sequence
  Synthetic
cacagcgcaugcgccgggccguu

SEQ ID NO: 47336 - RNA, 24 nt, Artificial Sequence
  Synthetic
ccacagcgcaugcgccgggccguu

SEQ ID NO: 47337 - RNA, 18 nt, Artificial Sequence
  Synthetic
cugcggccuaauggauuu

SEQ ID NO: 47338 - RNA, 19 nt, Artificial Sequence
  Synthetic
ucugcggccuaauggauuu

SEQ ID NO: 47339 - RNA, 20 nt, Artificial Sequence
  Synthetic
gucugcggccuaauggauuu

SEQ ID NO: 47340 - RNA, 21 nt, Artificial Sequence
  Synthetic
cgucugcggccuaauggauuu

SEQ ID NO: 47341 - RNA, 22 nt, Artificial Sequence
  Synthetic
ucgucugcggccuaauggauuu

SEQ ID NO: 47342 - RNA, 23 nt, Artificial Sequence
  Synthetic
cucgucugcggccuaauggauuu

SEQ ID NO: 47343 - RNA, 24 nt, Artificial Sequence
  Synthetic
ccucgucugcggccuaauggauuu

SEQ ID NO: 47344 - RNA, 18 nt, Artificial Sequence
  Synthetic
aucucagccuuuauaaaa

SEQ ID NO: 47345 - RNA, 19 nt, Artificial Sequence
  Synthetic
caucucagccuuuauaaaa

SEQ ID NO: 47346 - RNA, 20 nt, Artificial Sequence
  Synthetic
ucaucucagccuuuauaaaa

SEQ ID NO: 47347 - RNA, 21 nt, Artificial Sequence
  Synthetic
gucaucucagccuuuauaaaa

SEQ ID NO: 47348 - RNA, 22 nt, Artificial Sequence
  Synthetic
cgucaucucagccuuuauaaaa

SEQ ID NO: 47349 - RNA, 23 nt, Artificial Sequence
  Synthetic
gcgucaucucagccuuuauaaaa

SEQ ID NO: 47350 - RNA, 24 nt, Artificial Sequence
  Synthetic
ugcgucaucucagccuuuauaaaa

SEQ ID NO: 47351 - RNA, 18 nt, Artificial Sequence
  Synthetic
gggauggaaggacgggaa

SEQ ID NO: 47352 - RNA, 19 nt, Artificial Sequence
  Synthetic
ggggauggaaggacgggaa

SEQ ID NO: 47353 - RNA, 20 nt, Artificial Sequence
  Synthetic
gggggauggaaggacgggaa

SEQ ID NO: 47354 - RNA, 21 nt, Artificial Sequence
  Synthetic
cgggggauggaaggacgggaa

SEQ ID NO: 47355 - RNA, 22 nt, Artificial Sequence
  Synthetic
acgggggauggaaggacgggaa

SEQ ID NO: 47356 - RNA, 23 nt, Artificial Sequence
  Synthetic
aacgggggauggaaggacgggaa

SEQ ID NO: 47357 - RNA, 24 nt, Artificial Sequence
  Synthetic
gaacgggggauggaaggacgggaa

SEQ ID NO: 47358 - RNA, 18 nt, Artificial Sequence
  Synthetic
aggaacaaccgaggggaa

SEQ ID NO: 47359 - RNA, 19 nt, Artificial Sequence
  Synthetic
gaggaacaaccgaggggaa

SEQ ID NO: 47360 - RNA, 20 nt, Artificial Sequence
  Synthetic
cgaggaacaaccgaggggaa

SEQ ID NO: 47361 - RNA, 18 nt, Artificial Sequence
  Synthetic
ggggccccggcggaccca

SEQ ID NO: 47362 - RNA, 19 nt, Artificial Sequence
  Synthetic
cggggccccggcggaccca

SEQ ID NO: 47363 - RNA, 20 nt, Artificial Sequence
  Synthetic
ccggggccccggcggaccca

SEQ ID NO: 47364 - RNA, 21 nt, Artificial Sequence
  Synthetic
cccggggccccggcggaccca

SEQ ID NO: 47365 - RNA, 22 nt, Artificial Sequence
  Synthetic
gcccggggccccggcggaccca

SEQ ID NO: 47366 - RNA, 23 nt, Artificial Sequence
  Synthetic
ggcccggggccccggcggaccca

SEQ ID NO: 47367 - RNA, 24 nt, Artificial Sequence
  Synthetic
cggcccggggccccggcggaccca

SEQ ID NO: 47368 - RNA, 18 nt, Artificial Sequence
  Synthetic
cugcagccggggcggcca

SEQ ID NO: 47369 - RNA, 19 nt, Artificial Sequence
  Synthetic
ccugcagccggggcggcca

SEQ ID NO: 47370 - RNA, 20 nt, Artificial Sequence
  Synthetic
cccugcagccggggcggcca

SEQ ID NO: 47371 - RNA, 21 nt, Artificial Sequence
  Synthetic
ccccugcagccggggcggcca

SEQ ID NO: 47372 - RNA, 22 nt, Artificial Sequence
  Synthetic
cccccugcagccggggcggcca

SEQ ID NO: 47373 - RNA, 23 nt, Artificial Sequence
  Synthetic
ccccccugcagccggggcggcca

SEQ ID NO: 47374 - RNA, 24 nt, Artificial Sequence
  Synthetic
gccccccugcagccggggcggcca

SEQ ID NO: 47375 - RNA, 18 nt, Artificial Sequence
  Synthetic
cguucgucuguccccuca

SEQ ID NO: 47376 - RNA, 19 nt, Artificial Sequence
  Synthetic
ucguucgucuguccccuca

SEQ ID NO: 47377 - RNA, 20 nt, Artificial Sequence
  Synthetic
uucguucgucuguccccuca

SEQ ID NO: 47378 - RNA, 21 nt, Artificial Sequence
  Synthetic
uuucguucgucuguccccuca

SEQ ID NO: 47379 - RNA, 22 nt, Artificial Sequence
  Synthetic
guuucguucgucuguccccuca

SEQ ID NO: 47380 - RNA, 23 nt, Artificial Sequence
  Synthetic
uguuucguucgucuguccccuca

SEQ ID NO: 47381 - RNA, 24 nt, Artificial Sequence
  Synthetic
auguuucguucgucuguccccuca

SEQ ID NO: 47382 - RNA, 18 nt, Artificial Sequence
  Synthetic
cguuaagugcucugcaga

SEQ ID NO: 47383 - RNA, 19 nt, Artificial Sequence
  Synthetic
ccguuaagugcucugcaga

SEQ ID NO: 47384 - RNA, 20 nt, Artificial Sequence
  Synthetic
uccguuaagugcucugcaga

SEQ ID NO: 47385 - RNA, 21 nt, Artificial Sequence
  Synthetic
auccguuaagugcucugcaga

SEQ ID NO: 47386 - RNA, 22 nt, Artificial Sequence
  Synthetic
aauccguuaagugcucugcaga

SEQ ID NO: 47387 - RNA, 23 nt, Artificial Sequence
  Synthetic
caauccguuaagugcucugcaga

SEQ ID NO: 47388 - RNA, 24 nt, Artificial Sequence
  Synthetic
ucaauccguuaagugcucugcaga

SEQ ID NO: 47389 - RNA, 18 nt, Artificial Sequence
  Synthetic
gccggccggcuaccgaga

SEQ ID NO: 47390 - RNA, 19 nt, Artificial Sequence
  Synthetic
cgccggccggcuaccgaga

SEQ ID NO: 47391 - RNA, 20 nt, Artificial Sequence
  Synthetic
ccgccggccggcuaccgaga

SEQ ID NO: 47392 - RNA, 21 nt, Artificial Sequence
  Synthetic
cccgccggccggcuaccgaga

SEQ ID NO: 47393 - RNA, 22 nt, Artificial Sequence
  Synthetic
acccgccggccggcuaccgaga

SEQ ID NO: 47394 - RNA, 23 nt, Artificial Sequence
  Synthetic
cacccgccggccggcuaccgaga

SEQ ID NO: 47395 - RNA, 24 nt, Artificial Sequence
  Synthetic
ccacccgccggccggcuaccgaga

SEQ ID NO: 47396 - RNA, 18 nt, Artificial Sequence
  Synthetic
gaacgggggauggaagga

SEQ ID NO: 47397 - RNA, 19 nt, Artificial Sequence
  Synthetic
ggaacgggggauggaagga

SEQ ID NO: 47398 - RNA, 20 nt, Artificial Sequence
  Synthetic
gggaacgggggauggaagga

SEQ ID NO: 47399 - RNA, 21 nt, Artificial Sequence
  Synthetic
ggggaacgggggauggaagga

SEQ ID NO: 47400 - RNA, 22 nt, Artificial Sequence
  Synthetic
aggggaacgggggauggaagga

SEQ ID NO: 47401 - RNA, 23 nt, Artificial Sequence
  Synthetic
gaggggaacgggggauggaagga

SEQ ID NO: 47402 - RNA, 24 nt, Artificial Sequence
  Synthetic
cgaggggaacgggggauggaagga

SEQ ID NO: 47403 - RNA, 18 nt, Artificial Sequence
  Synthetic
gaggaacaaccgagggga

SEQ ID NO: 47404 - RNA, 19 nt, Artificial Sequence
  Synthetic
cgaggaacaaccgagggga

SEQ ID NO: 47405 - RNA, 20 nt, Artificial Sequence
  Synthetic
gcgaggaacaaccgagggga

SEQ ID NO: 47406 - RNA, 18 nt, Artificial Sequence
  Synthetic
accgaggggaacggggga

SEQ ID NO: 47407 - RNA, 19 nt, Artificial Sequence
  Synthetic
aaccgaggggaacggggga

SEQ ID NO: 47408 - RNA, 20 nt, Artificial Sequence
  Synthetic
caaccgaggggaacggggga

SEQ ID NO: 47409 - RNA, 21 nt, Artificial Sequence
  Synthetic
acaaccgaggggaacggggga

SEQ ID NO: 47410 - RNA, 22 nt, Artificial Sequence
  Synthetic
aacaaccgaggggaacggggga

SEQ ID NO: 47411 - RNA, 23 nt, Artificial Sequence
  Synthetic
gaacaaccgaggggaacggggga

SEQ ID NO: 47412 - RNA, 24 nt, Artificial Sequence
  Synthetic
ggaacaaccgaggggaacggggga

SEQ ID NO: 47413 - RNA, 18 nt, Artificial Sequence
  Synthetic
ccacccgccggccggcua

SEQ ID NO: 47414 - RNA, 19 nt, Artificial Sequence
  Synthetic
uccacccgccggccggcua

SEQ ID NO: 47415 - RNA, 20 nt, Artificial Sequence
  Synthetic
guccacccgccggccggcua

SEQ ID NO: 47416 - RNA, 21 nt, Artificial Sequence
  Synthetic
aguccacccgccggccggcua

SEQ ID NO: 47417 - RNA, 22 nt, Artificial Sequence
  Synthetic
gaguccacccgccggccggcua

SEQ ID NO: 47418 - RNA, 23 nt, Artificial Sequence
  Synthetic
cgaguccacccgccggccggcua

SEQ ID NO: 47419 - RNA, 24 nt, Artificial Sequence
  Synthetic
gcgaguccacccgccggccggcua

SEQ ID NO: 47420 - RNA, 18 nt, Artificial Sequence
  Synthetic
ggaacaaccgaggggaac

SEQ ID NO: 47421 - RNA, 19 nt, Artificial Sequence
  Synthetic
aggaacaaccgaggggaac

SEQ ID NO: 47422 - RNA, 20 nt, Artificial Sequence
  Synthetic
gaggaacaaccgaggggaac

SEQ ID NO: 47423 - RNA, 18 nt, Artificial Sequence
  Synthetic
ggggccugagaugaacac

SEQ ID NO: 47424 - RNA, 19 nt, Artificial Sequence
  Synthetic
cggggccugagaugaacac

SEQ ID NO: 47425 - RNA, 20 nt, Artificial Sequence
  Synthetic
ccggggccugagaugaacac

SEQ ID NO: 47426 - RNA, 21 nt, Artificial Sequence
  Synthetic
cccggggccugagaugaacac

SEQ ID NO: 47427 - RNA, 22 nt, Artificial Sequence
  Synthetic
gcccggggccugagaugaacac

SEQ ID NO: 47428 - RNA, 23 nt, Artificial Sequence
  Synthetic
ggcccggggccugagaugaacac

SEQ ID NO: 47429 - RNA, 24 nt, Artificial Sequence
  Synthetic
cggcccggggccugagaugaacac

SEQ ID NO: 47430 - RNA, 18 nt, Artificial Sequence
  Synthetic
auccauuaggccgcagac

SEQ ID NO: 47431 - RNA, 19 nt, Artificial Sequence
  Synthetic
aauccauuaggccgcagac

SEQ ID NO: 47432 - RNA, 20 nt, Artificial Sequence
  Synthetic
aaauccauuaggccgcagac

SEQ ID NO: 47433 - RNA, 21 nt, Artificial Sequence
  Synthetic
gaaauccauuaggccgcagac

SEQ ID NO: 47434 - RNA, 22 nt, Artificial Sequence
  Synthetic
ggaaauccauuaggccgcagac

SEQ ID NO: 47435 - RNA, 23 nt, Artificial Sequence
  Synthetic
cggaaauccauuaggccgcagac

SEQ ID NO: 47436 - RNA, 24 nt, Artificial Sequence
  Synthetic
ccggaaauccauuaggccgcagac

SEQ ID NO: 47437 - RNA, 18 nt, Artificial Sequence
  Synthetic
guuaagugcucugcagac

SEQ ID NO: 47438 - RNA, 19 nt, Artificial Sequence
  Synthetic
cguuaagugcucugcagac

SEQ ID NO: 47439 - RNA, 20 nt, Artificial Sequence
  Synthetic
ccguuaagugcucugcagac

SEQ ID NO: 47440 - RNA, 21 nt, Artificial Sequence
  Synthetic
uccguuaagugcucugcagac

SEQ ID NO: 47441 - RNA, 22 nt, Artificial Sequence
  Synthetic
auccguuaagugcucugcagac

SEQ ID NO: 47442 - RNA, 23 nt, Artificial Sequence
  Synthetic
aauccguuaagugcucugcagac

SEQ ID NO: 47443 - RNA, 24 nt, Artificial Sequence
  Synthetic
caauccguuaagugcucugcagac

SEQ ID NO: 47444 - RNA, 18 nt, Artificial Sequence
  Synthetic
cgcucgccggcacgcgac

SEQ ID NO: 47445 - RNA, 19 nt, Artificial Sequence
  Synthetic
ccgcucgccggcacgcgac

SEQ ID NO: 47446 - RNA, 20 nt, Artificial Sequence
  Synthetic
cccgcucgccggcacgcgac

SEQ ID NO: 47447 - RNA, 21 nt, Artificial Sequence
  Synthetic
acccgcucgccggcacgcgac

SEQ ID NO: 47448 - RNA, 22 nt, Artificial Sequence
  Synthetic
gacccgcucgccggcacgcgac

SEQ ID NO: 47449 - RNA, 23 nt, Artificial Sequence
  Synthetic
ggacccgcucgccggcacgcgac

SEQ ID NO: 47450 - RNA, 24 nt, Artificial Sequence
  Synthetic
cggacccgcucgccggcacgcgac

SEQ ID NO: 47451 - RNA, 18 nt, Artificial Sequence
  Synthetic
aacgggggauggaaggac

SEQ ID NO: 47452 - RNA, 19 nt, Artificial Sequence
  Synthetic
gaacgggggauggaaggac

SEQ ID NO: 47453 - RNA, 20 nt, Artificial Sequence
  Synthetic
ggaacgggggauggaaggac

SEQ ID NO: 47454 - RNA, 21 nt, Artificial Sequence
  Synthetic
gggaacgggggauggaaggac

SEQ ID NO: 47455 - RNA, 22 nt, Artificial Sequence
  Synthetic
ggggaacgggggauggaaggac

SEQ ID NO: 47456 - RNA, 23 nt, Artificial Sequence
  Synthetic
aggggaacgggggauggaaggac

SEQ ID NO: 47457 - RNA, 24 nt, Artificial Sequence
  Synthetic
gaggggaacgggggauggaaggac

SEQ ID NO: 47458 - RNA, 18 nt, Artificial Sequence
  Synthetic
ccgcguacggcccgggac

SEQ ID NO: 47459 - RNA, 19 nt, Artificial Sequence
  Synthetic
gccgcguacggcccgggac

SEQ ID NO: 47460 - RNA, 20 nt, Artificial Sequence
  Synthetic
ggccgcguacggcccgggac

SEQ ID NO: 47461 - RNA, 21 nt, Artificial Sequence
  Synthetic
aggccgcguacggcccgggac

SEQ ID NO: 47462 - RNA, 22 nt, Artificial Sequence
  Synthetic
aaggccgcguacggcccgggac

SEQ ID NO: 47463 - RNA, 23 nt, Artificial Sequence
  Synthetic
gaaggccgcguacggcccgggac

SEQ ID NO: 47464 - RNA, 24 nt, Artificial Sequence
  Synthetic
cgaaggccgcguacggcccgggac

SEQ ID NO: 47465 - RNA, 18 nt, Artificial Sequence
  Synthetic
cggggccccggcggaccc

SEQ ID NO: 47466 - RNA, 19 nt, Artificial Sequence
  Synthetic
ccggggccccggcggaccc

SEQ ID NO: 47467 - RNA, 20 nt, Artificial Sequence
  Synthetic
cccggggccccggcggaccc

SEQ ID NO: 47468 - RNA, 21 nt, Artificial Sequence
  Synthetic
gcccggggccccggcggaccc

SEQ ID NO: 47469 - RNA, 22 nt, Artificial Sequence
  Synthetic
ggcccggggccccggcggaccc

SEQ ID NO: 47470 - RNA, 23 nt, Artificial Sequence
  Synthetic
cggcccggggccccggcggaccc

SEQ ID NO: 47471 - RNA, 24 nt, Artificial Sequence
  Synthetic
ccggcccggggccccggcggaccc

SEQ ID NO: 47472 - RNA, 18 nt, Artificial Sequence
  Synthetic
gacgcgaaaaaggccccc

SEQ ID NO: 47473 - RNA, 19 nt, Artificial Sequence
  Synthetic
cgacgcgaaaaaggccccc

SEQ ID NO: 47474 - RNA, 20 nt, Artificial Sequence
  Synthetic
gcgacgcgaaaaaggccccc

SEQ ID NO: 47475 - RNA, 21 nt, Artificial Sequence
  Synthetic
cgcgacgcgaaaaaggccccc

SEQ ID NO: 47476 - RNA, 22 nt, Artificial Sequence
  Synthetic
acgcgacgcgaaaaaggccccc

SEQ ID NO: 47477 - RNA, 23 nt, Artificial Sequence
  Synthetic
cacgcgacgcgaaaaaggccccc

SEQ ID NO: 47478 - RNA, 24 nt, Artificial Sequence
  Synthetic
gcacgcgacgcgaaaaaggccccc

SEQ ID NO: 47479 - RNA, 18 nt, Artificial Sequence
  Synthetic
cgacgcgaaaaaggcccc

SEQ ID NO: 47480 - RNA, 19 nt, Artificial Sequence
  Synthetic
gcgacgcgaaaaaggcccc

SEQ ID NO: 47481 - RNA, 20 nt, Artificial Sequence
  Synthetic
cgcgacgcgaaaaaggcccc

SEQ ID NO: 47482 - RNA, 21 nt, Artificial Sequence
  Synthetic
acgcgacgcgaaaaaggcccc

SEQ ID NO: 47483 - RNA, 22 nt, Artificial Sequence
  Synthetic
cacgcgacgcgaaaaaggcccc

SEQ ID NO: 47484 - RNA, 23 nt, Artificial Sequence
  Synthetic
gcacgcgacgcgaaaaaggcccc

SEQ ID NO: 47485 - RNA, 24 nt, Artificial Sequence
  Synthetic
ggcacgcgacgcgaaaaaggcccc

SEQ ID NO: 47486 - RNA, 18 nt, Artificial Sequence
  Synthetic
uuaagggcgcgcgugccc

SEQ ID NO: 47487 - RNA, 19 nt, Artificial Sequence
  Synthetic
auuaagggcgcgcgugccc

SEQ ID NO: 47488 - RNA, 20 nt, Artificial Sequence
  Synthetic
cauuaagggcgcgcgugccc

SEQ ID NO: 47489 - RNA, 21 nt, Artificial Sequence
  Synthetic
ccauuaagggcgcgcgugccc

SEQ ID NO: 47490 - RNA, 22 nt, Artificial Sequence
  Synthetic
uccauuaagggcgcgcgugccc

SEQ ID NO: 47491 - RNA, 23 nt, Artificial Sequence
  Synthetic
guccauuaagggcgcgcgugccc

SEQ ID NO: 47492 - RNA, 24 nt, Artificial Sequence
  Synthetic
gguccauuaagggcgcgcgugccc

SEQ ID NO: 47493 - RNA, 18 nt, Artificial Sequence
  Synthetic
agacaggggcaccgcgcc

SEQ ID NO: 47494 - RNA, 19 nt, Artificial Sequence
  Synthetic
cagacaggggcaccgcgcc

SEQ ID NO: 47495 - RNA, 20 nt, Artificial Sequence
  Synthetic
gcagacaggggcaccgcgcc

SEQ ID NO: 47496 - RNA, 21 nt, Artificial Sequence
  Synthetic
ugcagacaggggcaccgcgcc

SEQ ID NO: 47497 - RNA, 22 nt, Artificial Sequence
  Synthetic
cugcagacaggggcaccgcgcc

SEQ ID NO: 47498 - RNA, 23 nt, Artificial Sequence
  Synthetic
ucugcagacaggggcaccgcgcc

SEQ ID NO: 47499 - RNA, 24 nt, Artificial Sequence
  Synthetic
cucugcagacaggggcaccgcgcc

SEQ ID NO: 47500 - RNA, 18 nt, Artificial Sequence
  Synthetic
cgaaggccgcguacggcc

SEQ ID NO: 47501 - RNA, 19 nt, Artificial Sequence
  Synthetic
gcgaaggccgcguacggcc

SEQ ID NO: 47502 - RNA, 20 nt, Artificial Sequence
  Synthetic
ggcgaaggccgcguacggcc

SEQ ID NO: 47503 - RNA, 21 nt, Artificial Sequence
  Synthetic
gggcgaaggccgcguacggcc

SEQ ID NO: 47504 - RNA, 22 nt, Artificial Sequence
  Synthetic
ggggcgaaggccgcguacggcc

SEQ ID NO: 47505 - RNA, 23 nt, Artificial Sequence
  Synthetic
cggggcgaaggccgcguacggcc

SEQ ID NO: 47506 - RNA, 24 nt, Artificial Sequence
  Synthetic
acggggcgaaggccgcguacggcc

SEQ ID NO: 47507 - RNA, 18 nt, Artificial Sequence
  Synthetic
acccaaggggccccggcc

SEQ ID NO: 47508 - RNA, 19 nt, Artificial Sequence
  Synthetic
gacccaaggggccccggcc

SEQ ID NO: 47509 - RNA, 20 nt, Artificial Sequence
  Synthetic
ggacccaaggggccccggcc

SEQ ID NO: 47510 - RNA, 21 nt, Artificial Sequence
  Synthetic
cggacccaaggggccccggcc

SEQ ID NO: 47511 - RNA, 22 nt, Artificial Sequence
  Synthetic
gcggacccaaggggccccggcc

SEQ ID NO: 47512 - RNA, 23 nt, Artificial Sequence
  Synthetic
ggcggacccaaggggccccggcc

SEQ ID NO: 47513 - RNA, 24 nt, Artificial Sequence
  Synthetic
cggcggacccaaggggccccggcc

SEQ ID NO: 47514 - RNA, 18 nt, Artificial Sequence
  Synthetic
ccccguggcggcccggcc

SEQ ID NO: 47515 - RNA, 19 nt, Artificial Sequence
  Synthetic
cccccguggcggcccggcc

SEQ ID NO: 47516 - RNA, 20 nt, Artificial Sequence
  Synthetic
gcccccguggcggcccggcc

SEQ ID NO: 47517 - RNA, 21 nt, Artificial Sequence
  Synthetic
ggcccccguggcggcccggcc

SEQ ID NO: 47518 - RNA, 22 nt, Artificial Sequence
  Synthetic
cggcccccguggcggcccggcc

SEQ ID NO: 47519 - RNA, 23 nt, Artificial Sequence
  Synthetic
ccggcccccguggcggcccggcc

SEQ ID NO: 47520 - RNA, 24 nt, Artificial Sequence
  Synthetic
gccggcccccguggcggcccggcc

SEQ ID NO: 47521 - RNA, 18 nt, Artificial Sequence
  Synthetic
uuuuccggguucccggcc

SEQ ID NO: 47522 - RNA, 19 nt, Artificial Sequence
  Synthetic
cuuuuccggguucccggcc

SEQ ID NO: 47523 - RNA, 20 nt, Artificial Sequence
  Synthetic
gcuuuuccggguucccggcc

SEQ ID NO: 47524 - RNA, 21 nt, Artificial Sequence
  Synthetic
ggcuuuuccggguucccggcc

SEQ ID NO: 47525 - RNA, 22 nt, Artificial Sequence
  Synthetic
aggcuuuuccggguucccggcc

SEQ ID NO: 47526 - RNA, 23 nt, Artificial Sequence
  Synthetic
gaggcuuuuccggguucccggcc

SEQ ID NO: 47527 - RNA, 24 nt, Artificial Sequence
  Synthetic
ggaggcuuuuccggguucccggcc

SEQ ID NO: 47528 - RNA, 18 nt, Artificial Sequence
  Synthetic
ccugcagccggggcggcc

SEQ ID NO: 47529 - RNA, 19 nt, Artificial Sequence
  Synthetic
cccugcagccggggcggcc

SEQ ID NO: 47530 - RNA, 20 nt, Artificial Sequence
  Synthetic
ccccugcagccggggcggcc

SEQ ID NO: 47531 - RNA, 21 nt, Artificial Sequence
  Synthetic
cccccugcagccggggcggcc

SEQ ID NO: 47532 - RNA, 22 nt, Artificial Sequence
  Synthetic
ccccccugcagccggggcggcc

SEQ ID NO: 47533 - RNA, 23 nt, Artificial Sequence
  Synthetic
gccccccugcagccggggcggcc

SEQ ID NO: 47534 - RNA, 24 nt, Artificial Sequence
  Synthetic
ggccccccugcagccggggcggcc

SEQ ID NO: 47535 - RNA, 18 nt, Artificial Sequence
  Synthetic
gucauuguuuauguggcc

SEQ ID NO: 47536 - RNA, 19 nt, Artificial Sequence
  Synthetic
agucauuguuuauguggcc

SEQ ID NO: 47537 - RNA, 20 nt, Artificial Sequence
  Synthetic
gagucauuguuuauguggcc

SEQ ID NO: 47538 - RNA, 21 nt, Artificial Sequence
  Synthetic
agagucauuguuuauguggcc

SEQ ID NO: 47539 - RNA, 22 nt, Artificial Sequence
  Synthetic
cagagucauuguuuauguggcc

SEQ ID NO: 47540 - RNA, 23 nt, Artificial Sequence
  Synthetic
ccagagucauuguuuauguggcc

SEQ ID NO: 47541 - RNA, 24 nt, Artificial Sequence
  Synthetic
cccagagucauuguuuauguggcc

SEQ ID NO: 47542 - RNA, 18 nt, Artificial Sequence
  Synthetic
cucagccuuuauaaaagc

SEQ ID NO: 47543 - RNA, 19 nt, Artificial Sequence
  Synthetic
ucucagccuuuauaaaagc

SEQ ID NO: 47544 - RNA, 20 nt, Artificial Sequence
  Synthetic
aucucagccuuuauaaaagc

SEQ ID NO: 47545 - RNA, 21 nt, Artificial Sequence
  Synthetic
caucucagccuuuauaaaagc

SEQ ID NO: 47546 - RNA, 22 nt, Artificial Sequence
  Synthetic
ucaucucagccuuuauaaaagc

SEQ ID NO: 47547 - RNA, 23 nt, Artificial Sequence
  Synthetic
gucaucucagccuuuauaaaagc

SEQ ID NO: 47548 - RNA, 24 nt, Artificial Sequence
  Synthetic
cgucaucucagccuuuauaaaagc

SEQ ID NO: 47549 - RNA, 18 nt, Artificial Sequence
  Synthetic
uccgggccccccugcagc

SEQ ID NO: 47550 - RNA, 19 nt, Artificial Sequence
  Synthetic
cuccgggccccccugcagc

SEQ ID NO: 47551 - RNA, 20 nt, Artificial Sequence
  Synthetic
ucuccgggccccccugcagc

SEQ ID NO: 47552 - RNA, 21 nt, Artificial Sequence
  Synthetic
cucuccgggccccccugcagc

SEQ ID NO: 47553 - RNA, 22 nt, Artificial Sequence
  Synthetic
gcucuccgggccccccugcagc

SEQ ID NO: 47554 - RNA, 23 nt, Artificial Sequence
  Synthetic
ggcucuccgggccccccugcagc

SEQ ID NO: 47555 - RNA, 24 nt, Artificial Sequence
  Synthetic
cggcucuccgggccccccugcagc

SEQ ID NO: 47556 - RNA, 18 nt, Artificial Sequence
  Synthetic
cagacaggggcaccgcgc

SEQ ID NO: 47557 - RNA, 19 nt, Artificial Sequence
  Synthetic
gcagacaggggcaccgcgc

SEQ ID NO: 47558 - RNA, 20 nt, Artificial Sequence
  Synthetic
ugcagacaggggcaccgcgc

SEQ ID NO: 47559 - RNA, 21 nt, Artificial Sequence
  Synthetic
cugcagacaggggcaccgcgc

SEQ ID NO: 47560 - RNA, 22 nt, Artificial Sequence
  Synthetic
ucugcagacaggggcaccgcgc

SEQ ID NO: 47561 - RNA, 23 nt, Artificial Sequence
  Synthetic
cucugcagacaggggcaccgcgc

SEQ ID NO: 47562 - RNA, 24 nt, Artificial Sequence
  Synthetic
gcucugcagacaggggcaccgcgc

SEQ ID NO: 47563 - RNA, 18 nt, Artificial Sequence
  Synthetic
gcgaaggccgcguacggc

SEQ ID NO: 47564 - RNA, 19 nt, Artificial Sequence
  Synthetic
ggcgaaggccgcguacggc

SEQ ID NO: 47565 - RNA, 20 nt, Artificial Sequence
  Synthetic
gggcgaaggccgcguacggc

SEQ ID NO: 47566 - RNA, 21 nt, Artificial Sequence
  Synthetic
ggggcgaaggccgcguacggc

SEQ ID NO: 47567 - RNA, 22 nt, Artificial Sequence
  Synthetic
cggggcgaaggccgcguacggc

SEQ ID NO: 47568 - RNA, 23 nt, Artificial Sequence
  Synthetic
acggggcgaaggccgcguacggc

SEQ ID NO: 47569 - RNA, 24 nt, Artificial Sequence
  Synthetic
cacggggcgaaggccgcguacggc

SEQ ID NO: 47570 - RNA, 18 nt, Artificial Sequence
  Synthetic
gacccaaggggccccggc

SEQ ID NO: 47571 - RNA, 19 nt, Artificial Sequence
  Synthetic
ggacccaaggggccccggc

SEQ ID NO: 47572 - RNA, 20 nt, Artificial Sequence
  Synthetic
cggacccaaggggccccggc

SEQ ID NO: 47573 - RNA, 21 nt, Artificial Sequence
  Synthetic
gcggacccaaggggccccggc

SEQ ID NO: 47574 - RNA, 22 nt, Artificial Sequence
  Synthetic
ggcggacccaaggggccccggc

SEQ ID NO: 47575 - RNA, 23 nt, Artificial Sequence
  Synthetic
cggcggacccaaggggccccggc

SEQ ID NO: 47576 - RNA, 24 nt, Artificial Sequence
  Synthetic
ccggcggacccaaggggccccggc

SEQ ID NO: 47577 - RNA, 18 nt, Artificial Sequence
  Synthetic
cccccguggcggcccggc

SEQ ID NO: 47578 - RNA, 19 nt, Artificial Sequence
  Synthetic
gcccccguggcggcccggc

SEQ ID NO: 47579 - RNA, 20 nt, Artificial Sequence
  Synthetic
ggcccccguggcggcccggc

SEQ ID NO: 47580 - RNA, 21 nt, Artificial Sequence
  Synthetic
cggcccccguggcggcccggc

SEQ ID NO: 47581 - RNA, 22 nt, Artificial Sequence
  Synthetic
ccggcccccguggcggcccggc

SEQ ID NO: 47582 - RNA, 23 nt, Artificial Sequence
  Synthetic
gccggcccccguggcggcccggc

SEQ ID NO: 47583 - RNA, 24 nt, Artificial Sequence
  Synthetic
ggccggcccccguggcggcccggc

SEQ ID NO: 47584 - RNA, 18 nt, Artificial Sequence
  Synthetic
cuuuuccggguucccggc

SEQ ID NO: 47585 - RNA, 19 nt, Artificial Sequence
  Synthetic
gcuuuuccggguucccggc

SEQ ID NO: 47586 - RNA, 20 nt, Artificial Sequence
  Synthetic
ggcuuuuccggguucccggc

SEQ ID NO: 47587 - RNA, 21 nt, Artificial Sequence
  Synthetic
aggcuuuuccggguucccggc

SEQ ID NO: 47588 - RNA, 22 nt, Artificial Sequence
  Synthetic
gaggcuuuuccggguucccggc

SEQ ID NO: 47589 - RNA, 23 nt, Artificial Sequence
  Synthetic
ggaggcuuuuccggguucccggc

SEQ ID NO: 47590 - RNA, 24 nt, Artificial Sequence
  Synthetic
cggaggcuuuuccggguucccggc

SEQ ID NO: 47591 - RNA, 18 nt, Artificial Sequence
  Synthetic
ggguucccggcccggggc

SEQ ID NO: 47592 - RNA, 19 nt, Artificial Sequence
  Synthetic
cggguucccggcccggggc

SEQ ID NO: 47593 - RNA, 20 nt, Artificial Sequence
  Synthetic
ccggguucccggcccggggc

SEQ ID NO: 47594 - RNA, 21 nt, Artificial Sequence
  Synthetic
uccggguucccggcccggggc

SEQ ID NO: 47595 - RNA, 22 nt, Artificial Sequence
  Synthetic
uuccggguucccggcccggggc

SEQ ID NO: 47596 - RNA, 23 nt, Artificial Sequence
  Synthetic
uuuccggguucccggcccggggc

SEQ ID NO: 47597 - RNA, 24 nt, Artificial Sequence
  Synthetic
uuuuccggguucccggcccggggc

SEQ ID NO: 47598 - RNA, 18 nt, Artificial Sequence
  Synthetic
ucguucgucuguccccuc

SEQ ID NO: 47599 - RNA, 19 nt, Artificial Sequence
  Synthetic
uucguucgucuguccccuc

SEQ ID NO: 47600 - RNA, 20 nt, Artificial Sequence
  Synthetic
uuucguucgucuguccccuc

SEQ ID NO: 47601 - RNA, 21 nt, Artificial Sequence
  Synthetic
guuucguucgucuguccccuc

SEQ ID NO: 47602 - RNA, 22 nt, Artificial Sequence
  Synthetic
uguuucguucgucuguccccuc

SEQ ID NO: 47603 - RNA, 23 nt, Artificial Sequence
  Synthetic
auguuucguucgucuguccccuc

SEQ ID NO: 47604 - RNA, 24 nt, Artificial Sequence
  Synthetic
aauguuucguucgucuguccccuc

SEQ ID NO: 47605 - RNA, 18 nt, Artificial Sequence
  Synthetic
ucucagccuuuauaaaag

SEQ ID NO: 47606 - RNA, 19 nt, Artificial Sequence
  Synthetic
aucucagccuuuauaaaag

SEQ ID NO: 47607 - RNA, 20 nt, Artificial Sequence
  Synthetic
caucucagccuuuauaaaag

SEQ ID NO: 47608 - RNA, 21 nt, Artificial Sequence
  Synthetic
ucaucucagccuuuauaaaag

SEQ ID NO: 47609 - RNA, 22 nt, Artificial Sequence
  Synthetic
gucaucucagccuuuauaaaag

SEQ ID NO: 47610 - RNA, 23 nt, Artificial Sequence
  Synthetic
cgucaucucagccuuuauaaaag

SEQ ID NO: 47611 - RNA, 24 nt, Artificial Sequence
  Synthetic
gcgucaucucagccuuuauaaaag

SEQ ID NO: 47612 - RNA, 18 nt, Artificial Sequence
  Synthetic
ggauggaaggacgggaag

SEQ ID NO: 47613 - RNA, 19 nt, Artificial Sequence
  Synthetic
gggauggaaggacgggaag

SEQ ID NO: 47614 - RNA, 20 nt, Artificial Sequence
  Synthetic
ggggauggaaggacgggaag

SEQ ID NO: 47615 - RNA, 21 nt, Artificial Sequence
  Synthetic
gggggauggaaggacgggaag

SEQ ID NO: 47616 - RNA, 22 nt, Artificial Sequence
  Synthetic
cgggggauggaaggacgggaag

SEQ ID NO: 47617 - RNA, 23 nt, Artificial Sequence
  Synthetic
acgggggauggaaggacgggaag

SEQ ID NO: 47618 - RNA, 24 nt, Artificial Sequence
  Synthetic
aacgggggauggaaggacgggaag

SEQ ID NO: 47619 - RNA, 18 nt, Artificial Sequence
  Synthetic
aaauccauuaggccgcag

SEQ ID NO: 47620 - RNA, 19 nt, Artificial Sequence
  Synthetic
gaaauccauuaggccgcag

SEQ ID NO: 47621 - RNA, 20 nt, Artificial Sequence
  Synthetic
ggaaauccauuaggccgcag

SEQ ID NO: 47622 - RNA, 21 nt, Artificial Sequence
  Synthetic
cggaaauccauuaggccgcag

SEQ ID NO: 47623 - RNA, 22 nt, Artificial Sequence
  Synthetic
ccggaaauccauuaggccgcag

SEQ ID NO: 47624 - RNA, 23 nt, Artificial Sequence
  Synthetic
cccggaaauccauuaggccgcag

SEQ ID NO: 47625 - RNA, 24 nt, Artificial Sequence
  Synthetic
gcccggaaauccauuaggccgcag

SEQ ID NO: 47626 - RNA, 18 nt, Artificial Sequence
  Synthetic
cuccgggccccccugcag

SEQ ID NO: 47627 - RNA, 19 nt, Artificial Sequence
  Synthetic
ucuccgggccccccugcag

SEQ ID NO: 47628 - RNA, 20 nt, Artificial Sequence
  Synthetic
cucuccgggccccccugcag

SEQ ID NO: 47629 - RNA, 21 nt, Artificial Sequence
  Synthetic
gcucuccgggccccccugcag

SEQ ID NO: 47630 - RNA, 22 nt, Artificial Sequence
  Synthetic
ggcucuccgggccccccugcag

SEQ ID NO: 47631 - RNA, 23 nt, Artificial Sequence
  Synthetic
cggcucuccgggccccccugcag

SEQ ID NO: 47632 - RNA, 24 nt, Artificial Sequence
  Synthetic
gcggcucuccgggccccccugcag

SEQ ID NO: 47633 - RNA, 18 nt, Artificial Sequence
  Synthetic
cccggcccggggccugag

SEQ ID NO: 47634 - RNA, 19 nt, Artificial Sequence
  Synthetic
ucccggcccggggccugag

SEQ ID NO: 47635 - RNA, 20 nt, Artificial Sequence
  Synthetic
uucccggcccggggccugag

SEQ ID NO: 47636 - RNA, 21 nt, Artificial Sequence
  Synthetic
guucccggcccggggccugag

SEQ ID NO: 47637 - RNA, 22 nt, Artificial Sequence
  Synthetic
gguucccggcccggggccugag

SEQ ID NO: 47638 - RNA, 23 nt, Artificial Sequence
  Synthetic
ggguucccggcccggggccugag

SEQ ID NO: 47639 - RNA, 24 nt, Artificial Sequence
  Synthetic
cggguucccggcccggggccugag

SEQ ID NO: 47640 - RNA, 18 nt, Artificial Sequence
  Synthetic
uccauuaggccgcagacg

SEQ ID NO: 47641 - RNA, 19 nt, Artificial Sequence
  Synthetic
auccauuaggccgcagacg

SEQ ID NO: 47642 - RNA, 20 nt, Artificial Sequence
  Synthetic
aauccauuaggccgcagacg

SEQ ID NO: 47643 - RNA, 21 nt, Artificial Sequence
  Synthetic
aaauccauuaggccgcagacg

SEQ ID NO: 47644 - RNA, 22 nt, Artificial Sequence
  Synthetic
gaaauccauuaggccgcagacg

SEQ ID NO: 47645 - RNA, 23 nt, Artificial Sequence
  Synthetic
ggaaauccauuaggccgcagacg

SEQ ID NO: 47646 - RNA, 24 nt, Artificial Sequence
  Synthetic
cggaaauccauuaggccgcagacg

SEQ ID NO: 47647 - RNA, 18 nt, Artificial Sequence
  Synthetic
cgcguacggcccgggacg

SEQ ID NO: 47648 - RNA, 19 nt, Artificial Sequence
  Synthetic
ccgcguacggcccgggacg

SEQ ID NO: 47649 - RNA, 20 nt, Artificial Sequence
  Synthetic
gccgcguacggcccgggacg

SEQ ID NO: 47650 - RNA, 21 nt, Artificial Sequence
  Synthetic
ggccgcguacggcccgggacg

SEQ ID NO: 47651 - RNA, 22 nt, Artificial Sequence
  Synthetic
aggccgcguacggcccgggacg

SEQ ID NO: 47652 - RNA, 23 nt, Artificial Sequence
  Synthetic
aaggccgcguacggcccgggacg

SEQ ID NO: 47653 - RNA, 24 nt, Artificial Sequence
  Synthetic
gaaggccgcguacggcccgggacg

SEQ ID NO: 47654 - RNA, 18 nt, Artificial Sequence
  Synthetic
cagccgccgccgacaccg

SEQ ID NO: 47655 - RNA, 19 nt, Artificial Sequence
  Synthetic
gcagccgccgccgacaccg

SEQ ID NO: 47656 - RNA, 20 nt, Artificial Sequence
  Synthetic
cgcagccgccgccgacaccg

SEQ ID NO: 47657 - RNA, 21 nt, Artificial Sequence
  Synthetic
ccgcagccgccgccgacaccg

SEQ ID NO: 47658 - RNA, 22 nt, Artificial Sequence
  Synthetic
gccgcagccgccgccgacaccg

SEQ ID NO: 47659 - RNA, 23 nt, Artificial Sequence
  Synthetic
cgccgcagccgccgccgacaccg

SEQ ID NO: 47660 - RNA, 24 nt, Artificial Sequence
  Synthetic
ccgccgcagccgccgccgacaccg

SEQ ID NO: 47661 - RNA, 18 nt, Artificial Sequence
  Synthetic
gcccggcccggggccccg

SEQ ID NO: 47662 - RNA, 19 nt, Artificial Sequence
  Synthetic
ggcccggcccggggccccg

SEQ ID NO: 47663 - RNA, 20 nt, Artificial Sequence
  Synthetic
cggcccggcccggggccccg

SEQ ID NO: 47664 - RNA, 21 nt, Artificial Sequence
  Synthetic
gcggcccggcccggggccccg

SEQ ID NO: 47665 - RNA, 22 nt, Artificial Sequence
  Synthetic
ggcggcccggcccggggccccg

SEQ ID NO: 47666 - RNA, 23 nt, Artificial Sequence
  Synthetic
uggcggcccggcccggggccccg

SEQ ID NO: 47667 - RNA, 24 nt, Artificial Sequence
  Synthetic
guggcggcccggcccggggccccg

SEQ ID NO: 47668 - RNA, 18 nt, Artificial Sequence
  Synthetic
guguuuuucguuccgucg

SEQ ID NO: 47669 - RNA, 19 nt, Artificial Sequence
  Synthetic
gguguuuuucguuccgucg

SEQ ID NO: 47670 - RNA, 20 nt, Artificial Sequence
  Synthetic
ggguguuuuucguuccgucg

SEQ ID NO: 47671 - RNA, 21 nt, Artificial Sequence
  Synthetic
gggguguuuuucguuccgucg

SEQ ID NO: 47672 - RNA, 22 nt, Artificial Sequence
  Synthetic
ugggguguuuuucguuccgucg

SEQ ID NO: 47673 - RNA, 23 nt, Artificial Sequence
  Synthetic
cugggguguuuuucguuccgucg

SEQ ID NO: 47674 - RNA, 24 nt, Artificial Sequence
  Synthetic
ucugggguguuuuucguuccgucg

SEQ ID NO: 47675 - RNA, 18 nt, Artificial Sequence
  Synthetic
ggaacgggggauggaagg

SEQ ID NO: 47676 - RNA, 19 nt, Artificial Sequence
  Synthetic
gggaacgggggauggaagg

SEQ ID NO: 47677 - RNA, 20 nt, Artificial Sequence
  Synthetic
ggggaacgggggauggaagg

SEQ ID NO: 47678 - RNA, 21 nt, Artificial Sequence
  Synthetic
aggggaacgggggauggaagg

SEQ ID NO: 47679 - RNA, 22 nt, Artificial Sequence
  Synthetic
gaggggaacgggggauggaagg

SEQ ID NO: 47680 - RNA, 23 nt, Artificial Sequence
  Synthetic
cgaggggaacgggggauggaagg

SEQ ID NO: 47681 - RNA, 24 nt, Artificial Sequence
  Synthetic
ccgaggggaacgggggauggaagg

SEQ ID NO: 47682 - RNA, 18 nt, Artificial Sequence
  Synthetic
acucacaagcggcagagg

SEQ ID NO: 47683 - RNA, 19 nt, Artificial Sequence
  Synthetic
cacucacaagcggcagagg

SEQ ID NO: 47684 - RNA, 20 nt, Artificial Sequence
  Synthetic
gcacucacaagcggcagagg

SEQ ID NO: 47685 - RNA, 21 nt, Artificial Sequence
  Synthetic
cgcacucacaagcggcagagg

SEQ ID NO: 47686 - RNA, 22 nt, Artificial Sequence
  Synthetic
gcgcacucacaagcggcagagg

SEQ ID NO: 47687 - RNA, 23 nt, Artificial Sequence
  Synthetic
cgcgcacucacaagcggcagagg

SEQ ID NO: 47688 - RNA, 24 nt, Artificial Sequence
  Synthetic
gcgcgcacucacaagcggcagagg

SEQ ID NO: 47689 - RNA, 18 nt, Artificial Sequence
  Synthetic
gcgcgcacucacaagcgg

SEQ ID NO: 47690 - RNA, 19 nt, Artificial Sequence
  Synthetic
cgcgcgcacucacaagcgg

SEQ ID NO: 47691 - RNA, 20 nt, Artificial Sequence
  Synthetic
gcgcgcgcacucacaagcgg

SEQ ID NO: 47692 - RNA, 21 nt, Artificial Sequence
  Synthetic
ggcgcgcgcacucacaagcgg

SEQ ID NO: 47693 - RNA, 22 nt, Artificial Sequence
  Synthetic
cggcgcgcgcacucacaagcgg

SEQ ID NO: 47694 - RNA, 23 nt, Artificial Sequence
  Synthetic
ccggcgcgcgcacucacaagcgg

SEQ ID NO: 47695 - RNA, 24 nt, Artificial Sequence
  Synthetic
gccggcgcgcgcacucacaagcgg

SEQ ID NO: 47696 - RNA, 18 nt, Artificial Sequence
  Synthetic
cgucuguccccucacggg

SEQ ID NO: 47697 - RNA, 19 nt, Artificial Sequence
  Synthetic
ucgucuguccccucacggg

SEQ ID NO: 47698 - RNA, 20 nt, Artificial Sequence
  Synthetic
uucgucuguccccucacggg

SEQ ID NO: 47699 - RNA, 21 nt, Artificial Sequence
  Synthetic
guucgucuguccccucacggg

SEQ ID NO: 47700 - RNA, 22 nt, Artificial Sequence
  Synthetic
cguucgucuguccccucacggg

SEQ ID NO: 47701 - RNA, 23 nt, Artificial Sequence
  Synthetic
ucguucgucuguccccucacggg

SEQ ID NO: 47702 - RNA, 24 nt, Artificial Sequence
  Synthetic
uucguucgucuguccccucacggg

SEQ ID NO: 47703 - RNA, 18 nt, Artificial Sequence
  Synthetic
ggccgcguacggcccggg

SEQ ID NO: 47704 - RNA, 19 nt, Artificial Sequence
  Synthetic
aggccgcguacggcccggg

SEQ ID NO: 47705 - RNA, 20 nt, Artificial Sequence
  Synthetic
aaggccgcguacggcccggg

SEQ ID NO: 47706 - RNA, 21 nt, Artificial Sequence
  Synthetic
gaaggccgcguacggcccggg

SEQ ID NO: 47707 - RNA, 22 nt, Artificial Sequence
  Synthetic
cgaaggccgcguacggcccggg

SEQ ID NO: 47708 - RNA, 23 nt, Artificial Sequence
  Synthetic
gcgaaggccgcguacggcccggg

SEQ ID NO: 47709 - RNA, 24 nt, Artificial Sequence
  Synthetic
ggcgaaggccgcguacggcccggg

SEQ ID NO: 47710 - RNA, 18 nt, Artificial Sequence
  Synthetic
aaccgaggggaacggggg

SEQ ID NO: 47711 - RNA, 19 nt, Artificial Sequence
  Synthetic
caaccgaggggaacggggg

SEQ ID NO: 47712 - RNA, 20 nt, Artificial Sequence
  Synthetic
acaaccgaggggaacggggg

SEQ ID NO: 47713 - RNA, 21 nt, Artificial Sequence
  Synthetic
aacaaccgaggggaacggggg

SEQ ID NO: 47714 - RNA, 22 nt, Artificial Sequence
  Synthetic
gaacaaccgaggggaacggggg

SEQ ID NO: 47715 - RNA, 23 nt, Artificial Sequence
  Synthetic
ggaacaaccgaggggaacggggg

SEQ ID NO: 47716 - RNA, 24 nt, Artificial Sequence
  Synthetic
aggaacaaccgaggggaacggggg

SEQ ID NO: 47717 - RNA, 18 nt, Artificial Sequence
  Synthetic
gaggggaacgggggaugg

SEQ ID NO: 47718 - RNA, 19 nt, Artificial Sequence
  Synthetic
cgaggggaacgggggaugg

SEQ ID NO: 47719 - RNA, 20 nt, Artificial Sequence
  Synthetic
ccgaggggaacgggggaugg

SEQ ID NO: 47720 - RNA, 21 nt, Artificial Sequence
  Synthetic
accgaggggaacgggggaugg

SEQ ID NO: 47721 - RNA, 22 nt, Artificial Sequence
  Synthetic
aaccgaggggaacgggggaugg

SEQ ID NO: 47722 - RNA, 23 nt, Artificial Sequence
  Synthetic
caaccgaggggaacgggggaugg

SEQ ID NO: 47723 - RNA, 24 nt, Artificial Sequence
  Synthetic
acaaccgaggggaacgggggaugg

SEQ ID NO: 47724 - RNA, 18 nt, Artificial Sequence
  Synthetic
uccccguuucgggggugg

SEQ ID NO: 47725 - RNA, 19 nt, Artificial Sequence
  Synthetic
uuccccguuucgggggugg

SEQ ID NO: 47726 - RNA, 20 nt, Artificial Sequence
  Synthetic
uuuccccguuucgggggugg

SEQ ID NO: 47727 - RNA, 21 nt, Artificial Sequence
  Synthetic
uuuuccccguuucgggggugg

SEQ ID NO: 47728 - RNA, 22 nt, Artificial Sequence
  Synthetic
guuuuccccguuucgggggugg

SEQ ID NO: 47729 - RNA, 23 nt, Artificial Sequence
  Synthetic
cguuuuccccguuucgggggugg

SEQ ID NO: 47730 - RNA, 24 nt, Artificial Sequence
  Synthetic
ucguuuuccccguuucgggggugg

SEQ ID NO: 47731 - RNA, 18 nt, Artificial Sequence
  Synthetic
uuccccguuucgggggug

SEQ ID NO: 47732 - RNA, 19 nt, Artificial Sequence
  Synthetic
uuuccccguuucgggggug

SEQ ID NO: 47733 - RNA, 20 nt, Artificial Sequence
  Synthetic
uuuuccccguuucgggggug

SEQ ID NO: 47734 - RNA, 21 nt, Artificial Sequence
  Synthetic
guuuuccccguuucgggggug

SEQ ID NO: 47735 - RNA, 22 nt, Artificial Sequence
  Synthetic
cguuuuccccguuucgggggug

SEQ ID NO: 47736 - RNA, 23 nt, Artificial Sequence
  Synthetic
ucguuuuccccguuucgggggug

SEQ ID NO: 47737 - RNA, 24 nt, Artificial Sequence
  Synthetic
uucguuuuccccguuucgggggug

SEQ ID NO: 47738 - RNA, 18 nt, Artificial Sequence
  Synthetic
uccgggugccgcggcucu

SEQ ID NO: 47739 - RNA, 19 nt, Artificial Sequence
  Synthetic
guccgggugccgcggcucu

SEQ ID NO: 47740 - RNA, 20 nt, Artificial Sequence
  Synthetic
cguccgggugccgcggcucu

SEQ ID NO: 47741 - RNA, 21 nt, Artificial Sequence
  Synthetic
gcguccgggugccgcggcucu

SEQ ID NO: 47742 - RNA, 22 nt, Artificial Sequence
  Synthetic
cgcguccgggugccgcggcucu

SEQ ID NO: 47743 - RNA, 23 nt, Artificial Sequence
  Synthetic
gcgcguccgggugccgcggcucu

SEQ ID NO: 47744 - RNA, 24 nt, Artificial Sequence
  Synthetic
ggcgcguccgggugccgcggcucu

SEQ ID NO: 47745 - RNA, 18 nt, Artificial Sequence
  Synthetic
ucuguuucuuuaacccgu

SEQ ID NO: 47746 - RNA, 19 nt, Artificial Sequence
  Synthetic
uucuguuucuuuaacccgu

SEQ ID NO: 47747 - RNA, 20 nt, Artificial Sequence
  Synthetic
uuucuguuucuuuaacccgu

SEQ ID NO: 47748 - RNA, 21 nt, Artificial Sequence
  Synthetic
guuucuguuucuuuaacccgu

SEQ ID NO: 47749 - RNA, 22 nt, Artificial Sequence
  Synthetic
gguuucuguuucuuuaacccgu

SEQ ID NO: 47750 - RNA, 23 nt, Artificial Sequence
  Synthetic
cgguuucuguuucuuuaacccgu

SEQ ID NO: 47751 - RNA, 24 nt, Artificial Sequence
  Synthetic
gcgguuucuguuucuuuaacccgu

SEQ ID NO: 47752 - RNA, 18 nt, Artificial Sequence
  Synthetic
cggcgguccgggccccgu

SEQ ID NO: 47753 - RNA, 19 nt, Artificial Sequence
  Synthetic
gcggcgguccgggccccgu

SEQ ID NO: 47754 - RNA, 20 nt, Artificial Sequence
  Synthetic
cgcggcgguccgggccccgu

SEQ ID NO: 47755 - RNA, 21 nt, Artificial Sequence
  Synthetic
ccgcggcgguccgggccccgu

SEQ ID NO: 47756 - RNA, 22 nt, Artificial Sequence
  Synthetic
accgcggcgguccgggccccgu

SEQ ID NO: 47757 - RNA, 23 nt, Artificial Sequence
  Synthetic
gaccgcggcgguccgggccccgu

SEQ ID NO: 47758 - RNA, 24 nt, Artificial Sequence
  Synthetic
cgaccgcggcgguccgggccccgu

SEQ ID NO: 47759 - RNA, 18 nt, Artificial Sequence
  Synthetic
gcccccgaccgcggcggu

SEQ ID NO: 47760 - RNA, 19 nt, Artificial Sequence
  Synthetic
ggcccccgaccgcggcggu

SEQ ID NO: 47761 - RNA, 20 nt, Artificial Sequence
  Synthetic
gggcccccgaccgcggcggu

SEQ ID NO: 47762 - RNA, 21 nt, Artificial Sequence
  Synthetic
ggggcccccgaccgcggcggu

SEQ ID NO: 47763 - RNA, 22 nt, Artificial Sequence
  Synthetic
aggggcccccgaccgcggcggu

SEQ ID NO: 47764 - RNA, 23 nt, Artificial Sequence
  Synthetic
gaggggcccccgaccgcggcggu

SEQ ID NO: 47765 - RNA, 24 nt, Artificial Sequence
  Synthetic
cgaggggcccccgaccgcggcggu

SEQ ID NO: 47766 - RNA, 18 nt, Artificial Sequence
  Synthetic
gccccgcgccgguccauu

SEQ ID NO: 47767 - RNA, 19 nt, Artificial Sequence
  Synthetic
cgccccgcgccgguccauu

SEQ ID NO: 47768 - RNA, 20 nt, Artificial Sequence
  Synthetic
ccgccccgcgccgguccauu

SEQ ID NO: 47769 - RNA, 21 nt, Artificial Sequence
  Synthetic
cccgccccgcgccgguccauu

SEQ ID NO: 47770 - RNA, 22 nt, Artificial Sequence
  Synthetic
ccccgccccgcgccgguccauu

SEQ ID NO: 47771 - RNA, 23 nt, Artificial Sequence
  Synthetic
cccccgccccgcgccgguccauu

SEQ ID NO: 47772 - RNA, 24 nt, Artificial Sequence
  Synthetic
ccccccgccccgcgccgguccauu

SEQ ID NO: 47773 - RNA, 18 nt, Artificial Sequence
  Synthetic
uuuuucguuuuccccguu

SEQ ID NO: 47774 - RNA, 19 nt, Artificial Sequence
  Synthetic
uuuuuucguuuuccccguu

SEQ ID NO: 47775 - RNA, 20 nt, Artificial Sequence
  Synthetic
guuuuuucguuuuccccguu

SEQ ID NO: 47776 - RNA, 21 nt, Artificial Sequence
  Synthetic
uguuuuuucguuuuccccguu

SEQ ID NO: 47777 - RNA, 22 nt, Artificial Sequence
  Synthetic
cuguuuuuucguuuuccccguu

SEQ ID NO: 47778 - RNA, 23 nt, Artificial Sequence
  Synthetic
ucuguuuuuucguuuuccccguu

SEQ ID NO: 47779 - RNA, 24 nt, Artificial Sequence
  Synthetic
gucuguuuuuucguuuuccccguu

SEQ ID NO: 47780 - RNA, 18 nt, Artificial Sequence
  Synthetic
gguggugcgaaagacuuu

SEQ ID NO: 47781 - RNA, 19 nt, Artificial Sequence
  Synthetic
ggguggugcgaaagacuuu

SEQ ID NO: 47782 - RNA, 20 nt, Artificial Sequence
  Synthetic
cggguggugcgaaagacuuu

SEQ ID NO: 47783 - RNA, 18 nt, Artificial Sequence
  Synthetic
uuuucguuuuccccguuu

SEQ ID NO: 47784 - RNA, 19 nt, Artificial Sequence
  Synthetic
uuuuucguuuuccccguuu

SEQ ID NO: 47785 - RNA, 20 nt, Artificial Sequence
  Synthetic
uuuuuucguuuuccccguuu

SEQ ID NO: 47786 - RNA, 21 nt, Artificial Sequence
  Synthetic
guuuuuucguuuuccccguuu

SEQ ID NO: 47787 - RNA, 22 nt, Artificial Sequence
  Synthetic
uguuuuuucguuuuccccguuu

SEQ ID NO: 47788 - RNA, 23 nt, Artificial Sequence
  Synthetic
cuguuuuuucguuuuccccguuu

SEQ ID NO: 47789 - RNA, 24 nt, Artificial Sequence
  Synthetic
ucuguuuuuucguuuuccccguuu

SEQ ID NO: 47790 - RNA, 18 nt, Artificial Sequence
  Synthetic
ggucggacggguaaguaa

SEQ ID NO: 47791 - RNA, 20 nt, Artificial Sequence
  Synthetic
guggucggacggguaaguaa

SEQ ID NO: 47792 - RNA, 21 nt, Artificial Sequence
  Synthetic
gguggucggacggguaaguaa

SEQ ID NO: 47793 - RNA, 24 nt, Artificial Sequence
  Synthetic
guugguggucggacggguaaguaa

SEQ ID NO: 47794 - RNA, 18 nt, Artificial Sequence
  Synthetic
ggggucccgggggcggga

SEQ ID NO: 47795 - RNA, 20 nt, Artificial Sequence
  Synthetic
guggggucccgggggcggga

SEQ ID NO: 47796 - RNA, 18 nt, Artificial Sequence
  Synthetic
gggagaaggcgaggagac

SEQ ID NO: 47797 - RNA, 20 nt, Artificial Sequence
  Synthetic
gugggagaaggcgaggagac

SEQ ID NO: 47798 - RNA, 21 nt, Artificial Sequence
  Synthetic
ggugggagaaggcgaggagac

SEQ ID NO: 47799 - RNA, 22 nt, Artificial Sequence
  Synthetic
gggugggagaaggcgaggagac

SEQ ID NO: 47800 - RNA, 24 nt, Artificial Sequence
  Synthetic
gugggugggagaaggcgaggagac

SEQ ID NO: 47801 - RNA, 22 nt, Artificial Sequence
  Synthetic
gacacaugccuucuuggaguac

SEQ ID NO: 47802 - RNA, 23 nt, Artificial Sequence
  Synthetic
ggacacaugccuucuuggaguac

SEQ ID NO: 47803 - RNA, 24 nt, Artificial Sequence
  Synthetic
gggacacaugccuucuuggaguac

SEQ ID NO: 47804 - RNA, 20 nt, Artificial Sequence
  Synthetic
gcuguaacacgagcccaccc

SEQ ID NO: 47805 - RNA, 22 nt, Artificial Sequence
  Synthetic
gugcuguaacacgagcccaccc

SEQ ID NO: 47806 - RNA, 24 nt, Artificial Sequence
  Synthetic
gugugcuguaacacgagcccaccc

SEQ ID NO: 47807 - RNA, 18 nt, Artificial Sequence
  Synthetic
gucgggaucgugcgggcc

SEQ ID NO: 47808 - RNA, 21 nt, Artificial Sequence
  Synthetic
guugucgggaucgugcgggcc

SEQ ID NO: 47809 - RNA, 20 nt, Artificial Sequence
  Synthetic
gcaggggcgggggcgugggc

SEQ ID NO: 47810 - RNA, 21 nt, Artificial Sequence
  Synthetic
ggcaggggcgggggcgugggc

SEQ ID NO: 47811 - RNA, 22 nt, Artificial Sequence
  Synthetic
gggcaggggcgggggcgugggc

SEQ ID NO: 47812 - RNA, 23 nt, Artificial Sequence
  Synthetic
ggggcaggggcgggggcgugggc

SEQ ID NO: 47813 - RNA, 20 nt, Artificial Sequence
  Synthetic
guccccuccguccccccguc

SEQ ID NO: 47814 - RNA, 23 nt, Artificial Sequence
  Synthetic
gacaccggggcgcccucgacgag

SEQ ID NO: 47815 - RNA, 18 nt, Artificial Sequence
  Synthetic
ggggcuggguaucccgag

SEQ ID NO: 47816 - RNA, 22 nt, Artificial Sequence
  Synthetic
gaccggggcuggguaucccgag

SEQ ID NO: 47817 - RNA, 23 nt, Artificial Sequence
  Synthetic
ggaccggggcuggguaucccgag

SEQ ID NO: 47818 - RNA, 24 nt, Artificial Sequence
  Synthetic
gggaccggggcuggguaucccgag

SEQ ID NO: 47819 - RNA, 18 nt, Artificial Sequence
  Synthetic
ggggaggaagggagggag

SEQ ID NO: 47820 - RNA, 19 nt, Artificial Sequence
  Synthetic
gggggaggaagggagggag

SEQ ID NO: 47821 - RNA, 20 nt, Artificial Sequence
  Synthetic
gaccgggcucagugggggcg

SEQ ID NO: 47822 - RNA, 24 nt, Artificial Sequence
  Synthetic
gaucgaccgggcucagugggggcg

SEQ ID NO: 47823 - RNA, 18 nt, Artificial Sequence
  Synthetic
gacaccggggcgcccucg

SEQ ID NO: 47824 - RNA, 22 nt, Artificial Sequence
  Synthetic
gaacgacaccggggcgcccucg

SEQ ID NO: 47825 - RNA, 19 nt, Artificial Sequence
  Synthetic
gacuggggugggggugucg

SEQ ID NO: 47826 - RNA, 21 nt, Artificial Sequence
  Synthetic
gagacuggggugggggugucg

SEQ ID NO: 47827 - RNA, 22 nt, Artificial Sequence
  Synthetic
ggagacuggggugggggugucg

SEQ ID NO: 47828 - RNA, 24 nt, Artificial Sequence
  Synthetic
gaggagacuggggugggggugucg

SEQ ID NO: 47829 - RNA, 20 nt, Artificial Sequence
  Synthetic
gccaggcacaaaaacacagg

SEQ ID NO: 47830 - RNA, 22 nt, Artificial Sequence
  Synthetic
gagccaggcacaaaaacacagg

SEQ ID NO: 47831 - RNA, 24 nt, Artificial Sequence
  Synthetic
gagagccaggcacaaaaacacagg

SEQ ID NO: 47832 - RNA, 18 nt, Artificial Sequence
  Synthetic
ggggcaguugguggucgg

SEQ ID NO: 47833 - RNA, 19 nt, Artificial Sequence
  Synthetic
gggggcaguugguggucgg

SEQ ID NO: 47834 - RNA, 24 nt, Artificial Sequence
  Synthetic
gauaagggggcaguugguggucgg

SEQ ID NO: 47835 - RNA, 18 nt, Artificial Sequence
  Synthetic
gggaacgggggaccgggg

SEQ ID NO: 47836 - RNA, 19 nt, Artificial Sequence
  Synthetic
ggggaacgggggaccgggg

SEQ ID NO: 47837 - RNA, 23 nt, Artificial Sequence
  Synthetic
gcuuauauguggggucccggggg

SEQ ID NO: 47838 - RNA, 24 nt, Artificial Sequence
  Synthetic
ggcuuauauguggggucccggggg

SEQ ID NO: 47839 - RNA, 18 nt, Artificial Sequence
  Synthetic
gcucagugggggcguggg

SEQ ID NO: 47840 - RNA, 19 nt, Artificial Sequence
  Synthetic
ggcucagugggggcguggg

SEQ ID NO: 47841 - RNA, 20 nt, Artificial Sequence
  Synthetic
gggcucagugggggcguggg

SEQ ID NO: 47842 - RNA, 24 nt, Artificial Sequence
  Synthetic
gaccgggcucagugggggcguggg

SEQ ID NO: 47843 - RNA, 19 nt, Artificial Sequence
  Synthetic
gcuggguaucccgaggugg

SEQ ID NO: 47844 - RNA, 20 nt, Artificial Sequence
  Synthetic
ggcuggguaucccgaggugg

SEQ ID NO: 47845 - RNA, 21 nt, Artificial Sequence
  Synthetic
gggcuggguaucccgaggugg

SEQ ID NO: 47846 - RNA, 22 nt, Artificial Sequence
  Synthetic
ggggcuggguaucccgaggugg

SEQ ID NO: 47847 - RNA, 19 nt, Artificial Sequence
  Synthetic
guggcugggggcuuauaug

SEQ ID NO: 47848 - RNA, 21 nt, Artificial Sequence
  Synthetic
guguggcugggggcuuauaug

SEQ ID NO: 47849 - RNA, 23 nt, Artificial Sequence
  Synthetic
gcguguggcugggggcuuauaug

SEQ ID NO: 47850 - RNA, 20 nt, Artificial Sequence
  Synthetic
guacgugggucauuggcgug

SEQ ID NO: 47851 - RNA, 22 nt, Artificial Sequence
  Synthetic
gaguacgugggucauuggcgug

SEQ ID NO: 47852 - RNA, 23 nt, Artificial Sequence
  Synthetic
ggaguacgugggucauuggcgug

SEQ ID NO: 47853 - RNA, 20 nt, Artificial Sequence
  Synthetic
guaaguaacagagucugacu

SEQ ID NO: 47854 - RNA, 21 nt, Artificial Sequence
  Synthetic
gguaaguaacagagucugacu

SEQ ID NO: 47855 - RNA, 22 nt, Artificial Sequence
  Synthetic
ggguaaguaacagagucugacu

SEQ ID NO: 47856 - RNA, 18 nt, Artificial Sequence
  Synthetic
gggagggaggaggguacu

SEQ ID NO: 47857 - RNA, 21 nt, Artificial Sequence
  Synthetic
gaagggagggaggaggguacu

SEQ ID NO: 47858 - RNA, 22 nt, Artificial Sequence
  Synthetic
ggaagggagggaggaggguacu

SEQ ID NO: 47859 - RNA, 24 nt, Artificial Sequence
  Synthetic
gaggaagggagggaggaggguacu

SEQ ID NO: 47860 - RNA, 18 nt, Artificial Sequence
  Synthetic
gugggacacaugccuucu

SEQ ID NO: 47861 - RNA, 19 nt, Artificial Sequence
  Synthetic
ggugggacacaugccuucu

SEQ ID NO: 47862 - RNA, 20 nt, Artificial Sequence
  Synthetic
gggugggacacaugccuucu

SEQ ID NO: 47863 - RNA, 21 nt, Artificial Sequence
  Synthetic
ggggugggacacaugccuucu

SEQ ID NO: 47864 - RNA, 23 nt, Artificial Sequence
  Synthetic
gcggggugggacacaugccuucu

SEQ ID NO: 47865 - RNA, 24 nt, Artificial Sequence
  Synthetic
ggcggggugggacacaugccuucu

SEQ ID NO: 47866 - RNA, 23 nt, Artificial Sequence
  Synthetic
gccucuggggcgcccccugucgu

SEQ ID NO: 47867 - RNA, 20 nt, Artificial Sequence
  Synthetic
gaaggcgaggagacuggggu

SEQ ID NO: 47868 - RNA, 22 nt, Artificial Sequence
  Synthetic
gagaaggcgaggagacuggggu

SEQ ID NO: 47869 - RNA, 23 nt, Artificial Sequence
  Synthetic
ggagaaggcgaggagacuggggu

SEQ ID NO: 47870 - RNA, 24 nt, Artificial Sequence
  Synthetic
gggagaaggcgaggagacuggggu

SEQ ID NO: 47871 - RNA, 20 nt, Artificial Sequence
  Synthetic
guugggguuguuauuguugu

SEQ ID NO: 47872 - RNA, 19 nt, Artificial Sequence
  Synthetic
gccggcuggaagaccgcca

SEQ ID NO: 47873 - RNA, 20 nt, Artificial Sequence
  Synthetic
ggccggcuggaagaccgcca

SEQ ID NO: 47874 - RNA, 21 nt, Artificial Sequence
  Synthetic
gggccggcuggaagaccgcca

SEQ ID NO: 47875 - RNA, 19 nt, Artificial Sequence
  Synthetic
gacggaggggacggaggga

SEQ ID NO: 47876 - RNA, 20 nt, Artificial Sequence
  Synthetic
ggacggaggggacggaggga

SEQ ID NO: 47877 - RNA, 21 nt, Artificial Sequence
  Synthetic
gggacggaggggacggaggga

SEQ ID NO: 47878 - RNA, 22 nt, Artificial Sequence
  Synthetic
ggggacggaggggacggaggga

SEQ ID NO: 47879 - RNA, 23 nt, Artificial Sequence
  Synthetic
gggggacggaggggacggaggga

SEQ ID NO: 47880 - RNA, 24 nt, Artificial Sequence
  Synthetic
ggggggacggaggggacggaggga

SEQ ID NO: 47881 - RNA, 18 nt, Artificial Sequence
  Synthetic
gugccuggcucucuaugc

SEQ ID NO: 47882 - RNA, 24 nt, Artificial Sequence
  Synthetic
guuuuugugccuggcucucuaugc

SEQ ID NO: 47883 - RNA, 22 nt, Artificial Sequence
  Synthetic
gcuaaggucggccacgccacuc

SEQ ID NO: 47884 - RNA, 23 nt, Artificial Sequence
  Synthetic
ggcuaaggucggccacgccacuc

SEQ ID NO: 47885 - RNA, 19 nt, Artificial Sequence
  Synthetic
gccgcccacccacccaccu

SEQ ID NO: 47886 - RNA, 22 nt, Artificial Sequence
  Synthetic
guuuauuuaaauaaaccaaugu

SEQ ID NO: 47887 - RNA, 24 nt, Artificial Sequence
  Synthetic
guguuuauuuaaauaaaccaaugu

SEQ ID NO: 47888 - RNA, 19 nt, Artificial Sequence
  Synthetic
uggucggacggguaaguaa

SEQ ID NO: 47889 - RNA, 22 nt, Artificial Sequence
  Synthetic
ugguggucggacggguaaguaa

SEQ ID NO: 47890 - RNA, 23 nt, Artificial Sequence
  Synthetic
uugguggucggacggguaaguaa

SEQ ID NO: 47891 - RNA, 19 nt, Artificial Sequence
  Synthetic
uggggucccgggggcggga

SEQ ID NO: 47892 - RNA, 21 nt, Artificial Sequence
  Synthetic
uguggggucccgggggcggga

SEQ ID NO: 47893 - RNA, 22 nt, Artificial Sequence
  Synthetic
auguggggucccgggggcggga

SEQ ID NO: 47894 - RNA, 23 nt, Artificial Sequence
  Synthetic
uauguggggucccgggggcggga

SEQ ID NO: 47895 - RNA, 24 nt, Artificial Sequence
  Synthetic
auauguggggucccgggggcggga

SEQ ID NO: 47896 - RNA, 19 nt, Artificial Sequence
  Synthetic
ugggagaaggcgaggagac

SEQ ID NO: 47897 - RNA, 23 nt, Artificial Sequence
  Synthetic
ugggugggagaaggcgaggagac

SEQ ID NO: 47898 - RNA, 18 nt, Artificial Sequence
  Synthetic
caugccuucuuggaguac

SEQ ID NO: 47899 - RNA, 19 nt, Artificial Sequence
  Synthetic
acaugccuucuuggaguac

SEQ ID NO: 47900 - RNA, 20 nt, Artificial Sequence
  Synthetic
cacaugccuucuuggaguac

SEQ ID NO: 47901 - RNA, 21 nt, Artificial Sequence
  Synthetic
acacaugccuucuuggaguac

SEQ ID NO: 47902 - RNA, 18 nt, Artificial Sequence
  Synthetic
uguaacacgagcccaccc

SEQ ID NO: 47903 - RNA, 19 nt, Artificial Sequence
  Synthetic
cuguaacacgagcccaccc

SEQ ID NO: 47904 - RNA, 21 nt, Artificial Sequence
  Synthetic
ugcuguaacacgagcccaccc

SEQ ID NO: 47905 - RNA, 23 nt, Artificial Sequence
  Synthetic
ugugcuguaacacgagcccaccc

SEQ ID NO: 47906 - RNA, 19 nt, Artificial Sequence
  Synthetic
ugucgggaucgugcgggcc

SEQ ID NO: 47907 - RNA, 20 nt, Artificial Sequence
  Synthetic
uugucgggaucgugcgggcc

SEQ ID NO: 47908 - RNA, 22 nt, Artificial Sequence
  Synthetic
uguugucgggaucgugcgggcc

SEQ ID NO: 47909 - RNA, 23 nt, Artificial Sequence
  Synthetic
uuguugucgggaucgugcgggcc

SEQ ID NO: 47910 - RNA, 24 nt, Artificial Sequence
  Synthetic
auuguugucgggaucgugcgggcc

SEQ ID NO: 47911 - RNA, 18 nt, Artificial Sequence
  Synthetic
aggggcgggggcgugggc

SEQ ID NO: 47912 - RNA, 19 nt, Artificial Sequence
  Synthetic
caggggcgggggcgugggc

SEQ ID NO: 47913 - RNA, 24 nt, Artificial Sequence
  Synthetic
cggggcaggggcgggggcgugggc

SEQ ID NO: 47914 - RNA, 18 nt, Artificial Sequence
  Synthetic
ccccuccguccccccguc

SEQ ID NO: 47915 - RNA, 19 nt, Artificial Sequence
  Synthetic
uccccuccguccccccguc

SEQ ID NO: 47916 - RNA, 21 nt, Artificial Sequence
  Synthetic
cguccccuccguccccccguc

SEQ ID NO: 47917 - RNA, 22 nt, Artificial Sequence
  Synthetic
ccguccccuccguccccccguc

SEQ ID NO: 47918 - RNA, 23 nt, Artificial Sequence
  Synthetic
uccguccccuccguccccccguc

SEQ ID NO: 47919 - RNA, 24 nt, Artificial Sequence
  Synthetic
cuccguccccuccguccccccguc

SEQ ID NO: 47920 - RNA, 18 nt, Artificial Sequence
  Synthetic
cggggcgcccucgacgag

SEQ ID NO: 47921 - RNA, 19 nt, Artificial Sequence
  Synthetic
ccggggcgcccucgacgag

SEQ ID NO: 47922 - RNA, 20 nt, Artificial Sequence
  Synthetic
accggggcgcccucgacgag

SEQ ID NO: 47923 - RNA, 21 nt, Artificial Sequence
  Synthetic
caccggggcgcccucgacgag

SEQ ID NO: 47924 - RNA, 22 nt, Artificial Sequence
  Synthetic
acaccggggcgcccucgacgag

SEQ ID NO: 47925 - RNA, 24 nt, Artificial Sequence
  Synthetic
cgacaccggggcgcccucgacgag

SEQ ID NO: 47926 - RNA, 19 nt, Artificial Sequence
  Synthetic
cggggcuggguaucccgag

SEQ ID NO: 47927 - RNA, 20 nt, Artificial Sequence
  Synthetic
ccggggcuggguaucccgag

SEQ ID NO: 47928 - RNA, 21 nt, Artificial Sequence
  Synthetic
accggggcuggguaucccgag

SEQ ID NO: 47929 - RNA, 20 nt, Artificial Sequence
  Synthetic
cgggggaggaagggagggag

SEQ ID NO: 47930 - RNA, 21 nt, Artificial Sequence
  Synthetic
acgggggaggaagggagggag

SEQ ID NO: 47931 - RNA, 22 nt, Artificial Sequence
  Synthetic
aacgggggaggaagggagggag

SEQ ID NO: 47932 - RNA, 23 nt, Artificial Sequence
  Synthetic
uaacgggggaggaagggagggag

SEQ ID NO: 47933 - RNA, 24 nt, Artificial Sequence
  Synthetic
auaacgggggaggaagggagggag

SEQ ID NO: 47934 - RNA, 18 nt, Artificial Sequence
  Synthetic
ccgggcucagugggggcg

SEQ ID NO: 47935 - RNA, 19 nt, Artificial Sequence
  Synthetic
accgggcucagugggggcg

SEQ ID NO: 47936 - RNA, 21 nt, Artificial Sequence
  Synthetic
cgaccgggcucagugggggcg

SEQ ID NO: 47937 - RNA, 22 nt, Artificial Sequence
  Synthetic
ucgaccgggcucagugggggcg

SEQ ID NO: 47938 - RNA, 23 nt, Artificial Sequence
  Synthetic
aucgaccgggcucagugggggcg

SEQ ID NO: 47939 - RNA, 19 nt, Artificial Sequence
  Synthetic
cgacaccggggcgcccucg

SEQ ID NO: 47940 - RNA, 20 nt, Artificial Sequence
  Synthetic
acgacaccggggcgcccucg

SEQ ID NO: 47941 - RNA, 21 nt, Artificial Sequence
  Synthetic
aacgacaccggggcgcccucg

SEQ ID NO: 47942 - RNA, 23 nt, Artificial Sequence
  Synthetic
ugaacgacaccggggcgcccucg

SEQ ID NO: 47943 - RNA, 24 nt, Artificial Sequence
  Synthetic
uugaacgacaccggggcgcccucg

SEQ ID NO: 47944 - RNA, 18 nt, Artificial Sequence
  Synthetic
acuggggugggggugucg

SEQ ID NO: 47945 - RNA, 20 nt, Artificial Sequence
  Synthetic
agacuggggugggggugucg

SEQ ID NO: 47946 - RNA, 23 nt, Artificial Sequence
  Synthetic
aggagacuggggugggggugucg

SEQ ID NO: 47947 - RNA, 18 nt, Artificial Sequence
  Synthetic
caggcacaaaaacacagg

SEQ ID NO: 47948 - RNA, 19 nt, Artificial Sequence
  Synthetic
ccaggcacaaaaacacagg

SEQ ID NO: 47949 - RNA, 21 nt, Artificial Sequence
  Synthetic
agccaggcacaaaaacacagg

SEQ ID NO: 47950 - RNA, 23 nt, Artificial Sequence
  Synthetic
agagccaggcacaaaaacacagg

SEQ ID NO: 47951 - RNA, 20 nt, Artificial Sequence
  Synthetic
agggggcaguugguggucgg

SEQ ID NO: 47952 - RNA, 21 nt, Artificial Sequence
  Synthetic
aagggggcaguugguggucgg

SEQ ID NO: 47953 - RNA, 22 nt, Artificial Sequence
  Synthetic
uaagggggcaguugguggucgg

SEQ ID NO: 47954 - RNA, 23 nt, Artificial Sequence
  Synthetic
auaagggggcaguugguggucgg

SEQ ID NO: 47955 - RNA, 20 nt, Artificial Sequence
  Synthetic
cggggaacgggggaccgggg

SEQ ID NO: 47956 - RNA, 21 nt, Artificial Sequence
  Synthetic
ccggggaacgggggaccgggg

SEQ ID NO: 47957 - RNA, 22 nt, Artificial Sequence
  Synthetic
cccggggaacgggggaccgggg

SEQ ID NO: 47958 - RNA, 23 nt, Artificial Sequence
  Synthetic
ccccggggaacgggggaccgggg

SEQ ID NO: 47959 - RNA, 24 nt, Artificial Sequence
  Synthetic
cccccggggaacgggggaccgggg

SEQ ID NO: 47960 - RNA, 18 nt, Artificial Sequence
  Synthetic
uauguggggucccggggg

SEQ ID NO: 47961 - RNA, 19 nt, Artificial Sequence
  Synthetic
auauguggggucccggggg

SEQ ID NO: 47962 - RNA, 20 nt, Artificial Sequence
  Synthetic
uauauguggggucccggggg

SEQ ID NO: 47963 - RNA, 21 nt, Artificial Sequence
  Synthetic
uuauauguggggucccggggg

SEQ ID NO: 47964 - RNA, 22 nt, Artificial Sequence
  Synthetic
cuuauauguggggucccggggg

SEQ ID NO: 47965 - RNA, 21 nt, Artificial Sequence
  Synthetic
cgggcucagugggggcguggg

SEQ ID NO: 47966 - RNA, 22 nt, Artificial Sequence
  Synthetic
ccgggcucagugggggcguggg

SEQ ID NO: 47967 - RNA, 23 nt, Artificial Sequence
  Synthetic
accgggcucagugggggcguggg

SEQ ID NO: 47968 - RNA, 18 nt, Artificial Sequence
  Synthetic
cuggguaucccgaggugg

SEQ ID NO: 47969 - RNA, 23 nt, Artificial Sequence
  Synthetic
cggggcuggguaucccgaggugg

SEQ ID NO: 47970 - RNA, 24 nt, Artificial Sequence
  Synthetic
ccggggcuggguaucccgaggugg

SEQ ID NO: 47971 - RNA, 18 nt, Artificial Sequence
  Synthetic
uggcugggggcuuauaug

SEQ ID NO: 47972 - RNA, 20 nt, Artificial Sequence
  Synthetic
uguggcugggggcuuauaug

SEQ ID NO: 47973 - RNA, 22 nt, Artificial Sequence
  Synthetic
cguguggcugggggcuuauaug

SEQ ID NO: 47974 - RNA, 24 nt, Artificial Sequence
  Synthetic
ugcguguggcugggggcuuauaug

SEQ ID NO: 47975 - RNA, 18 nt, Artificial Sequence
  Synthetic
acgugggucauuggcgug

SEQ ID NO: 47976 - RNA, 19 nt, Artificial Sequence
  Synthetic
uacgugggucauuggcgug

SEQ ID NO: 47977 - RNA, 21 nt, Artificial Sequence
  Synthetic
aguacgugggucauuggcgug

SEQ ID NO: 47978 - RNA, 24 nt, Artificial Sequence
  Synthetic
uggaguacgugggucauuggcgug

SEQ ID NO: 47979 - RNA, 18 nt, Artificial Sequence
  Synthetic
aaguaacagagucugacu

SEQ ID NO: 47980 - RNA, 19 nt, Artificial Sequence
  Synthetic
uaaguaacagagucugacu

SEQ ID NO: 47981 - RNA, 23 nt, Artificial Sequence
  Synthetic
cggguaaguaacagagucugacu

SEQ ID NO: 47982 - RNA, 24 nt, Artificial Sequence
  Synthetic
acggguaaguaacagagucugacu

SEQ ID NO: 47983 - RNA, 19 nt, Artificial Sequence
  Synthetic
agggagggaggaggguacu

SEQ ID NO: 47984 - RNA, 20 nt, Artificial Sequence
  Synthetic
aagggagggaggaggguacu

SEQ ID NO: 47985 - RNA, 23 nt, Artificial Sequence
  Synthetic
aggaagggagggaggaggguacu

SEQ ID NO: 47986 - RNA, 22 nt, Artificial Sequence
  Synthetic
cggggugggacacaugccuucu

SEQ ID NO: 47987 - RNA, 18 nt, Artificial Sequence
  Synthetic
caccccgccgcuuuccgu

SEQ ID NO: 47988 - RNA, 19 nt, Artificial Sequence
  Synthetic
acaccccgccgcuuuccgu

SEQ ID NO: 47989 - RNA, 20 nt, Artificial Sequence
  Synthetic
aacaccccgccgcuuuccgu

SEQ ID NO: 47990 - RNA, 21 nt, Artificial Sequence
  Synthetic
caacaccccgccgcuuuccgu

SEQ ID NO: 47991 - RNA, 22 nt, Artificial Sequence
  Synthetic
ccaacaccccgccgcuuuccgu

SEQ ID NO: 47992 - RNA, 23 nt, Artificial Sequence
  Synthetic
cccaacaccccgccgcuuuccgu

SEQ ID NO: 47993 - RNA, 24 nt, Artificial Sequence
  Synthetic
ccccaacaccccgccgcuuuccgu

SEQ ID NO: 47994 - RNA, 18 nt, Artificial Sequence
  Synthetic
uggggcgcccccugucgu

SEQ ID NO: 47995 - RNA, 19 nt, Artificial Sequence
  Synthetic
cuggggcgcccccugucgu

SEQ ID NO: 47996 - RNA, 20 nt, Artificial Sequence
  Synthetic
ucuggggcgcccccugucgu

SEQ ID NO: 47997 - RNA, 21 nt, Artificial Sequence
  Synthetic
cucuggggcgcccccugucgu

SEQ ID NO: 47998 - RNA, 22 nt, Artificial Sequence
  Synthetic
ccucuggggcgcccccugucgu

SEQ ID NO: 47999 - RNA, 24 nt, Artificial Sequence
  Synthetic
agccucuggggcgcccccugucgu

SEQ ID NO: 48000 - RNA, 18 nt, Artificial Sequence
  Synthetic
aggcgaggagacuggggu

SEQ ID NO: 48001 - RNA, 19 nt, Artificial Sequence
  Synthetic
aaggcgaggagacuggggu

SEQ ID NO: 48002 - RNA, 21 nt, Artificial Sequence
  Synthetic
agaaggcgaggagacuggggu

SEQ ID NO: 48003 - RNA, 18 nt, Artificial Sequence
  Synthetic
ugggguuguuauuguugu

SEQ ID NO: 48004 - RNA, 19 nt, Artificial Sequence
  Synthetic
uugggguuguuauuguugu

SEQ ID NO: 48005 - RNA, 21 nt, Artificial Sequence
  Synthetic
cguugggguuguuauuguugu

SEQ ID NO: 48006 - RNA, 22 nt, Artificial Sequence
  Synthetic
ccguugggguuguuauuguugu

SEQ ID NO: 48007 - RNA, 23 nt, Artificial Sequence
  Synthetic
uccguugggguuguuauuguugu

SEQ ID NO: 48008 - RNA, 24 nt, Artificial Sequence
  Synthetic
uuccguugggguuguuauuguugu

SEQ ID NO: 48009 - RNA, 18 nt, Artificial Sequence
  Synthetic
ccggcuggaagaccgcca

SEQ ID NO: 48010 - RNA, 22 nt, Artificial Sequence
  Synthetic
agggccggcuggaagaccgcca

SEQ ID NO: 48011 - RNA, 23 nt, Artificial Sequence
  Synthetic
aagggccggcuggaagaccgcca

SEQ ID NO: 48012 - RNA, 24 nt, Artificial Sequence
  Synthetic
uaagggccggcuggaagaccgcca

SEQ ID NO: 48013 - RNA, 18 nt, Artificial Sequence
  Synthetic
acggaggggacggaggga

SEQ ID NO: 48014 - RNA, 19 nt, Artificial Sequence
  Synthetic
ugugccuggcucucuaugc

SEQ ID NO: 48015 - RNA, 20 nt, Artificial Sequence
  Synthetic
uugugccuggcucucuaugc

SEQ ID NO: 48016 - RNA, 21 nt, Artificial Sequence
  Synthetic
uuugugccuggcucucuaugc

SEQ ID NO: 48017 - RNA, 22 nt, Artificial Sequence
  Synthetic
uuuugugccuggcucucuaugc

SEQ ID NO: 48018 - RNA, 23 nt, Artificial Sequence
  Synthetic
uuuuugugccuggcucucuaugc

SEQ ID NO: 48019 - RNA, 18 nt, Artificial Sequence
  Synthetic
aggucggccacgccacuc

SEQ ID NO: 48020 - RNA, 19 nt, Artificial Sequence
  Synthetic
aaggucggccacgccacuc

SEQ ID NO: 48021 - RNA, 20 nt, Artificial Sequence
  Synthetic
uaaggucggccacgccacuc

SEQ ID NO: 48022 - RNA, 21 nt, Artificial Sequence
  Synthetic
cuaaggucggccacgccacuc

SEQ ID NO: 48023 - RNA, 24 nt, Artificial Sequence
  Synthetic
aggcuaaggucggccacgccacuc

SEQ ID NO: 48024 - RNA, 18 nt, Artificial Sequence
  Synthetic
aaccccaacggaaagcgg

SEQ ID NO: 48025 - RNA, 19 nt, Artificial Sequence
  Synthetic
caaccccaacggaaagcgg

SEQ ID NO: 48026 - RNA, 20 nt, Artificial Sequence
  Synthetic
acaaccccaacggaaagcgg

SEQ ID NO: 48027 - RNA, 21 nt, Artificial Sequence
  Synthetic
aacaaccccaacggaaagcgg

SEQ ID NO: 48028 - RNA, 22 nt, Artificial Sequence
  Synthetic
uaacaaccccaacggaaagcgg

SEQ ID NO: 48029 - RNA, 23 nt, Artificial Sequence
  Synthetic
auaacaaccccaacggaaagcgg

SEQ ID NO: 48030 - RNA, 24 nt, Artificial Sequence
  Synthetic
aauaacaaccccaacggaaagcgg

SEQ ID NO: 48031 - RNA, 18 nt, Artificial Sequence
  Synthetic
ccgcccacccacccaccu

SEQ ID NO: 48032 - RNA, 20 nt, Artificial Sequence
  Synthetic
cgccgcccacccacccaccu

SEQ ID NO: 48033 - RNA, 21 nt, Artificial Sequence
  Synthetic
ccgccgcccacccacccaccu

SEQ ID NO: 48034 - RNA, 22 nt, Artificial Sequence
  Synthetic
accgccgcccacccacccaccu

SEQ ID NO: 48035 - RNA, 23 nt, Artificial Sequence
  Synthetic
caccgccgcccacccacccaccu

SEQ ID NO: 48036 - RNA, 24 nt, Artificial Sequence
  Synthetic
ccaccgccgcccacccacccaccu

SEQ ID NO: 48037 - RNA, 18 nt, Artificial Sequence
  Synthetic
auuuaaauaaaccaaugu

SEQ ID NO: 48038 - RNA, 19 nt, Artificial Sequence
  Synthetic
uauuuaaauaaaccaaugu

SEQ ID NO: 48039 - RNA, 20 nt, Artificial Sequence
  Synthetic
uuauuuaaauaaaccaaugu

SEQ ID NO: 48040 - RNA, 21 nt, Artificial Sequence
  Synthetic
uuuauuuaaauaaaccaaugu

SEQ ID NO: 48041 - RNA, 23 nt, Artificial Sequence
  Synthetic
uguuuauuuaaauaaaccaaugu

SEQ ID NO: 48042 - RNA, 18 nt, Artificial Sequence
  Synthetic
gguacugggggugaagaa

SEQ ID NO: 48043 - RNA, 19 nt, Artificial Sequence
  Synthetic
ggguacugggggugaagaa

SEQ ID NO: 48044 - RNA, 20 nt, Artificial Sequence
  Synthetic
aggguacugggggugaagaa

SEQ ID NO: 48045 - RNA, 21 nt, Artificial Sequence
  Synthetic
gaggguacugggggugaagaa

SEQ ID NO: 48046 - RNA, 22 nt, Artificial Sequence
  Synthetic
ggaggguacugggggugaagaa

SEQ ID NO: 48047 - RNA, 23 nt, Artificial Sequence
  Synthetic
aggaggguacugggggugaagaa

SEQ ID NO: 48048 - RNA, 24 nt, Artificial Sequence
  Synthetic
gaggaggguacugggggugaagaa

SEQ ID NO: 48049 - RNA, 18 nt, Artificial Sequence
  Synthetic
gggggggagaagcgagaa

SEQ ID NO: 48050 - RNA, 19 nt, Artificial Sequence
  Synthetic
ggggggggagaagcgagaa

SEQ ID NO: 48051 - RNA, 20 nt, Artificial Sequence
  Synthetic
gggggggggagaagcgagaa

SEQ ID NO: 48052 - RNA, 21 nt, Artificial Sequence
  Synthetic
ggggggggggagaagcgagaa

SEQ ID NO: 48053 - RNA, 22 nt, Artificial Sequence
  Synthetic
aggggggggggagaagcgagaa

SEQ ID NO: 48054 - RNA, 23 nt, Artificial Sequence
  Synthetic
aaggggggggggagaagcgagaa

SEQ ID NO: 48055 - RNA, 24 nt, Artificial Sequence
  Synthetic
gaaggggggggggagaagcgagaa

SEQ ID NO: 48056 - RNA, 18 nt, Artificial Sequence
  Synthetic
agaaggggggggggagaa

SEQ ID NO: 48057 - RNA, 19 nt, Artificial Sequence
  Synthetic
aagaaggggggggggagaa

SEQ ID NO: 48058 - RNA, 20 nt, Artificial Sequence
  Synthetic
gaagaaggggggggggagaa

SEQ ID NO: 48059 - RNA, 21 nt, Artificial Sequence
  Synthetic
ugaagaaggggggggggagaa

SEQ ID NO: 48060 - RNA, 22 nt, Artificial Sequence
  Synthetic
gugaagaaggggggggggagaa

SEQ ID NO: 48061 - RNA, 23 nt, Artificial Sequence
  Synthetic
ggugaagaaggggggggggagaa

SEQ ID NO: 48062 - RNA, 24 nt, Artificial Sequence
  Synthetic
gggugaagaaggggggggggagaa

SEQ ID NO: 48063 - RNA, 18 nt, Artificial Sequence
  Synthetic
gggauaacgggggaggaa

SEQ ID NO: 48064 - RNA, 19 nt, Artificial Sequence
  Synthetic
ugggauaacgggggaggaa

SEQ ID NO: 48065 - RNA, 20 nt, Artificial Sequence
  Synthetic
gugggauaacgggggaggaa

SEQ ID NO: 48066 - RNA, 21 nt, Artificial Sequence
  Synthetic
agugggauaacgggggaggaa

SEQ ID NO: 48067 - RNA, 22 nt, Artificial Sequence
  Synthetic
gagugggauaacgggggaggaa

SEQ ID NO: 48068 - RNA, 23 nt, Artificial Sequence
  Synthetic
cgagugggauaacgggggaggaa

SEQ ID NO: 48069 - RNA, 24 nt, Artificial Sequence
  Synthetic
acgagugggauaacgggggaggaa

SEQ ID NO: 48070 - RNA, 18 nt, Artificial Sequence
  Synthetic
auaacggcccccggggaa

SEQ ID NO: 48071 - RNA, 19 nt, Artificial Sequence
  Synthetic
gauaacggcccccggggaa

SEQ ID NO: 48072 - RNA, 20 nt, Artificial Sequence
  Synthetic
agauaacggcccccggggaa

SEQ ID NO: 48073 - RNA, 21 nt, Artificial Sequence
  Synthetic
gagauaacggcccccggggaa

SEQ ID NO: 48074 - RNA, 22 nt, Artificial Sequence
  Synthetic
ggagauaacggcccccggggaa

SEQ ID NO: 48075 - RNA, 23 nt, Artificial Sequence
  Synthetic
uggagauaacggcccccggggaa

SEQ ID NO: 48076 - RNA, 24 nt, Artificial Sequence
  Synthetic
cuggagauaacggcccccggggaa

SEQ ID NO: 48077 - RNA, 18 nt, Artificial Sequence
  Synthetic
agggugggagggggggaa

SEQ ID NO: 48078 - RNA, 19 nt, Artificial Sequence
  Synthetic
aagggugggagggggggaa

SEQ ID NO: 48079 - RNA, 20 nt, Artificial Sequence
  Synthetic
uaagggugggagggggggaa

SEQ ID NO: 48080 - RNA, 21 nt, Artificial Sequence
  Synthetic
cuaagggugggagggggggaa

SEQ ID NO: 48081 - RNA, 22 nt, Artificial Sequence
  Synthetic
acuaagggugggagggggggaa

SEQ ID NO: 48082 - RNA, 23 nt, Artificial Sequence
  Synthetic
gacuaagggugggagggggggaa

SEQ ID NO: 48083 - RNA, 24 nt, Artificial Sequence
  Synthetic
ugacuaagggugggagggggggaa

SEQ ID NO: 48084 - RNA, 18 nt, Artificial Sequence
  Synthetic
cagccggcccuuagauaa

SEQ ID NO: 48085 - RNA, 19 nt, Artificial Sequence
  Synthetic
ccagccggcccuuagauaa

SEQ ID NO: 48086 - RNA, 20 nt, Artificial Sequence
  Synthetic
uccagccggcccuuagauaa

SEQ ID NO: 48087 - RNA, 21 nt, Artificial Sequence
  Synthetic
uuccagccggcccuuagauaa

SEQ ID NO: 48088 - RNA, 22 nt, Artificial Sequence
  Synthetic
cuuccagccggcccuuagauaa

SEQ ID NO: 48089 - RNA, 23 nt, Artificial Sequence
  Synthetic
ucuuccagccggcccuuagauaa

SEQ ID NO: 48090 - RNA, 24 nt, Artificial Sequence
  Synthetic
gucuuccagccggcccuuagauaa

SEQ ID NO: 48091 - RNA, 18 nt, Artificial Sequence
  Synthetic
ccucgacgagugggauaa

SEQ ID NO: 48092 - RNA, 19 nt, Artificial Sequence
  Synthetic
cccucgacgagugggauaa

SEQ ID NO: 48093 - RNA, 20 nt, Artificial Sequence
  Synthetic
gcccucgacgagugggauaa

SEQ ID NO: 48094 - RNA, 21 nt, Artificial Sequence
  Synthetic
cgcccucgacgagugggauaa

SEQ ID NO: 48095 - RNA, 22 nt, Artificial Sequence
  Synthetic
gcgcccucgacgagugggauaa

SEQ ID NO: 48096 - RNA, 23 nt, Artificial Sequence
  Synthetic
ggcgcccucgacgagugggauaa

SEQ ID NO: 48097 - RNA, 24 nt, Artificial Sequence
  Synthetic
gggcgcccucgacgagugggauaa

SEQ ID NO: 48098 - RNA, 18 nt, Artificial Sequence
  Synthetic
auggagcccggcagaaca

SEQ ID NO: 48099 - RNA, 19 nt, Artificial Sequence
  Synthetic
gauggagcccggcagaaca

SEQ ID NO: 48100 - RNA, 20 nt, Artificial Sequence
  Synthetic
cgauggagcccggcagaaca

SEQ ID NO: 48101 - RNA, 21 nt, Artificial Sequence
  Synthetic
gcgauggagcccggcagaaca

SEQ ID NO: 48102 - RNA, 22 nt, Artificial Sequence
  Synthetic
ggcgauggagcccggcagaaca

SEQ ID NO: 48103 - RNA, 23 nt, Artificial Sequence
  Synthetic
aggcgauggagcccggcagaaca

SEQ ID NO: 48104 - RNA, 24 nt, Artificial Sequence
  Synthetic
aaggcgauggagcccggcagaaca

SEQ ID NO: 48105 - RNA, 18 nt, Artificial Sequence
  Synthetic
cgucuuuguugaacgaca

SEQ ID NO: 48106 - RNA, 19 nt, Artificial Sequence
  Synthetic
gcgucuuuguugaacgaca

SEQ ID NO: 48107 - RNA, 20 nt, Artificial Sequence
  Synthetic
ggcgucuuuguugaacgaca

SEQ ID NO: 48108 - RNA, 21 nt, Artificial Sequence
  Synthetic
cggcgucuuuguugaacgaca

SEQ ID NO: 48109 - RNA, 22 nt, Artificial Sequence
  Synthetic
gcggcgucuuuguugaacgaca

SEQ ID NO: 48110 - RNA, 23 nt, Artificial Sequence
  Synthetic
cgcggcgucuuuguugaacgaca

SEQ ID NO: 48111 - RNA, 24 nt, Artificial Sequence
  Synthetic
acgcggcgucuuuguugaacgaca

SEQ ID NO: 48112 - RNA, 18 nt, Artificial Sequence
  Synthetic
ggcaguaagacccaagca

SEQ ID NO: 48113 - RNA, 19 nt, Artificial Sequence
  Synthetic
aggcaguaagacccaagca

SEQ ID NO: 48114 - RNA, 20 nt, Artificial Sequence
  Synthetic
caggcaguaagacccaagca

SEQ ID NO: 48115 - RNA, 18 nt, Artificial Sequence
  Synthetic
gucgaucgaccgggcuca

SEQ ID NO: 48116 - RNA, 19 nt, Artificial Sequence
  Synthetic
cgucgaucgaccgggcuca

SEQ ID NO: 48117 - RNA, 20 nt, Artificial Sequence
  Synthetic
ucgucgaucgaccgggcuca

SEQ ID NO: 48118 - RNA, 21 nt, Artificial Sequence
  Synthetic
cucgucgaucgaccgggcuca

SEQ ID NO: 48119 - RNA, 22 nt, Artificial Sequence
  Synthetic
gcucgucgaucgaccgggcuca

SEQ ID NO: 48120 - RNA, 23 nt, Artificial Sequence
  Synthetic
ugcucgucgaucgaccgggcuca

SEQ ID NO: 48121 - RNA, 24 nt, Artificial Sequence
  Synthetic
gugcucgucgaucgaccgggcuca

SEQ ID NO: 48122 - RNA, 18 nt, Artificial Sequence
  Synthetic
ugggagggggggaaaaga

SEQ ID NO: 48123 - RNA, 19 nt, Artificial Sequence
  Synthetic
gugggagggggggaaaaga

SEQ ID NO: 48124 - RNA, 20 nt, Artificial Sequence
  Synthetic
ggugggagggggggaaaaga

SEQ ID NO: 48125 - RNA, 21 nt, Artificial Sequence
  Synthetic
gggugggagggggggaaaaga

SEQ ID NO: 48126 - RNA, 22 nt, Artificial Sequence
  Synthetic
agggugggagggggggaaaaga

SEQ ID NO: 48127 - RNA, 23 nt, Artificial Sequence
  Synthetic
aagggugggagggggggaaaaga

SEQ ID NO: 48128 - RNA, 24 nt, Artificial Sequence
  Synthetic
uaagggugggagggggggaaaaga

SEQ ID NO: 48129 - RNA, 18 nt, Artificial Sequence
  Synthetic
ggguacugggggugaaga

SEQ ID NO: 48130 - RNA, 19 nt, Artificial Sequence
  Synthetic
aggguacugggggugaaga

SEQ ID NO: 48131 - RNA, 20 nt, Artificial Sequence
  Synthetic
gaggguacugggggugaaga

SEQ ID NO: 48132 - RNA, 21 nt, Artificial Sequence
  Synthetic
ggaggguacugggggugaaga

SEQ ID NO: 48133 - RNA, 22 nt, Artificial Sequence
  Synthetic
aggaggguacugggggugaaga

SEQ ID NO: 48134 - RNA, 23 nt, Artificial Sequence
  Synthetic
gaggaggguacugggggugaaga

SEQ ID NO: 48135 - RNA, 24 nt, Artificial Sequence
  Synthetic
ggaggaggguacugggggugaaga

SEQ ID NO: 48136 - RNA, 18 nt, Artificial Sequence
  Synthetic
ugggagaaggcgaggaga

SEQ ID NO: 48137 - RNA, 19 nt, Artificial Sequence
  Synthetic
gugggagaaggcgaggaga

SEQ ID NO: 48138 - RNA, 20 nt, Artificial Sequence
  Synthetic
ggugggagaaggcgaggaga

SEQ ID NO: 48139 - RNA, 21 nt, Artificial Sequence
  Synthetic
gggugggagaaggcgaggaga

SEQ ID NO: 48140 - RNA, 22 nt, Artificial Sequence
  Synthetic
ugggugggagaaggcgaggaga

SEQ ID NO: 48141 - RNA, 23 nt, Artificial Sequence
  Synthetic
gugggugggagaaggcgaggaga

SEQ ID NO: 48142 - RNA, 24 nt, Artificial Sequence
  Synthetic
ggugggugggagaaggcgaggaga

SEQ ID NO: 48143 - RNA, 18 nt, Artificial Sequence
  Synthetic
ccggggcgcccucgacga

SEQ ID NO: 48144 - RNA, 19 nt, Artificial Sequence
  Synthetic
accggggcgcccucgacga

SEQ ID NO: 48145 - RNA, 20 nt, Artificial Sequence
  Synthetic
caccggggcgcccucgacga

SEQ ID NO: 48146 - RNA, 21 nt, Artificial Sequence
  Synthetic
acaccggggcgcccucgacga

SEQ ID NO: 48147 - RNA, 22 nt, Artificial Sequence
  Synthetic
gacaccggggcgcccucgacga

SEQ ID NO: 48148 - RNA, 23 nt, Artificial Sequence
  Synthetic
cgacaccggggcgcccucgacga

SEQ ID NO: 48149 - RNA, 24 nt, Artificial Sequence
  Synthetic
acgacaccggggcgcccucgacga

SEQ ID NO: 48150 - RNA, 18 nt, Artificial Sequence
  Synthetic
cgagaacaggaaaggcga

SEQ ID NO: 48151 - RNA, 19 nt, Artificial Sequence
  Synthetic
gcgagaacaggaaaggcga

SEQ ID NO: 48152 - RNA, 20 nt, Artificial Sequence
  Synthetic
agcgagaacaggaaaggcga

SEQ ID NO: 48153 - RNA, 21 nt, Artificial Sequence
  Synthetic
aagcgagaacaggaaaggcga

SEQ ID NO: 48154 - RNA, 22 nt, Artificial Sequence
  Synthetic
gaagcgagaacaggaaaggcga

SEQ ID NO: 48155 - RNA, 23 nt, Artificial Sequence
  Synthetic
agaagcgagaacaggaaaggcga

SEQ ID NO: 48156 - RNA, 24 nt, Artificial Sequence
  Synthetic
gagaagcgagaacaggaaaggcga

SEQ ID NO: 48157 - RNA, 18 nt, Artificial Sequence
  Synthetic
ggggugcucgucgaucga

SEQ ID NO: 48158 - RNA, 19 nt, Artificial Sequence
  Synthetic
gggggugcucgucgaucga

SEQ ID NO: 48159 - RNA, 20 nt, Artificial Sequence
  Synthetic
cgggggugcucgucgaucga

SEQ ID NO: 48160 - RNA, 21 nt, Artificial Sequence
  Synthetic
gcgggggugcucgucgaucga

SEQ ID NO: 48161 - RNA, 22 nt, Artificial Sequence
  Synthetic
ggcgggggugcucgucgaucga

SEQ ID NO: 48162 - RNA, 23 nt, Artificial Sequence
  Synthetic
gggcgggggugcucgucgaucga

SEQ ID NO: 48163 - RNA, 24 nt, Artificial Sequence
  Synthetic
ugggcgggggugcucgucgaucga

SEQ ID NO: 48164 - RNA, 18 nt, Artificial Sequence
  Synthetic
ugggauaacgggggagga

SEQ ID NO: 48165 - RNA, 19 nt, Artificial Sequence
  Synthetic
gugggauaacgggggagga

SEQ ID NO: 48166 - RNA, 20 nt, Artificial Sequence
  Synthetic
agugggauaacgggggagga

SEQ ID NO: 48167 - RNA, 21 nt, Artificial Sequence
  Synthetic
gagugggauaacgggggagga

SEQ ID NO: 48168 - RNA, 22 nt, Artificial Sequence
  Synthetic
cgagugggauaacgggggagga

SEQ ID NO: 48169 - RNA, 23 nt, Artificial Sequence
  Synthetic
acgagugggauaacgggggagga

SEQ ID NO: 48170 - RNA, 24 nt, Artificial Sequence
  Synthetic
gacgagugggauaacgggggagga

SEQ ID NO: 48171 - RNA, 18 nt, Artificial Sequence
  Synthetic
ggggggcggcgcgccgga

SEQ ID NO: 48172 - RNA, 19 nt, Artificial Sequence
  Synthetic
cggggggcggcgcgccgga

SEQ ID NO: 48173 - RNA, 20 nt, Artificial Sequence
  Synthetic
gcggggggcggcgcgccgga

SEQ ID NO: 48174 - RNA, 21 nt, Artificial Sequence
  Synthetic
ggcggggggcggcgcgccgga

SEQ ID NO: 48175 - RNA, 22 nt, Artificial Sequence
  Synthetic
cggcggggggcggcgcgccgga

SEQ ID NO: 48176 - RNA, 23 nt, Artificial Sequence
  Synthetic
gcggcggggggcggcgcgccgga

SEQ ID NO: 48177 - RNA, 24 nt, Artificial Sequence
  Synthetic
agcggcggggggcggcgcgccgga

SEQ ID NO: 48178 - RNA, 18 nt, Artificial Sequence
  Synthetic
uaacgggggaggaaggga

SEQ ID NO: 48179 - RNA, 19 nt, Artificial Sequence
  Synthetic
auaacgggggaggaaggga

SEQ ID NO: 48180 - RNA, 20 nt, Artificial Sequence
  Synthetic
gauaacgggggaggaaggga

SEQ ID NO: 48181 - RNA, 21 nt, Artificial Sequence
  Synthetic
ggauaacgggggaggaaggga

SEQ ID NO: 48182 - RNA, 22 nt, Artificial Sequence
  Synthetic
gggauaacgggggaggaaggga

SEQ ID NO: 48183 - RNA, 23 nt, Artificial Sequence
  Synthetic
ugggauaacgggggaggaaggga

SEQ ID NO: 48184 - RNA, 24 nt, Artificial Sequence
  Synthetic
gugggauaacgggggaggaaggga

SEQ ID NO: 48185 - RNA, 18 nt, Artificial Sequence
  Synthetic
gauaacggcccccgggga

SEQ ID NO: 48186 - RNA, 19 nt, Artificial Sequence
  Synthetic
agauaacggcccccgggga

SEQ ID NO: 48187 - RNA, 20 nt, Artificial Sequence
  Synthetic
gagauaacggcccccgggga

SEQ ID NO: 48188 - RNA, 21 nt, Artificial Sequence
  Synthetic
ggagauaacggcccccgggga

SEQ ID NO: 48189 - RNA, 22 nt, Artificial Sequence
  Synthetic
uggagauaacggcccccgggga

SEQ ID NO: 48190 - RNA, 23 nt, Artificial Sequence
  Synthetic
cuggagauaacggcccccgggga

SEQ ID NO: 48191 - RNA, 24 nt, Artificial Sequence
  Synthetic
gcuggagauaacggcccccgggga

SEQ ID NO: 48192 - RNA, 18 nt, Artificial Sequence
  Synthetic
cccccggggaacggggga

SEQ ID NO: 48193 - RNA, 19 nt, Artificial Sequence
  Synthetic
gcccccggggaacggggga

SEQ ID NO: 48194 - RNA, 20 nt, Artificial Sequence
  Synthetic
ggcccccggggaacggggga

SEQ ID NO: 48195 - RNA, 21 nt, Artificial Sequence
  Synthetic
cggcccccggggaacggggga

SEQ ID NO: 48196 - RNA, 22 nt, Artificial Sequence
  Synthetic
acggcccccggggaacggggga

SEQ ID NO: 48197 - RNA, 23 nt, Artificial Sequence
  Synthetic
aacggcccccggggaacggggga

SEQ ID NO: 48198 - RNA, 24 nt, Artificial Sequence
  Synthetic
uaacggcccccggggaacggggga

SEQ ID NO: 48199 - RNA, 18 nt, Artificial Sequence
  Synthetic
gucugacuaaggguggga

SEQ ID NO: 48200 - RNA, 19 nt, Artificial Sequence
  Synthetic
agucugacuaaggguggga

SEQ ID NO: 48201 - RNA, 20 nt, Artificial Sequence
  Synthetic
gagucugacuaaggguggga

SEQ ID NO: 48202 - RNA, 21 nt, Artificial Sequence
  Synthetic
agagucugacuaaggguggga

SEQ ID NO: 48203 - RNA, 22 nt, Artificial Sequence
  Synthetic
cagagucugacuaaggguggga

SEQ ID NO: 48204 - RNA, 23 nt, Artificial Sequence
  Synthetic
acagagucugacuaaggguggga

SEQ ID NO: 48205 - RNA, 24 nt, Artificial Sequence
  Synthetic
aacagagucugacuaaggguggga

SEQ ID NO: 48206 - RNA, 18 nt, Artificial Sequence
  Synthetic
caguaagacccaagcaua

SEQ ID NO: 48207 - RNA, 19 nt, Artificial Sequence
  Synthetic
gcaguaagacccaagcaua

SEQ ID NO: 48208 - RNA, 20 nt, Artificial Sequence
  Synthetic
ggcaguaagacccaagcaua

SEQ ID NO: 48209 - RNA, 21 nt, Artificial Sequence
  Synthetic
aggcaguaagacccaagcaua

SEQ ID NO: 48210 - RNA, 22 nt, Artificial Sequence
  Synthetic
caggcaguaagacccaagcaua

SEQ ID NO: 48211 - RNA, 23 nt, Artificial Sequence
  Synthetic
ccaggcaguaagacccaagcaua

SEQ ID NO: 48212 - RNA, 24 nt, Artificial Sequence
  Synthetic
cccaggcaguaagacccaagcaua

SEQ ID NO: 48213 - RNA, 18 nt, Artificial Sequence
  Synthetic
ccagccggcccuuagaua

SEQ ID NO: 48214 - RNA, 19 nt, Artificial Sequence
  Synthetic
uccagccggcccuuagaua

SEQ ID NO: 48215 - RNA, 20 nt, Artificial Sequence
  Synthetic
uuccagccggcccuuagaua

SEQ ID NO: 48216 - RNA, 21 nt, Artificial Sequence
  Synthetic
cuuccagccggcccuuagaua

SEQ ID NO: 48217 - RNA, 22 nt, Artificial Sequence
  Synthetic
ucuuccagccggcccuuagaua

SEQ ID NO: 48218 - RNA, 23 nt, Artificial Sequence
  Synthetic
gucuuccagccggcccuuagaua

SEQ ID NO: 48219 - RNA, 24 nt, Artificial Sequence
  Synthetic
ggucuuccagccggcccuuagaua

SEQ ID NO: 48220 - RNA, 18 nt, Artificial Sequence
  Synthetic
cccucgacgagugggaua

SEQ ID NO: 48221 - RNA, 19 nt, Artificial Sequence
  Synthetic
gcccucgacgagugggaua

SEQ ID NO: 48222 - RNA, 20 nt, Artificial Sequence
  Synthetic
cgcccucgacgagugggaua

SEQ ID NO: 48223 - RNA, 21 nt, Artificial Sequence
  Synthetic
gcgcccucgacgagugggaua

SEQ ID NO: 48224 - RNA, 22 nt, Artificial Sequence
  Synthetic
ggcgcccucgacgagugggaua

SEQ ID NO: 48225 - RNA, 23 nt, Artificial Sequence
  Synthetic
gggcgcccucgacgagugggaua

SEQ ID NO: 48226 - RNA, 24 nt, Artificial Sequence
  Synthetic
ggggcgcccucgacgagugggaua

SEQ ID NO: 48227 - RNA, 18 nt, Artificial Sequence
  Synthetic
uuggguccccccccucua

SEQ ID NO: 48228 - RNA, 19 nt, Artificial Sequence
  Synthetic
uuuggguccccccccucua

SEQ ID NO: 48229 - RNA, 20 nt, Artificial Sequence
  Synthetic
guuuggguccccccccucua

SEQ ID NO: 48230 - RNA, 21 nt, Artificial Sequence
  Synthetic
cguuuggguccccccccucua

SEQ ID NO: 48231 - RNA, 22 nt, Artificial Sequence
  Synthetic
ucguuuggguccccccccucua

SEQ ID NO: 48232 - RNA, 23 nt, Artificial Sequence
  Synthetic
gucguuuggguccccccccucua

SEQ ID NO: 48233 - RNA, 24 nt, Artificial Sequence
  Synthetic
ugucguuuggguccccccccucua

SEQ ID NO: 48234 - RNA, 18 nt, Artificial Sequence
  Synthetic
aagggagggaggagggua

SEQ ID NO: 48235 - RNA, 19 nt, Artificial Sequence
  Synthetic
gaagggagggaggagggua

SEQ ID NO: 48236 - RNA, 20 nt, Artificial Sequence
  Synthetic
ggaagggagggaggagggua

SEQ ID NO: 48237 - RNA, 21 nt, Artificial Sequence
  Synthetic
aggaagggagggaggagggua

SEQ ID NO: 48238 - RNA, 22 nt, Artificial Sequence
  Synthetic
gaggaagggagggaggagggua

SEQ ID NO: 48239 - RNA, 23 nt, Artificial Sequence
  Synthetic
ggaggaagggagggaggagggua

SEQ ID NO: 48240 - RNA, 24 nt, Artificial Sequence
  Synthetic
gggaggaagggagggaggagggua

SEQ ID NO: 48241 - RNA, 18 nt, Artificial Sequence
  Synthetic
ggggggagaagcgagaac

SEQ ID NO: 48242 - RNA, 19 nt, Artificial Sequence
  Synthetic
gggggggagaagcgagaac

SEQ ID NO: 48243 - RNA, 20 nt, Artificial Sequence
  Synthetic
ggggggggagaagcgagaac

SEQ ID NO: 48244 - RNA, 21 nt, Artificial Sequence
  Synthetic
gggggggggagaagcgagaac

SEQ ID NO: 48245 - RNA, 22 nt, Artificial Sequence
  Synthetic
ggggggggggagaagcgagaac

SEQ ID NO: 48246 - RNA, 23 nt, Artificial Sequence
  Synthetic
aggggggggggagaagcgagaac

SEQ ID NO: 48247 - RNA, 24 nt, Artificial Sequence
  Synthetic
aaggggggggggagaagcgagaac

SEQ ID NO: 48248 - RNA, 18 nt, Artificial Sequence
  Synthetic
uaacggcccccggggaac

SEQ ID NO: 48249 - RNA, 19 nt, Artificial Sequence
  Synthetic
auaacggcccccggggaac

SEQ ID NO: 48250 - RNA, 20 nt, Artificial Sequence
  Synthetic
gauaacggcccccggggaac

SEQ ID NO: 48251 - RNA, 21 nt, Artificial Sequence
  Synthetic
agauaacggcccccggggaac

SEQ ID NO: 48252 - RNA, 22 nt, Artificial Sequence
  Synthetic
gagauaacggcccccggggaac

SEQ ID NO: 48253 - RNA, 23 nt, Artificial Sequence
  Synthetic
ggagauaacggcccccggggaac

SEQ ID NO: 48254 - RNA, 24 nt, Artificial Sequence
  Synthetic
uggagauaacggcccccggggaac

SEQ ID NO: 48255 - RNA, 18 nt, Artificial Sequence
  Synthetic
cucgacgagugggauaac

SEQ ID NO: 48256 - RNA, 19 nt, Artificial Sequence
  Synthetic
ccucgacgagugggauaac

SEQ ID NO: 48257 - RNA, 20 nt, Artificial Sequence
  Synthetic
cccucgacgagugggauaac

SEQ ID NO: 48258 - RNA, 21 nt, Artificial Sequence
  Synthetic
gcccucgacgagugggauaac

SEQ ID NO: 48259 - RNA, 22 nt, Artificial Sequence
  Synthetic
cgcccucgacgagugggauaac

SEQ ID NO: 48260 - RNA, 23 nt, Artificial Sequence
  Synthetic
gcgcccucgacgagugggauaac

SEQ ID NO: 48261 - RNA, 24 nt, Artificial Sequence
  Synthetic
ggcgcccucgacgagugggauaac

SEQ ID NO: 48262 - RNA, 18 nt, Artificial Sequence
  Synthetic
gggcuggugugcuguaac

SEQ ID NO: 48263 - RNA, 19 nt, Artificial Sequence
  Synthetic
cgggcuggugugcuguaac

SEQ ID NO: 48264 - RNA, 20 nt, Artificial Sequence
  Synthetic
acgggcuggugugcuguaac

SEQ ID NO: 48265 - RNA, 21 nt, Artificial Sequence
  Synthetic
aacgggcuggugugcuguaac

SEQ ID NO: 48266 - RNA, 22 nt, Artificial Sequence
  Synthetic
gaacgggcuggugugcuguaac

SEQ ID NO: 48267 - RNA, 23 nt, Artificial Sequence
  Synthetic
agaacgggcuggugugcuguaac

SEQ ID NO: 48268 - RNA, 24 nt, Artificial Sequence
  Synthetic
aagaacgggcuggugugcuguaac

SEQ ID NO: 48269 - RNA, 18 nt, Artificial Sequence
  Synthetic
gucuuuguugaacgacac

SEQ ID NO: 48270 - RNA, 19 nt, Artificial Sequence
  Synthetic
cgucuuuguugaacgacac

SEQ ID NO: 48271 - RNA, 20 nt, Artificial Sequence
  Synthetic
gcgucuuuguugaacgacac

SEQ ID NO: 48272 - RNA, 21 nt, Artificial Sequence
  Synthetic
ggcgucuuuguugaacgacac

SEQ ID NO: 48273 - RNA, 22 nt, Artificial Sequence
  Synthetic
cggcgucuuuguugaacgacac

SEQ ID NO: 48274 - RNA, 23 nt, Artificial Sequence
  Synthetic
gcggcgucuuuguugaacgacac

SEQ ID NO: 48275 - RNA, 24 nt, Artificial Sequence
  Synthetic
cgcggcgucuuuguugaacgacac

SEQ ID NO: 48276 - RNA, 18 nt, Artificial Sequence
  Synthetic
ccccggggaacgggggac

SEQ ID NO: 48277 - RNA, 19 nt, Artificial Sequence
  Synthetic
cccccggggaacgggggac

SEQ ID NO: 48278 - RNA, 20 nt, Artificial Sequence
  Synthetic
gcccccggggaacgggggac

SEQ ID NO: 48279 - RNA, 21 nt, Artificial Sequence
  Synthetic
ggcccccggggaacgggggac

SEQ ID NO: 48280 - RNA, 22 nt, Artificial Sequence
  Synthetic
cggcccccggggaacgggggac

SEQ ID NO: 48281 - RNA, 23 nt, Artificial Sequence
  Synthetic
acggcccccggggaacgggggac

SEQ ID NO: 48282 - RNA, 24 nt, Artificial Sequence
  Synthetic
aacggcccccggggaacgggggac

SEQ ID NO: 48283 - RNA, 18 nt, Artificial Sequence
  Synthetic
agcaggugucuaaccuac

SEQ ID NO: 48284 - RNA, 19 nt, Artificial Sequence
  Synthetic
aagcaggugucuaaccuac

SEQ ID NO: 48285 - RNA, 20 nt, Artificial Sequence
  Synthetic
gaagcaggugucuaaccuac

SEQ ID NO: 48286 - RNA, 21 nt, Artificial Sequence
  Synthetic
agaagcaggugucuaaccuac

SEQ ID NO: 48287 - RNA, 22 nt, Artificial Sequence
  Synthetic
gagaagcaggugucuaaccuac

SEQ ID NO: 48288 - RNA, 23 nt, Artificial Sequence
  Synthetic
ggagaagcaggugucuaaccuac

SEQ ID NO: 48289 - RNA, 24 nt, Artificial Sequence
  Synthetic
gggagaagcaggugucuaaccuac

SEQ ID NO: 48290 - RNA, 18 nt, Artificial Sequence
  Synthetic
agggagggaggaggguac

SEQ ID NO: 48291 - RNA, 19 nt, Artificial Sequence
  Synthetic
aagggagggaggaggguac

SEQ ID NO: 48292 - RNA, 20 nt, Artificial Sequence
  Synthetic
gaagggagggaggaggguac

SEQ ID NO: 48293 - RNA, 21 nt, Artificial Sequence
  Synthetic
ggaagggagggaggaggguac

SEQ ID NO: 48294 - RNA, 22 nt, Artificial Sequence
  Synthetic
aggaagggagggaggaggguac

SEQ ID NO: 48295 - RNA, 23 nt, Artificial Sequence
  Synthetic
gaggaagggagggaggaggguac

SEQ ID NO: 48296 - RNA, 24 nt, Artificial Sequence
  Synthetic
ggaggaagggagggaggaggguac

SEQ ID NO: 48297 - RNA, 18 nt, Artificial Sequence
  Synthetic
ggagcccggcagaacacc

SEQ ID NO: 48298 - RNA, 19 nt, Artificial Sequence
  Synthetic
uggagcccggcagaacacc

SEQ ID NO: 48299 - RNA, 20 nt, Artificial Sequence
  Synthetic
auggagcccggcagaacacc

SEQ ID NO: 48300 - RNA, 21 nt, Artificial Sequence
  Synthetic
gauggagcccggcagaacacc

SEQ ID NO: 48301 - RNA, 22 nt, Artificial Sequence
  Synthetic
cgauggagcccggcagaacacc

SEQ ID NO: 48302 - RNA, 23 nt, Artificial Sequence
  Synthetic
gcgauggagcccggcagaacacc

SEQ ID NO: 48303 - RNA, 24 nt, Artificial Sequence
  Synthetic
ggcgauggagcccggcagaacacc

SEQ ID NO: 48304 - RNA, 18 nt, Artificial Sequence
  Synthetic
gcaggugucuaaccuacc

SEQ ID NO: 48305 - RNA, 19 nt, Artificial Sequence
  Synthetic
agcaggugucuaaccuacc

SEQ ID NO: 48306 - RNA, 20 nt, Artificial Sequence
  Synthetic
aagcaggugucuaaccuacc

SEQ ID NO: 48307 - RNA, 21 nt, Artificial Sequence
  Synthetic
gaagcaggugucuaaccuacc

SEQ ID NO: 48308 - RNA, 22 nt, Artificial Sequence
  Synthetic
agaagcaggugucuaaccuacc

SEQ ID NO: 48309 - RNA, 23 nt, Artificial Sequence
  Synthetic
gagaagcaggugucuaaccuacc

SEQ ID NO: 48310 - RNA, 24 nt, Artificial Sequence
  Synthetic
ggagaagcaggugucuaaccuacc

SEQ ID NO: 48311 - RNA, 18 nt, Artificial Sequence
  Synthetic
cuggagauaacggccccc

SEQ ID NO: 48312 - RNA, 19 nt, Artificial Sequence
  Synthetic
gcuggagauaacggccccc

SEQ ID NO: 48313 - RNA, 20 nt, Artificial Sequence
  Synthetic
cgcuggagauaacggccccc

SEQ ID NO: 48314 - RNA, 21 nt, Artificial Sequence
  Synthetic
gcgcuggagauaacggccccc

SEQ ID NO: 48315 - RNA, 22 nt, Artificial Sequence
  Synthetic
ggcgcuggagauaacggccccc

SEQ ID NO: 48316 - RNA, 23 nt, Artificial Sequence
  Synthetic
gggcgcuggagauaacggccccc

SEQ ID NO: 48317 - RNA, 24 nt, Artificial Sequence
  Synthetic
ggggcgcuggagauaacggccccc

SEQ ID NO: 48318 - RNA, 18 nt, Artificial Sequence
  Synthetic
gcuggagauaacggcccc

SEQ ID NO: 48319 - RNA, 19 nt, Artificial Sequence
  Synthetic
cgcuggagauaacggcccc

SEQ ID NO: 48320 - RNA, 20 nt, Artificial Sequence
  Synthetic
gcgcuggagauaacggcccc

SEQ ID NO: 48321 - RNA, 21 nt, Artificial Sequence
  Synthetic
ggcgcuggagauaacggcccc

SEQ ID NO: 48322 - RNA, 22 nt, Artificial Sequence
  Synthetic
gggcgcuggagauaacggcccc

SEQ ID NO: 48323 - RNA, 23 nt, Artificial Sequence
  Synthetic
ggggcgcuggagauaacggcccc

SEQ ID NO: 48324 - RNA, 24 nt, Artificial Sequence
  Synthetic
cggggcgcuggagauaacggcccc

SEQ ID NO: 48325 - RNA, 18 nt, Artificial Sequence
  Synthetic
cgcuggagauaacggccc

SEQ ID NO: 48326 - RNA, 19 nt, Artificial Sequence
  Synthetic
gcgcuggagauaacggccc

SEQ ID NO: 48327 - RNA, 20 nt, Artificial Sequence
  Synthetic
ggcgcuggagauaacggccc

SEQ ID NO: 48328 - RNA, 21 nt, Artificial Sequence
  Synthetic
gggcgcuggagauaacggccc

SEQ ID NO: 48329 - RNA, 22 nt, Artificial Sequence
  Synthetic
ggggcgcuggagauaacggccc

SEQ ID NO: 48330 - RNA, 23 nt, Artificial Sequence
  Synthetic
cggggcgcuggagauaacggccc

SEQ ID NO: 48331 - RNA, 24 nt, Artificial Sequence
  Synthetic
acggggcgcuggagauaacggccc

SEQ ID NO: 48332 - RNA, 18 nt, Artificial Sequence
  Synthetic
gcuuauaugugggguccc

SEQ ID NO: 48333 - RNA, 19 nt, Artificial Sequence
  Synthetic
ggcuuauaugugggguccc

SEQ ID NO: 48334 - RNA, 20 nt, Artificial Sequence
  Synthetic
gggcuuauaugugggguccc

SEQ ID NO: 48335 - RNA, 21 nt, Artificial Sequence
  Synthetic
ggggcuuauaugugggguccc

SEQ ID NO: 48336 - RNA, 22 nt, Artificial Sequence
  Synthetic
gggggcuuauaugugggguccc

SEQ ID NO: 48337 - RNA, 23 nt, Artificial Sequence
  Synthetic
ugggggcuuauaugugggguccc

SEQ ID NO: 48338 - RNA, 24 nt, Artificial Sequence
  Synthetic
cugggggcuuauaugugggguccc

SEQ ID NO: 48339 - RNA, 18 nt, Artificial Sequence
  Synthetic
ggcuuauauguggggucc

SEQ ID NO: 48340 - RNA, 19 nt, Artificial Sequence
  Synthetic
gggcuuauauguggggucc

SEQ ID NO: 48341 - RNA, 20 nt, Artificial Sequence
  Synthetic
ggggcuuauauguggggucc

SEQ ID NO: 48342 - RNA, 21 nt, Artificial Sequence
  Synthetic
gggggcuuauauguggggucc

SEQ ID NO: 48343 - RNA, 22 nt, Artificial Sequence
  Synthetic
ugggggcuuauauguggggucc

SEQ ID NO: 48344 - RNA, 23 nt, Artificial Sequence
  Synthetic
cugggggcuuauauguggggucc

SEQ ID NO: 48345 - RNA, 24 nt, Artificial Sequence
  Synthetic
gcugggggcuuauauguggggucc

SEQ ID NO: 48346 - RNA, 18 nt, Artificial Sequence
  Synthetic
aaggggggggggagaagc

SEQ ID NO: 48347 - RNA, 19 nt, Artificial Sequence
  Synthetic
gaaggggggggggagaagc

SEQ ID NO: 48348 - RNA, 20 nt, Artificial Sequence
  Synthetic
agaaggggggggggagaagc

SEQ ID NO: 48349 - RNA, 21 nt, Artificial Sequence
  Synthetic
aagaaggggggggggagaagc

SEQ ID NO: 48350 - RNA, 22 nt, Artificial Sequence
  Synthetic
gaagaaggggggggggagaagc

SEQ ID NO: 48351 - RNA, 23 nt, Artificial Sequence
  Synthetic
ugaagaaggggggggggagaagc

SEQ ID NO: 48352 - RNA, 24 nt, Artificial Sequence
  Synthetic
gugaagaaggggggggggagaagc

SEQ ID NO: 48353 - RNA, 18 nt, Artificial Sequence
  Synthetic
gcgcgccggacggggcgc

SEQ ID NO: 48354 - RNA, 19 nt, Artificial Sequence
  Synthetic
ggcgcgccggacggggcgc

SEQ ID NO: 48355 - RNA, 20 nt, Artificial Sequence
  Synthetic
cggcgcgccggacggggcgc

SEQ ID NO: 48356 - RNA, 21 nt, Artificial Sequence
  Synthetic
gcggcgcgccggacggggcgc

SEQ ID NO: 48357 - RNA, 22 nt, Artificial Sequence
  Synthetic
ggcggcgcgccggacggggcgc

SEQ ID NO: 48358 - RNA, 23 nt, Artificial Sequence
  Synthetic
gggcggcgcgccggacggggcgc

SEQ ID NO: 48359 - RNA, 24 nt, Artificial Sequence
  Synthetic
ggggcggcgcgccggacggggcgc

SEQ ID NO: 48360 - RNA, 18 nt, Artificial Sequence
  Synthetic
gugcgggccgggggucgc

SEQ ID NO: 48361 - RNA, 19 nt, Artificial Sequence
  Synthetic
cgugcgggccgggggucgc

SEQ ID NO: 48362 - RNA, 20 nt, Artificial Sequence
  Synthetic
ucgugcgggccgggggucgc

SEQ ID NO: 48363 - RNA, 21 nt, Artificial Sequence
  Synthetic
aucgugcgggccgggggucgc

SEQ ID NO: 48364 - RNA, 22 nt, Artificial Sequence
  Synthetic
gaucgugcgggccgggggucgc

SEQ ID NO: 48365 - RNA, 23 nt, Artificial Sequence
  Synthetic
ggaucgugcgggccgggggucgc

SEQ ID NO: 48366 - RNA, 24 nt, Artificial Sequence
  Synthetic
gggaucgugcgggccgggggucgc

SEQ ID NO: 48367 - RNA, 18 nt, Artificial Sequence
  Synthetic
gggugggugggagaaggc

SEQ ID NO: 48368 - RNA, 19 nt, Artificial Sequence
  Synthetic
ggggugggugggagaaggc

SEQ ID NO: 48369 - RNA, 20 nt, Artificial Sequence
  Synthetic
uggggugggugggagaaggc

SEQ ID NO: 48370 - RNA, 21 nt, Artificial Sequence
  Synthetic
guggggugggugggagaaggc

SEQ ID NO: 48371 - RNA, 22 nt, Artificial Sequence
  Synthetic
cguggggugggugggagaaggc

SEQ ID NO: 48372 - RNA, 23 nt, Artificial Sequence
  Synthetic
gcguggggugggugggagaaggc

SEQ ID NO: 48373 - RNA, 24 nt, Artificial Sequence
  Synthetic
ggcguggggugggugggagaaggc

SEQ ID NO: 48374 - RNA, 18 nt, Artificial Sequence
  Synthetic
gggaugggguuuagcggc

SEQ ID NO: 48375 - RNA, 19 nt, Artificial Sequence
  Synthetic
cgggaugggguuuagcggc

SEQ ID NO: 48376 - RNA, 20 nt, Artificial Sequence
  Synthetic
gcgggaugggguuuagcggc

SEQ ID NO: 48377 - RNA, 21 nt, Artificial Sequence
  Synthetic
ggcgggaugggguuuagcggc

SEQ ID NO: 48378 - RNA, 22 nt, Artificial Sequence
  Synthetic
gggcgggaugggguuuagcggc

SEQ ID NO: 48379 - RNA, 23 nt, Artificial Sequence
  Synthetic
ggggcgggaugggguuuagcggc

SEQ ID NO: 48380 - RNA, 24 nt, Artificial Sequence
  Synthetic
gggggcgggaugggguuuagcggc

SEQ ID NO: 48381 - RNA, 18 nt, Artificial Sequence
  Synthetic
ugucgggaucgugcgggc

SEQ ID NO: 48382 - RNA, 19 nt, Artificial Sequence
  Synthetic
uugucgggaucgugcgggc

SEQ ID NO: 48383 - RNA, 20 nt, Artificial Sequence
  Synthetic
guugucgggaucgugcgggc

SEQ ID NO: 48384 - RNA, 21 nt, Artificial Sequence
  Synthetic
uguugucgggaucgugcgggc

SEQ ID NO: 48385 - RNA, 22 nt, Artificial Sequence
  Synthetic
uuguugucgggaucgugcgggc

SEQ ID NO: 48386 - RNA, 23 nt, Artificial Sequence
  Synthetic
auuguugucgggaucgugcgggc

SEQ ID NO: 48387 - RNA, 24 nt, Artificial Sequence
  Synthetic
uauuguugucgggaucgugcgggc

SEQ ID NO: 48388 - RNA, 18 nt, Artificial Sequence
  Synthetic
ggucgccggggcaggggc

SEQ ID NO: 48389 - RNA, 19 nt, Artificial Sequence
  Synthetic
gggucgccggggcaggggc

SEQ ID NO: 48390 - RNA, 20 nt, Artificial Sequence
  Synthetic
ggggucgccggggcaggggc

SEQ ID NO: 48391 - RNA, 21 nt, Artificial Sequence
  Synthetic
gggggucgccggggcaggggc

SEQ ID NO: 48392 - RNA, 22 nt, Artificial Sequence
  Synthetic
cgggggucgccggggcaggggc

SEQ ID NO: 48393 - RNA, 23 nt, Artificial Sequence
  Synthetic
ccgggggucgccggggcaggggc

SEQ ID NO: 48394 - RNA, 24 nt, Artificial Sequence
  Synthetic
gccgggggucgccggggcaggggc

SEQ ID NO: 48395 - RNA, 18 nt, Artificial Sequence
  Synthetic
gccgggggucgccggggc

SEQ ID NO: 48396 - RNA, 19 nt, Artificial Sequence
  Synthetic
ggccgggggucgccggggc

SEQ ID NO: 48397 - RNA, 20 nt, Artificial Sequence
  Synthetic
gggccgggggucgccggggc

SEQ ID NO: 48398 - RNA, 21 nt, Artificial Sequence
  Synthetic
cgggccgggggucgccggggc

SEQ ID NO: 48399 - RNA, 22 nt, Artificial Sequence
  Synthetic
gcgggccgggggucgccggggc

SEQ ID NO: 48400 - RNA, 23 nt, Artificial Sequence
  Synthetic
ugcgggccgggggucgccggggc

SEQ ID NO: 48401 - RNA, 24 nt, Artificial Sequence
  Synthetic
gugcgggccgggggucgccggggc

SEQ ID NO: 48402 - RNA, 18 nt, Artificial Sequence
  Synthetic
cggggcaggggcgggggc

SEQ ID NO: 48403 - RNA, 19 nt, Artificial Sequence
  Synthetic
ccggggcaggggcgggggc

SEQ ID NO: 48404 - RNA, 20 nt, Artificial Sequence
  Synthetic
gccggggcaggggcgggggc

SEQ ID NO: 48405 - RNA, 21 nt, Artificial Sequence
  Synthetic
cgccggggcaggggcgggggc

SEQ ID NO: 48406 - RNA, 22 nt, Artificial Sequence
  Synthetic
ucgccggggcaggggcgggggc

SEQ ID NO: 48407 - RNA, 23 nt, Artificial Sequence
  Synthetic
gucgccggggcaggggcgggggc

SEQ ID NO: 48408 - RNA, 24 nt, Artificial Sequence
  Synthetic
ggucgccggggcaggggcgggggc

SEQ ID NO: 48409 - RNA, 18 nt, Artificial Sequence
  Synthetic
accgggcucagugggggc

SEQ ID NO: 48410 - RNA, 19 nt, Artificial Sequence
  Synthetic
gaccgggcucagugggggc

SEQ ID NO: 48411 - RNA, 20 nt, Artificial Sequence
  Synthetic
cgaccgggcucagugggggc

SEQ ID NO: 48412 - RNA, 21 nt, Artificial Sequence
  Synthetic
ucgaccgggcucagugggggc

SEQ ID NO: 48413 - RNA, 22 nt, Artificial Sequence
  Synthetic
aucgaccgggcucagugggggc

SEQ ID NO: 48414 - RNA, 23 nt, Artificial Sequence
  Synthetic
gaucgaccgggcucagugggggc

SEQ ID NO: 48415 - RNA, 24 nt, Artificial Sequence
  Synthetic
cgaucgaccgggcucagugggggc

SEQ ID NO: 48416 - RNA, 18 nt, Artificial Sequence
  Synthetic
ucuguucuugcguguggc

SEQ ID NO: 48417 - RNA, 19 nt, Artificial Sequence
  Synthetic
gucuguucuugcguguggc

SEQ ID NO: 48418 - RNA, 20 nt, Artificial Sequence
  Synthetic
ugucuguucuugcguguggc

SEQ ID NO: 48419 - RNA, 21 nt, Artificial Sequence
  Synthetic
gugucuguucuugcguguggc

SEQ ID NO: 48420 - RNA, 22 nt, Artificial Sequence
  Synthetic
cgugucuguucuugcguguggc

SEQ ID NO: 48421 - RNA, 23 nt, Artificial Sequence
  Synthetic
gcgugucuguucuugcguguggc

SEQ ID NO: 48422 - RNA, 24 nt, Artificial Sequence
  Synthetic
ugcgugucuguucuugcguguggc

SEQ ID NO: 48423 - RNA, 18 nt, Artificial Sequence
  Synthetic
aguacgugggucauuggc

SEQ ID NO: 48424 - RNA, 19 nt, Artificial Sequence
  Synthetic
gaguacgugggucauuggc

SEQ ID NO: 48425 - RNA, 20 nt, Artificial Sequence
  Synthetic
ggaguacgugggucauuggc

SEQ ID NO: 48426 - RNA, 21 nt, Artificial Sequence
  Synthetic
uggaguacgugggucauuggc

SEQ ID NO: 48427 - RNA, 22 nt, Artificial Sequence
  Synthetic
uuggaguacgugggucauuggc

SEQ ID NO: 48428 - RNA, 23 nt, Artificial Sequence
  Synthetic
cuuggaguacgugggucauuggc

SEQ ID NO: 48429 - RNA, 24 nt, Artificial Sequence
  Synthetic
ucuuggaguacgugggucauuggc

SEQ ID NO: 48430 - RNA, 18 nt, Artificial Sequence
  Synthetic
ggaccggggcuggguauc

SEQ ID NO: 48431 - RNA, 19 nt, Artificial Sequence
  Synthetic
gggaccggggcuggguauc

SEQ ID NO: 48432 - RNA, 20 nt, Artificial Sequence
  Synthetic
ggggaccggggcuggguauc

SEQ ID NO: 48433 - RNA, 21 nt, Artificial Sequence
  Synthetic
gggggaccggggcuggguauc

SEQ ID NO: 48434 - RNA, 22 nt, Artificial Sequence
  Synthetic
cgggggaccggggcuggguauc

SEQ ID NO: 48435 - RNA, 23 nt, Artificial Sequence
  Synthetic
acgggggaccggggcuggguauc

SEQ ID NO: 48436 - RNA, 24 nt, Artificial Sequence
  Synthetic
aacgggggaccggggcuggguauc

SEQ ID NO: 48437 - RNA, 18 nt, Artificial Sequence
  Synthetic
guggccgaccuuagccuc

SEQ ID NO: 48438 - RNA, 19 nt, Artificial Sequence
  Synthetic
cguggccgaccuuagccuc

SEQ ID NO: 48439 - RNA, 20 nt, Artificial Sequence
  Synthetic
gcguggccgaccuuagccuc

SEQ ID NO: 48440 - RNA, 21 nt, Artificial Sequence
  Synthetic
ggcguggccgaccuuagccuc

SEQ ID NO: 48441 - RNA, 22 nt, Artificial Sequence
  Synthetic
uggcguggccgaccuuagccuc

SEQ ID NO: 48442 - RNA, 23 nt, Artificial Sequence
  Synthetic
guggcguggccgaccuuagccuc

SEQ ID NO: 48443 - RNA, 24 nt, Artificial Sequence
  Synthetic
aguggcguggccgaccuuagccuc

SEQ ID NO: 48444 - RNA, 18 nt, Artificial Sequence
  Synthetic
gggcuuauaugugggguc

SEQ ID NO: 48445 - RNA, 19 nt, Artificial Sequence
  Synthetic
ggggcuuauaugugggguc

SEQ ID NO: 48446 - RNA, 20 nt, Artificial Sequence
  Synthetic
gggggcuuauaugugggguc

SEQ ID NO: 48447 - RNA, 21 nt, Artificial Sequence
  Synthetic
ugggggcuuauaugugggguc

SEQ ID NO: 48448 - RNA, 22 nt, Artificial Sequence
  Synthetic
cugggggcuuauaugugggguc

SEQ ID NO: 48449 - RNA, 23 nt, Artificial Sequence
  Synthetic
gcugggggcuuauaugugggguc

SEQ ID NO: 48450 - RNA, 24 nt, Artificial Sequence
  Synthetic
ggcugggggcuuauaugugggguc

SEQ ID NO: 48451 - RNA, 18 nt, Artificial Sequence
  Synthetic
ggugggacacaugccuuc

SEQ ID NO: 48452 - RNA, 19 nt, Artificial Sequence
  Synthetic
gggugggacacaugccuuc

SEQ ID NO: 48453 - RNA, 20 nt, Artificial Sequence
  Synthetic
ggggugggacacaugccuuc

SEQ ID NO: 48454 - RNA, 21 nt, Artificial Sequence
  Synthetic
cggggugggacacaugccuuc

SEQ ID NO: 48455 - RNA, 22 nt, Artificial Sequence
  Synthetic
gcggggugggacacaugccuuc

SEQ ID NO: 48456 - RNA, 23 nt, Artificial Sequence
  Synthetic
ggcggggugggacacaugccuuc

SEQ ID NO: 48457 - RNA, 24 nt, Artificial Sequence
  Synthetic
aggcggggugggacacaugccuuc

SEQ ID NO: 48458 - RNA, 18 nt, Artificial Sequence
  Synthetic
guacugggggugaagaag

SEQ ID NO: 48459 - RNA, 19 nt, Artificial Sequence
  Synthetic
gguacugggggugaagaag

SEQ ID NO: 48460 - RNA, 20 nt, Artificial Sequence
  Synthetic
ggguacugggggugaagaag

SEQ ID NO: 48461 - RNA, 21 nt, Artificial Sequence
  Synthetic
aggguacugggggugaagaag

SEQ ID NO: 48462 - RNA, 22 nt, Artificial Sequence
  Synthetic
gaggguacugggggugaagaag

SEQ ID NO: 48463 - RNA, 23 nt, Artificial Sequence
  Synthetic
ggaggguacugggggugaagaag

SEQ ID NO: 48464 - RNA, 24 nt, Artificial Sequence
  Synthetic
aggaggguacugggggugaagaag

SEQ ID NO: 48465 - RNA, 18 nt, Artificial Sequence
  Synthetic
uggggugggugggagaag

SEQ ID NO: 48466 - RNA, 19 nt, Artificial Sequence
  Synthetic
guggggugggugggagaag

SEQ ID NO: 48467 - RNA, 20 nt, Artificial Sequence
  Synthetic
cguggggugggugggagaag

SEQ ID NO: 48468 - RNA, 21 nt, Artificial Sequence
  Synthetic
gcguggggugggugggagaag

SEQ ID NO: 48469 - RNA, 22 nt, Artificial Sequence
  Synthetic
ggcguggggugggugggagaag

SEQ ID NO: 48470 - RNA, 23 nt, Artificial Sequence
  Synthetic
gggcguggggugggugggagaag

SEQ ID NO: 48471 - RNA, 24 nt, Artificial Sequence
  Synthetic
ggggcguggggugggugggagaag

SEQ ID NO: 48472 - RNA, 18 nt, Artificial Sequence
  Synthetic
aggguacugggggugaag

SEQ ID NO: 48473 - RNA, 19 nt, Artificial Sequence
  Synthetic
gaggguacugggggugaag

SEQ ID NO: 48474 - RNA, 20 nt, Artificial Sequence
  Synthetic
ggaggguacugggggugaag

SEQ ID NO: 48475 - RNA, 21 nt, Artificial Sequence
  Synthetic
aggaggguacugggggugaag

SEQ ID NO: 48476 - RNA, 22 nt, Artificial Sequence
  Synthetic
gaggaggguacugggggugaag

SEQ ID NO: 48477 - RNA, 23 nt, Artificial Sequence
  Synthetic
ggaggaggguacugggggugaag

SEQ ID NO: 48478 - RNA, 24 nt, Artificial Sequence
  Synthetic
gggaggaggguacugggggugaag

SEQ ID NO: 48479 - RNA, 18 nt, Artificial Sequence
  Synthetic
ccaggcacaaaaacacag

SEQ ID NO: 48480 - RNA, 19 nt, Artificial Sequence
  Synthetic
gccaggcacaaaaacacag

SEQ ID NO: 48481 - RNA, 20 nt, Artificial Sequence
  Synthetic
agccaggcacaaaaacacag

SEQ ID NO: 48482 - RNA, 21 nt, Artificial Sequence
  Synthetic
gagccaggcacaaaaacacag

SEQ ID NO: 48483 - RNA, 22 nt, Artificial Sequence
  Synthetic
agagccaggcacaaaaacacag

SEQ ID NO: 48484 - RNA, 23 nt, Artificial Sequence
  Synthetic
gagagccaggcacaaaaacacag

SEQ ID NO: 48485 - RNA, 24 nt, Artificial Sequence
  Synthetic
agagagccaggcacaaaaacacag

SEQ ID NO: 48486 - RNA, 18 nt, Artificial Sequence
  Synthetic
ucgaucgaccgggcucag

SEQ ID NO: 48487 - RNA, 19 nt, Artificial Sequence
  Synthetic
gucgaucgaccgggcucag

SEQ ID NO: 48488 - RNA, 20 nt, Artificial Sequence
  Synthetic
cgucgaucgaccgggcucag

SEQ ID NO: 48489 - RNA, 21 nt, Artificial Sequence
  Synthetic
ucgucgaucgaccgggcucag

SEQ ID NO: 48490 - RNA, 22 nt, Artificial Sequence
  Synthetic
cucgucgaucgaccgggcucag

SEQ ID NO: 48491 - RNA, 23 nt, Artificial Sequence
  Synthetic
gcucgucgaucgaccgggcucag

SEQ ID NO: 48492 - RNA, 24 nt, Artificial Sequence
  Synthetic
ugcucgucgaucgaccgggcucag

SEQ ID NO: 48493 - RNA, 18 nt, Artificial Sequence
  Synthetic
ucugacuaagggugggag

SEQ ID NO: 48494 - RNA, 19 nt, Artificial Sequence
  Synthetic
gucugacuaagggugggag

SEQ ID NO: 48495 - RNA, 20 nt, Artificial Sequence
  Synthetic
agucugacuaagggugggag

SEQ ID NO: 48496 - RNA, 21 nt, Artificial Sequence
  Synthetic
gagucugacuaagggugggag

SEQ ID NO: 48497 - RNA, 22 nt, Artificial Sequence
  Synthetic
agagucugacuaagggugggag

SEQ ID NO: 48498 - RNA, 23 nt, Artificial Sequence
  Synthetic
cagagucugacuaagggugggag

SEQ ID NO: 48499 - RNA, 24 nt, Artificial Sequence
  Synthetic
acagagucugacuaagggugggag

SEQ ID NO: 48500 - RNA, 18 nt, Artificial Sequence
  Synthetic
aacggcccccggggaacg

SEQ ID NO: 48501 - RNA, 19 nt, Artificial Sequence
  Synthetic
uaacggcccccggggaacg

SEQ ID NO: 48502 - RNA, 20 nt, Artificial Sequence
  Synthetic
auaacggcccccggggaacg

SEQ ID NO: 48503 - RNA, 21 nt, Artificial Sequence
  Synthetic
gauaacggcccccggggaacg

SEQ ID NO: 48504 - RNA, 22 nt, Artificial Sequence
  Synthetic
agauaacggcccccggggaacg

SEQ ID NO: 48505 - RNA, 23 nt, Artificial Sequence
  Synthetic
gagauaacggcccccggggaacg

SEQ ID NO: 48506 - RNA, 24 nt, Artificial Sequence
  Synthetic
ggagauaacggcccccggggaacg

SEQ ID NO: 48507 - RNA, 18 nt, Artificial Sequence
  Synthetic
ucgacgagugggauaacg

SEQ ID NO: 48508 - RNA, 19 nt, Artificial Sequence
  Synthetic
cucgacgagugggauaacg

SEQ ID NO: 48509 - RNA, 20 nt, Artificial Sequence
  Synthetic
ccucgacgagugggauaacg

SEQ ID NO: 48510 - RNA, 21 nt, Artificial Sequence
  Synthetic
cccucgacgagugggauaacg

SEQ ID NO: 48511 - RNA, 22 nt, Artificial Sequence
  Synthetic
gcccucgacgagugggauaacg

SEQ ID NO: 48512 - RNA, 23 nt, Artificial Sequence
  Synthetic
cgcccucgacgagugggauaacg

SEQ ID NO: 48513 - RNA, 24 nt, Artificial Sequence
  Synthetic
gcgcccucgacgagugggauaacg

SEQ ID NO: 48514 - RNA, 18 nt, Artificial Sequence
  Synthetic
gagcccggcagaacaccg

SEQ ID NO: 48515 - RNA, 19 nt, Artificial Sequence
  Synthetic
ggagcccggcagaacaccg

SEQ ID NO: 48516 - RNA, 20 nt, Artificial Sequence
  Synthetic
uggagcccggcagaacaccg

SEQ ID NO: 48517 - RNA, 21 nt, Artificial Sequence
  Synthetic
auggagcccggcagaacaccg

SEQ ID NO: 48518 - RNA, 22 nt, Artificial Sequence
  Synthetic
gauggagcccggcagaacaccg

SEQ ID NO: 48519 - RNA, 23 nt, Artificial Sequence
  Synthetic
cgauggagcccggcagaacaccg

SEQ ID NO: 48520 - RNA, 24 nt, Artificial Sequence
  Synthetic
gcgauggagcccggcagaacaccg

SEQ ID NO: 48521 - RNA, 18 nt, Artificial Sequence
  Synthetic
uggagauaacggcccccg

SEQ ID NO: 48522 - RNA, 19 nt, Artificial Sequence
  Synthetic
cuggagauaacggcccccg

SEQ ID NO: 48523 - RNA, 20 nt, Artificial Sequence
  Synthetic
gcuggagauaacggcccccg

SEQ ID NO: 48524 - RNA, 21 nt, Artificial Sequence
  Synthetic
cgcuggagauaacggcccccg

SEQ ID NO: 48525 - RNA, 22 nt, Artificial Sequence
  Synthetic
gcgcuggagauaacggcccccg

SEQ ID NO: 48526 - RNA, 23 nt, Artificial Sequence
  Synthetic
ggcgcuggagauaacggcccccg

SEQ ID NO: 48527 - RNA, 24 nt, Artificial Sequence
  Synthetic
gggcgcuggagauaacggcccccg

SEQ ID NO: 48528 - RNA, 18 nt, Artificial Sequence
  Synthetic
acaccccgccgcuuuccg

SEQ ID NO: 48529 - RNA, 19 nt, Artificial Sequence
  Synthetic
aacaccccgccgcuuuccg

SEQ ID NO: 48530 - RNA, 20 nt, Artificial Sequence
  Synthetic
caacaccccgccgcuuuccg

SEQ ID NO: 48531 - RNA, 21 nt, Artificial Sequence
  Synthetic
ccaacaccccgccgcuuuccg

SEQ ID NO: 48532 - RNA, 22 nt, Artificial Sequence
  Synthetic
cccaacaccccgccgcuuuccg

SEQ ID NO: 48533 - RNA, 23 nt, Artificial Sequence
  Synthetic
ccccaacaccccgccgcuuuccg

SEQ ID NO: 48534 - RNA, 24 nt, Artificial Sequence
  Synthetic
cccccaacaccccgccgcuuuccg

SEQ ID NO: 48535 - RNA, 18 nt, Artificial Sequence
  Synthetic
gcgggaugggguuuagcg

SEQ ID NO: 48536 - RNA, 19 nt, Artificial Sequence
  Synthetic
ggcgggaugggguuuagcg

SEQ ID NO: 48537 - RNA, 20 nt, Artificial Sequence
  Synthetic
gggcgggaugggguuuagcg

SEQ ID NO: 48538 - RNA, 21 nt, Artificial Sequence
  Synthetic
ggggcgggaugggguuuagcg

SEQ ID NO: 48539 - RNA, 22 nt, Artificial Sequence
  Synthetic
gggggcgggaugggguuuagcg

SEQ ID NO: 48540 - RNA, 23 nt, Artificial Sequence
  Synthetic
cgggggcgggaugggguuuagcg

SEQ ID NO: 48541 - RNA, 24 nt, Artificial Sequence
  Synthetic
ccgggggcgggaugggguuuagcg

SEQ ID NO: 48542 - RNA, 18 nt, Artificial Sequence
  Synthetic
gcggcggggggcggcgcg

SEQ ID NO: 48543 - RNA, 19 nt, Artificial Sequence
  Synthetic
agcggcggggggcggcgcg

SEQ ID NO: 48544 - RNA, 20 nt, Artificial Sequence
  Synthetic
uagcggcggggggcggcgcg

SEQ ID NO: 48545 - RNA, 21 nt, Artificial Sequence
  Synthetic
uuagcggcggggggcggcgcg

SEQ ID NO: 48546 - RNA, 22 nt, Artificial Sequence
  Synthetic
uuuagcggcggggggcggcgcg

SEQ ID NO: 48547 - RNA, 23 nt, Artificial Sequence
  Synthetic
guuuagcggcggggggcggcgcg

SEQ ID NO: 48548 - RNA, 24 nt, Artificial Sequence
  Synthetic
gguuuagcggcggggggcggcgcg

SEQ ID NO: 48549 - RNA, 18 nt, Artificial Sequence
  Synthetic
gcgagaacaggaaaggcg

SEQ ID NO: 48550 - RNA, 19 nt, Artificial Sequence
  Synthetic
agcgagaacaggaaaggcg

SEQ ID NO: 48551 - RNA, 20 nt, Artificial Sequence
  Synthetic
aagcgagaacaggaaaggcg

SEQ ID NO: 48552 - RNA, 21 nt, Artificial Sequence
  Synthetic
gaagcgagaacaggaaaggcg

SEQ ID NO: 48553 - RNA, 22 nt, Artificial Sequence
  Synthetic
agaagcgagaacaggaaaggcg

SEQ ID NO: 48554 - RNA, 23 nt, Artificial Sequence
  Synthetic
gagaagcgagaacaggaaaggcg

SEQ ID NO: 48555 - RNA, 24 nt, Artificial Sequence
  Synthetic
ggagaagcgagaacaggaaaggcg

SEQ ID NO: 48556 - RNA, 18 nt, Artificial Sequence
  Synthetic
ggugggugggagaaggcg

SEQ ID NO: 48557 - RNA, 19 nt, Artificial Sequence
  Synthetic
gggugggugggagaaggcg

SEQ ID NO: 48558 - RNA, 20 nt, Artificial Sequence
  Synthetic
ggggugggugggagaaggcg

SEQ ID NO: 48559 - RNA, 21 nt, Artificial Sequence
  Synthetic
uggggugggugggagaaggcg

SEQ ID NO: 48560 - RNA, 22 nt, Artificial Sequence
  Synthetic
guggggugggugggagaaggcg

SEQ ID NO: 48561 - RNA, 23 nt, Artificial Sequence
  Synthetic
cguggggugggugggagaaggcg

SEQ ID NO: 48562 - RNA, 24 nt, Artificial Sequence
  Synthetic
gcguggggugggugggagaaggcg

SEQ ID NO: 48563 - RNA, 18 nt, Artificial Sequence
  Synthetic
ggaugggguuuagcggcg

SEQ ID NO: 48564 - RNA, 19 nt, Artificial Sequence
  Synthetic
gggaugggguuuagcggcg

SEQ ID NO: 48565 - RNA, 20 nt, Artificial Sequence
  Synthetic
cgggaugggguuuagcggcg

SEQ ID NO: 48566 - RNA, 21 nt, Artificial Sequence
  Synthetic
gcgggaugggguuuagcggcg

SEQ ID NO: 48567 - RNA, 22 nt, Artificial Sequence
  Synthetic
ggcgggaugggguuuagcggcg

SEQ ID NO: 48568 - RNA, 23 nt, Artificial Sequence
  Synthetic
gggcgggaugggguuuagcggcg

SEQ ID NO: 48569 - RNA, 24 nt, Artificial Sequence
  Synthetic
ggggcgggaugggguuuagcggcg

SEQ ID NO: 48570 - RNA, 18 nt, Artificial Sequence
  Synthetic
ggcgcgccggacggggcg

SEQ ID NO: 48571 - RNA, 19 nt, Artificial Sequence
  Synthetic
cggcgcgccggacggggcg

SEQ ID NO: 48572 - RNA, 20 nt, Artificial Sequence
  Synthetic
gcggcgcgccggacggggcg

SEQ ID NO: 48573 - RNA, 21 nt, Artificial Sequence
  Synthetic
ggcggcgcgccggacggggcg

SEQ ID NO: 48574 - RNA, 22 nt, Artificial Sequence
  Synthetic
gggcggcgcgccggacggggcg

SEQ ID NO: 48575 - RNA, 23 nt, Artificial Sequence
  Synthetic
ggggcggcgcgccggacggggcg

SEQ ID NO: 48576 - RNA, 24 nt, Artificial Sequence
  Synthetic
gggggcggcgcgccggacggggcg

SEQ ID NO: 48577 - RNA, 18 nt, Artificial Sequence
  Synthetic
guacgugggucauuggcg

SEQ ID NO: 48578 - RNA, 19 nt, Artificial Sequence
  Synthetic
aguacgugggucauuggcg

SEQ ID NO: 48579 - RNA, 20 nt, Artificial Sequence
  Synthetic
gaguacgugggucauuggcg

SEQ ID NO: 48580 - RNA, 21 nt, Artificial Sequence
  Synthetic
ggaguacgugggucauuggcg

SEQ ID NO: 48581 - RNA, 22 nt, Artificial Sequence
  Synthetic
uggaguacgugggucauuggcg

SEQ ID NO: 48582 - RNA, 23 nt, Artificial Sequence
  Synthetic
uuggaguacgugggucauuggcg

SEQ ID NO: 48583 - RNA, 24 nt, Artificial Sequence
  Synthetic
cuuggaguacgugggucauuggcg

SEQ ID NO: 48584 - RNA, 18 nt, Artificial Sequence
  Synthetic
cgugcgggccgggggucg

SEQ ID NO: 48585 - RNA, 19 nt, Artificial Sequence
  Synthetic
ucgugcgggccgggggucg

SEQ ID NO: 48586 - RNA, 20 nt, Artificial Sequence
  Synthetic
aucgugcgggccgggggucg

SEQ ID NO: 48587 - RNA, 21 nt, Artificial Sequence
  Synthetic
gaucgugcgggccgggggucg

SEQ ID NO: 48588 - RNA, 22 nt, Artificial Sequence
  Synthetic
ggaucgugcgggccgggggucg

SEQ ID NO: 48589 - RNA, 23 nt, Artificial Sequence
  Synthetic
gggaucgugcgggccgggggucg

SEQ ID NO: 48590 - RNA, 24 nt, Artificial Sequence
  Synthetic
cgggaucgugcgggccgggggucg

SEQ ID NO: 48591 - RNA, 18 nt, Artificial Sequence
  Synthetic
uacugggggugaagaagg

SEQ ID NO: 48592 - RNA, 19 nt, Artificial Sequence
  Synthetic
guacugggggugaagaagg

SEQ ID NO: 48593 - RNA, 20 nt, Artificial Sequence
  Synthetic
gguacugggggugaagaagg

SEQ ID NO: 48594 - RNA, 21 nt, Artificial Sequence
  Synthetic
ggguacugggggugaagaagg

SEQ ID NO: 48595 - RNA, 22 nt, Artificial Sequence
  Synthetic
aggguacugggggugaagaagg

SEQ ID NO: 48596 - RNA, 23 nt, Artificial Sequence
  Synthetic
gaggguacugggggugaagaagg

SEQ ID NO: 48597 - RNA, 24 nt, Artificial Sequence
  Synthetic
ggaggguacugggggugaagaagg

SEQ ID NO: 48598 - RNA, 18 nt, Artificial Sequence
  Synthetic
gauaacgggggaggaagg

SEQ ID NO: 48599 - RNA, 19 nt, Artificial Sequence
  Synthetic
ggauaacgggggaggaagg

SEQ ID NO: 48600 - RNA, 20 nt, Artificial Sequence
  Synthetic
gggauaacgggggaggaagg

SEQ ID NO: 48601 - RNA, 21 nt, Artificial Sequence
  Synthetic
ugggauaacgggggaggaagg

SEQ ID NO: 48602 - RNA, 22 nt, Artificial Sequence
  Synthetic
gugggauaacgggggaggaagg

SEQ ID NO: 48603 - RNA, 23 nt, Artificial Sequence
  Synthetic
agugggauaacgggggaggaagg

SEQ ID NO: 48604 - RNA, 24 nt, Artificial Sequence
  Synthetic
gagugggauaacgggggaggaagg

SEQ ID NO: 48605 - RNA, 18 nt, Artificial Sequence
  Synthetic
aacagagucugacuaagg

SEQ ID NO: 48606 - RNA, 19 nt, Artificial Sequence
  Synthetic
uaacagagucugacuaagg

SEQ ID NO: 48607 - RNA, 20 nt, Artificial Sequence
  Synthetic
guaacagagucugacuaagg

SEQ ID NO: 48608 - RNA, 21 nt, Artificial Sequence
  Synthetic
aguaacagagucugacuaagg

SEQ ID NO: 48609 - RNA, 22 nt, Artificial Sequence
  Synthetic
aaguaacagagucugacuaagg

SEQ ID NO: 48610 - RNA, 23 nt, Artificial Sequence
  Synthetic
uaaguaacagagucugacuaagg

SEQ ID NO: 48611 - RNA, 24 nt, Artificial Sequence
  Synthetic
guaaguaacagagucugacuaagg

SEQ ID NO: 48612 - RNA, 18 nt, Artificial Sequence
  Synthetic
acgggggaggaagggagg

SEQ ID NO: 48613 - RNA, 19 nt, Artificial Sequence
  Synthetic
aacgggggaggaagggagg

SEQ ID NO: 48614 - RNA, 20 nt, Artificial Sequence
  Synthetic
uaacgggggaggaagggagg

SEQ ID NO: 48615 - RNA, 21 nt, Artificial Sequence
  Synthetic
auaacgggggaggaagggagg

SEQ ID NO: 48616 - RNA, 22 nt, Artificial Sequence
  Synthetic
gauaacgggggaggaagggagg

SEQ ID NO: 48617 - RNA, 23 nt, Artificial Sequence
  Synthetic
ggauaacgggggaggaagggagg

SEQ ID NO: 48618 - RNA, 24 nt, Artificial Sequence
  Synthetic
gggauaacgggggaggaagggagg

SEQ ID NO: 48619 - RNA, 18 nt, Artificial Sequence
  Synthetic
gugggauaacgggggagg

SEQ ID NO: 48620 - RNA, 19 nt, Artificial Sequence
  Synthetic
agugggauaacgggggagg

SEQ ID NO: 48621 - RNA, 20 nt, Artificial Sequence
  Synthetic
gagugggauaacgggggagg

SEQ ID NO: 48622 - RNA, 21 nt, Artificial Sequence
  Synthetic
cgagugggauaacgggggagg

SEQ ID NO: 48623 - RNA, 22 nt, Artificial Sequence
  Synthetic
acgagugggauaacgggggagg

SEQ ID NO: 48624 - RNA, 23 nt, Artificial Sequence
  Synthetic
gacgagugggauaacgggggagg

SEQ ID NO: 48625 - RNA, 24 nt, Artificial Sequence
  Synthetic
cgacgagugggauaacgggggagg

SEQ ID NO: 48626 - RNA, 18 nt, Artificial Sequence
  Synthetic
cugacuaagggugggagg

SEQ ID NO: 48627 - RNA, 19 nt, Artificial Sequence
  Synthetic
ucugacuaagggugggagg

SEQ ID NO: 48628 - RNA, 20 nt, Artificial Sequence
  Synthetic
gucugacuaagggugggagg

SEQ ID NO: 48629 - RNA, 21 nt, Artificial Sequence
  Synthetic
agucugacuaagggugggagg

SEQ ID NO: 48630 - RNA, 22 nt, Artificial Sequence
  Synthetic
gagucugacuaagggugggagg

SEQ ID NO: 48631 - RNA, 23 nt, Artificial Sequence
  Synthetic
agagucugacuaagggugggagg

SEQ ID NO: 48632 - RNA, 24 nt, Artificial Sequence
  Synthetic
cagagucugacuaagggugggagg

SEQ ID NO: 48633 - RNA, 18 nt, Artificial Sequence
  Synthetic
cgacgagugggauaacgg

SEQ ID NO: 48634 - RNA, 19 nt, Artificial Sequence
  Synthetic
ucgacgagugggauaacgg

SEQ ID NO: 48635 - RNA, 20 nt, Artificial Sequence
  Synthetic
cucgacgagugggauaacgg

SEQ ID NO: 48636 - RNA, 21 nt, Artificial Sequence
  Synthetic
ccucgacgagugggauaacgg

SEQ ID NO: 48637 - RNA, 22 nt, Artificial Sequence
  Synthetic
cccucgacgagugggauaacgg

SEQ ID NO: 48638 - RNA, 23 nt, Artificial Sequence
  Synthetic
gcccucgacgagugggauaacgg

SEQ ID NO: 48639 - RNA, 24 nt, Artificial Sequence
  Synthetic
cgcccucgacgagugggauaacgg

SEQ ID NO: 48640 - RNA, 18 nt, Artificial Sequence
  Synthetic
aaaggcgauggagcccgg

SEQ ID NO: 48641 - RNA, 19 nt, Artificial Sequence
  Synthetic
gaaaggcgauggagcccgg

SEQ ID NO: 48642 - RNA, 20 nt, Artificial Sequence
  Synthetic
ggaaaggcgauggagcccgg

SEQ ID NO: 48643 - RNA, 21 nt, Artificial Sequence
  Synthetic
aggaaaggcgauggagcccgg

SEQ ID NO: 48644 - RNA, 22 nt, Artificial Sequence
  Synthetic
caggaaaggcgauggagcccgg

SEQ ID NO: 48645 - RNA, 23 nt, Artificial Sequence
  Synthetic
acaggaaaggcgauggagcccgg

SEQ ID NO: 48646 - RNA, 24 nt, Artificial Sequence
  Synthetic
aacaggaaaggcgauggagcccgg

SEQ ID NO: 48647 - RNA, 18 nt, Artificial Sequence
  Synthetic
cggggggcggcgcgccgg

SEQ ID NO: 48648 - RNA, 19 nt, Artificial Sequence
  Synthetic
gcggggggcggcgcgccgg

SEQ ID NO: 48649 - RNA, 20 nt, Artificial Sequence
  Synthetic
ggcggggggcggcgcgccgg

SEQ ID NO: 48650 - RNA, 21 nt, Artificial Sequence
  Synthetic
cggcggggggcggcgcgccgg

SEQ ID NO: 48651 - RNA, 22 nt, Artificial Sequence
  Synthetic
gcggcggggggcggcgcgccgg

SEQ ID NO: 48652 - RNA, 23 nt, Artificial Sequence
  Synthetic
agcggcggggggcggcgcgccgg

SEQ ID NO: 48653 - RNA, 24 nt, Artificial Sequence
  Synthetic
uagcggcggggggcggcgcgccgg

SEQ ID NO: 48654 - RNA, 18 nt, Artificial Sequence
  Synthetic
cgggaugggguuuagcgg

SEQ ID NO: 48655 - RNA, 19 nt, Artificial Sequence
  Synthetic
gcgggaugggguuuagcgg

SEQ ID NO: 48656 - RNA, 20 nt, Artificial Sequence
  Synthetic
ggcgggaugggguuuagcgg

SEQ ID NO: 48657 - RNA, 21 nt, Artificial Sequence
  Synthetic
gggcgggaugggguuuagcgg

SEQ ID NO: 48658 - RNA, 22 nt, Artificial Sequence
  Synthetic
ggggcgggaugggguuuagcgg

SEQ ID NO: 48659 - RNA, 23 nt, Artificial Sequence
  Synthetic
gggggcgggaugggguuuagcgg

SEQ ID NO: 48660 - RNA, 24 nt, Artificial Sequence
  Synthetic
cgggggcgggaugggguuuagcgg

SEQ ID NO: 48661 - RNA, 18 nt, Artificial Sequence
  Synthetic
acugggggugaagaaggg

SEQ ID NO: 48662 - RNA, 19 nt, Artificial Sequence
  Synthetic
uacugggggugaagaaggg

SEQ ID NO: 48663 - RNA, 20 nt, Artificial Sequence
  Synthetic
guacugggggugaagaaggg

SEQ ID NO: 48664 - RNA, 21 nt, Artificial Sequence
  Synthetic
gguacugggggugaagaaggg

SEQ ID NO: 48665 - RNA, 22 nt, Artificial Sequence
  Synthetic
ggguacugggggugaagaaggg

SEQ ID NO: 48666 - RNA, 23 nt, Artificial Sequence
  Synthetic
aggguacugggggugaagaaggg

SEQ ID NO: 48667 - RNA, 24 nt, Artificial Sequence
  Synthetic
gaggguacugggggugaagaaggg

SEQ ID NO: 48668 - RNA, 18 nt, Artificial Sequence
  Synthetic
auaacgggggaggaaggg

SEQ ID NO: 48669 - RNA, 19 nt, Artificial Sequence
  Synthetic
gauaacgggggaggaaggg

SEQ ID NO: 48670 - RNA, 20 nt, Artificial Sequence
  Synthetic
ggauaacgggggaggaaggg

SEQ ID NO: 48671 - RNA, 21 nt, Artificial Sequence
  Synthetic
gggauaacgggggaggaaggg

SEQ ID NO: 48672 - RNA, 22 nt, Artificial Sequence
  Synthetic
ugggauaacgggggaggaaggg

SEQ ID NO: 48673 - RNA, 23 nt, Artificial Sequence
  Synthetic
gugggauaacgggggaggaaggg

SEQ ID NO: 48674 - RNA, 24 nt, Artificial Sequence
  Synthetic
agugggauaacgggggaggaaggg

SEQ ID NO: 48675 - RNA, 18 nt, Artificial Sequence
  Synthetic
acagagucugacuaaggg

SEQ ID NO: 48676 - RNA, 19 nt, Artificial Sequence
  Synthetic
aacagagucugacuaaggg

SEQ ID NO: 48677 - RNA, 20 nt, Artificial Sequence
  Synthetic
uaacagagucugacuaaggg

SEQ ID NO: 48678 - RNA, 21 nt, Artificial Sequence
  Synthetic
guaacagagucugacuaaggg

SEQ ID NO: 48679 - RNA, 22 nt, Artificial Sequence
  Synthetic
aguaacagagucugacuaaggg

SEQ ID NO: 48680 - RNA, 23 nt, Artificial Sequence
  Synthetic
aaguaacagagucugacuaaggg

SEQ ID NO: 48681 - RNA, 24 nt, Artificial Sequence
  Synthetic
uaaguaacagagucugacuaaggg

SEQ ID NO: 48682 - RNA, 18 nt, Artificial Sequence
  Synthetic
ggggucgccggggcaggg

SEQ ID NO: 48683 - RNA, 19 nt, Artificial Sequence
  Synthetic
gggggucgccggggcaggg

SEQ ID NO: 48684 - RNA, 20 nt, Artificial Sequence
  Synthetic
cgggggucgccggggcaggg

SEQ ID NO: 48685 - RNA, 21 nt, Artificial Sequence
  Synthetic
ccgggggucgccggggcaggg

SEQ ID NO: 48686 - RNA, 22 nt, Artificial Sequence
  Synthetic
gccgggggucgccggggcaggg

SEQ ID NO: 48687 - RNA, 23 nt, Artificial Sequence
  Synthetic
ggccgggggucgccggggcaggg

SEQ ID NO: 48688 - RNA, 24 nt, Artificial Sequence
  Synthetic
gggccgggggucgccggggcaggg

SEQ ID NO: 48689 - RNA, 18 nt, Artificial Sequence
  Synthetic
cgggggaggaagggaggg

SEQ ID NO: 48690 - RNA, 19 nt, Artificial Sequence
  Synthetic
acgggggaggaagggaggg

SEQ ID NO: 48691 - RNA, 20 nt, Artificial Sequence
  Synthetic
aacgggggaggaagggaggg

SEQ ID NO: 48692 - RNA, 21 nt, Artificial Sequence
  Synthetic
uaacgggggaggaagggaggg

SEQ ID NO: 48693 - RNA, 22 nt, Artificial Sequence
  Synthetic
auaacgggggaggaagggaggg

SEQ ID NO: 48694 - RNA, 23 nt, Artificial Sequence
  Synthetic
gauaacgggggaggaagggaggg

SEQ ID NO: 48695 - RNA, 24 nt, Artificial Sequence
  Synthetic
ggauaacgggggaggaagggaggg

SEQ ID NO: 48696 - RNA, 18 nt, Artificial Sequence
  Synthetic
ugacuaagggugggaggg

SEQ ID NO: 48697 - RNA, 19 nt, Artificial Sequence
  Synthetic
cugacuaagggugggaggg

SEQ ID NO: 48698 - RNA, 20 nt, Artificial Sequence
  Synthetic
ucugacuaagggugggaggg

SEQ ID NO: 48699 - RNA, 21 nt, Artificial Sequence
  Synthetic
gucugacuaagggugggaggg

SEQ ID NO: 48700 - RNA, 22 nt, Artificial Sequence
  Synthetic
agucugacuaagggugggaggg

SEQ ID NO: 48701 - RNA, 23 nt, Artificial Sequence
  Synthetic
gagucugacuaagggugggaggg

SEQ ID NO: 48702 - RNA, 24 nt, Artificial Sequence
  Synthetic
agagucugacuaagggugggaggg

SEQ ID NO: 48703 - RNA, 18 nt, Artificial Sequence
  Synthetic
ugggcggcgguggccggg

SEQ ID NO: 48704 - RNA, 19 nt, Artificial Sequence
  Synthetic
gugggcggcgguggccggg

SEQ ID NO: 48705 - RNA, 20 nt, Artificial Sequence
  Synthetic
ggugggcggcgguggccggg

SEQ ID NO: 48706 - RNA, 21 nt, Artificial Sequence
  Synthetic
gggugggcggcgguggccggg

SEQ ID NO: 48707 - RNA, 22 nt, Artificial Sequence
  Synthetic
ugggugggcggcgguggccggg

SEQ ID NO: 48708 - RNA, 23 nt, Artificial Sequence
  Synthetic
gugggugggcggcgguggccggg

SEQ ID NO: 48709 - RNA, 24 nt, Artificial Sequence
  Synthetic
ggugggugggcggcgguggccggg

SEQ ID NO: 48710 - RNA, 18 nt, Artificial Sequence
  Synthetic
cacaaaaacacaggcggg

SEQ ID NO: 48711 - RNA, 19 nt, Artificial Sequence
  Synthetic
gcacaaaaacacaggcggg

SEQ ID NO: 48712 - RNA, 20 nt, Artificial Sequence
  Synthetic
ggcacaaaaacacaggcggg

SEQ ID NO: 48713 - RNA, 21 nt, Artificial Sequence
  Synthetic
aggcacaaaaacacaggcggg

SEQ ID NO: 48714 - RNA, 22 nt, Artificial Sequence
  Synthetic
caggcacaaaaacacaggcggg

SEQ ID NO: 48715 - RNA, 23 nt, Artificial Sequence
  Synthetic
ccaggcacaaaaacacaggcggg

SEQ ID NO: 48716 - RNA, 24 nt, Artificial Sequence
  Synthetic
gccaggcacaaaaacacaggcggg

SEQ ID NO: 48717 - RNA, 18 nt, Artificial Sequence
  Synthetic
uggggucccgggggcggg

SEQ ID NO: 48718 - RNA, 19 nt, Artificial Sequence
  Synthetic
guggggucccgggggcggg

SEQ ID NO: 48719 - RNA, 20 nt, Artificial Sequence
  Synthetic
uguggggucccgggggcggg

SEQ ID NO: 48720 - RNA, 21 nt, Artificial Sequence
  Synthetic
auguggggucccgggggcggg

SEQ ID NO: 48721 - RNA, 22 nt, Artificial Sequence
  Synthetic
uauguggggucccgggggcggg

SEQ ID NO: 48722 - RNA, 23 nt, Artificial Sequence
  Synthetic
auauguggggucccgggggcggg

SEQ ID NO: 48723 - RNA, 24 nt, Artificial Sequence
  Synthetic
uauauguggggucccgggggcggg

SEQ ID NO: 48724 - RNA, 18 nt, Artificial Sequence
  Synthetic
uugucgggaucgugcggg

SEQ ID NO: 48725 - RNA, 19 nt, Artificial Sequence
  Synthetic
guugucgggaucgugcggg

SEQ ID NO: 48726 - RNA, 20 nt, Artificial Sequence
  Synthetic
uguugucgggaucgugcggg

SEQ ID NO: 48727 - RNA, 21 nt, Artificial Sequence
  Synthetic
uuguugucgggaucgugcggg

SEQ ID NO: 48728 - RNA, 22 nt, Artificial Sequence
  Synthetic
auuguugucgggaucgugcggg

SEQ ID NO: 48729 - RNA, 23 nt, Artificial Sequence
  Synthetic
uauuguugucgggaucgugcggg

SEQ ID NO: 48730 - RNA, 24 nt, Artificial Sequence
  Synthetic
uuauuguugucgggaucgugcggg

SEQ ID NO: 48731 - RNA, 18 nt, Artificial Sequence
  Synthetic
cugggggugaagaagggg

SEQ ID NO: 48732 - RNA, 19 nt, Artificial Sequence
  Synthetic
acugggggugaagaagggg

SEQ ID NO: 48733 - RNA, 20 nt, Artificial Sequence
  Synthetic
uacugggggugaagaagggg

SEQ ID NO: 48734 - RNA, 21 nt, Artificial Sequence
  Synthetic
guacugggggugaagaagggg

SEQ ID NO: 48735 - RNA, 22 nt, Artificial Sequence
  Synthetic
gguacugggggugaagaagggg

SEQ ID NO: 48736 - RNA, 23 nt, Artificial Sequence
  Synthetic
ggguacugggggugaagaagggg

SEQ ID NO: 48737 - RNA, 24 nt, Artificial Sequence
  Synthetic
aggguacugggggugaagaagggg

SEQ ID NO: 48738 - RNA, 18 nt, Artificial Sequence
  Synthetic
gggucgccggggcagggg

SEQ ID NO: 48739 - RNA, 19 nt, Artificial Sequence
  Synthetic
ggggucgccggggcagggg

SEQ ID NO: 48740 - RNA, 20 nt, Artificial Sequence
  Synthetic
gggggucgccggggcagggg

SEQ ID NO: 48741 - RNA, 21 nt, Artificial Sequence
  Synthetic
cgggggucgccggggcagggg

SEQ ID NO: 48742 - RNA, 22 nt, Artificial Sequence
  Synthetic
ccgggggucgccggggcagggg

SEQ ID NO: 48743 - RNA, 23 nt, Artificial Sequence
  Synthetic
gccgggggucgccggggcagggg

SEQ ID NO: 48744 - RNA, 24 nt, Artificial Sequence
  Synthetic
ggccgggggucgccggggcagggg

SEQ ID NO: 48745 - RNA, 18 nt, Artificial Sequence
  Synthetic
gacuaagggugggagggg

SEQ ID NO: 48746 - RNA, 19 nt, Artificial Sequence
  Synthetic
ugacuaagggugggagggg

SEQ ID NO: 48747 - RNA, 20 nt, Artificial Sequence
  Synthetic
cugacuaagggugggagggg

SEQ ID NO: 48748 - RNA, 21 nt, Artificial Sequence
  Synthetic
ucugacuaagggugggagggg

SEQ ID NO: 48749 - RNA, 22 nt, Artificial Sequence
  Synthetic
gucugacuaagggugggagggg

SEQ ID NO: 48750 - RNA, 23 nt, Artificial Sequence
  Synthetic
agucugacuaagggugggagggg

SEQ ID NO: 48751 - RNA, 24 nt, Artificial Sequence
  Synthetic
gagucugacuaagggugggagggg

SEQ ID NO: 48752 - RNA, 18 nt, Artificial Sequence
  Synthetic
acgagugggauaacgggg

SEQ ID NO: 48753 - RNA, 19 nt, Artificial Sequence
  Synthetic
gacgagugggauaacgggg

SEQ ID NO: 48754 - RNA, 20 nt, Artificial Sequence
  Synthetic
cgacgagugggauaacgggg

SEQ ID NO: 48755 - RNA, 21 nt, Artificial Sequence
  Synthetic
ucgacgagugggauaacgggg

SEQ ID NO: 48756 - RNA, 22 nt, Artificial Sequence
  Synthetic
cucgacgagugggauaacgggg

SEQ ID NO: 48757 - RNA, 23 nt, Artificial Sequence
  Synthetic
ccucgacgagugggauaacgggg

SEQ ID NO: 48758 - RNA, 24 nt, Artificial Sequence
  Synthetic
cccucgacgagugggauaacgggg

SEQ ID NO: 48759 - RNA, 18 nt, Artificial Sequence
  Synthetic
auauguggggucccgggg

SEQ ID NO: 48760 - RNA, 19 nt, Artificial Sequence
  Synthetic
uauauguggggucccgggg

SEQ ID NO: 48761 - RNA, 20 nt, Artificial Sequence
  Synthetic
uuauauguggggucccgggg

SEQ ID NO: 48762 - RNA, 21 nt, Artificial Sequence
  Synthetic
cuuauauguggggucccgggg

SEQ ID NO: 48763 - RNA, 22 nt, Artificial Sequence
  Synthetic
gcuuauauguggggucccgggg

SEQ ID NO: 48764 - RNA, 23 nt, Artificial Sequence
  Synthetic
ggcuuauauguggggucccgggg

SEQ ID NO: 48765 - RNA, 24 nt, Artificial Sequence
  Synthetic
gggcuuauauguggggucccgggg

SEQ ID NO: 48766 - RNA, 18 nt, Artificial Sequence
  Synthetic
ggccgggggucgccgggg

SEQ ID NO: 48767 - RNA, 19 nt, Artificial Sequence
  Synthetic
gggccgggggucgccgggg

SEQ ID NO: 48768 - RNA, 20 nt, Artificial Sequence
  Synthetic
cgggccgggggucgccgggg

SEQ ID NO: 48769 - RNA, 21 nt, Artificial Sequence
  Synthetic
gcgggccgggggucgccgggg

SEQ ID NO: 48770 - RNA, 22 nt, Artificial Sequence
  Synthetic
ugcgggccgggggucgccgggg

SEQ ID NO: 48771 - RNA, 23 nt, Artificial Sequence
  Synthetic
gugcgggccgggggucgccgggg

SEQ ID NO: 48772 - RNA, 24 nt, Artificial Sequence
  Synthetic
cgugcgggccgggggucgccgggg

SEQ ID NO: 48773 - RNA, 18 nt, Artificial Sequence
  Synthetic
acaaaaacacaggcgggg

SEQ ID NO: 48774 - RNA, 19 nt, Artificial Sequence
  Synthetic
cacaaaaacacaggcgggg

SEQ ID NO: 48775 - RNA, 20 nt, Artificial Sequence
  Synthetic
gcacaaaaacacaggcgggg

SEQ ID NO: 48776 - RNA, 21 nt, Artificial Sequence
  Synthetic
ggcacaaaaacacaggcgggg

SEQ ID NO: 48777 - RNA, 22 nt, Artificial Sequence
  Synthetic
aggcacaaaaacacaggcgggg

SEQ ID NO: 48778 - RNA, 23 nt, Artificial Sequence
  Synthetic
caggcacaaaaacacaggcgggg

SEQ ID NO: 48779 - RNA, 24 nt, Artificial Sequence
  Synthetic
ccaggcacaaaaacacaggcgggg

SEQ ID NO: 48780 - RNA, 18 nt, Artificial Sequence
  Synthetic
ugggggugaagaaggggg

SEQ ID NO: 48781 - RNA, 19 nt, Artificial Sequence
  Synthetic
cugggggugaagaaggggg

SEQ ID NO: 48782 - RNA, 20 nt, Artificial Sequence
  Synthetic
acugggggugaagaaggggg

SEQ ID NO: 48783 - RNA, 21 nt, Artificial Sequence
  Synthetic
uacugggggugaagaaggggg

SEQ ID NO: 48784 - RNA, 22 nt, Artificial Sequence
  Synthetic
guacugggggugaagaaggggg

SEQ ID NO: 48785 - RNA, 23 nt, Artificial Sequence
  Synthetic
gguacugggggugaagaaggggg

SEQ ID NO: 48786 - RNA, 24 nt, Artificial Sequence
  Synthetic
ggguacugggggugaagaaggggg

SEQ ID NO: 48787 - RNA, 18 nt, Artificial Sequence
  Synthetic
cgagugggauaacggggg

SEQ ID NO: 48788 - RNA, 19 nt, Artificial Sequence
  Synthetic
acgagugggauaacggggg

SEQ ID NO: 48789 - RNA, 20 nt, Artificial Sequence
  Synthetic
gacgagugggauaacggggg

SEQ ID NO: 48790 - RNA, 21 nt, Artificial Sequence
  Synthetic
cgacgagugggauaacggggg

SEQ ID NO: 48791 - RNA, 22 nt, Artificial Sequence
  Synthetic
ucgacgagugggauaacggggg

SEQ ID NO: 48792 - RNA, 23 nt, Artificial Sequence
  Synthetic
cucgacgagugggauaacggggg

SEQ ID NO: 48793 - RNA, 24 nt, Artificial Sequence
  Synthetic
ccucgacgagugggauaacggggg

SEQ ID NO: 48794 - RNA, 18 nt, Artificial Sequence
  Synthetic
gggggugaagaagggggg

SEQ ID NO: 48795 - RNA, 19 nt, Artificial Sequence
  Synthetic
ugggggugaagaagggggg

SEQ ID NO: 48796 - RNA, 20 nt, Artificial Sequence
  Synthetic
cugggggugaagaagggggg

SEQ ID NO: 48797 - RNA, 21 nt, Artificial Sequence
  Synthetic
acugggggugaagaagggggg

SEQ ID NO: 48798 - RNA, 22 nt, Artificial Sequence
  Synthetic
uacugggggugaagaagggggg

SEQ ID NO: 48799 - RNA, 23 nt, Artificial Sequence
  Synthetic
guacugggggugaagaagggggg

SEQ ID NO: 48800 - RNA, 24 nt, Artificial Sequence
  Synthetic
gguacugggggugaagaagggggg

SEQ ID NO: 48801 - RNA, 18 nt, Artificial Sequence
  Synthetic
ggggugaagaaggggggg

SEQ ID NO: 48802 - RNA, 19 nt, Artificial Sequence
  Synthetic
gggggugaagaaggggggg

SEQ ID NO: 48803 - RNA, 20 nt, Artificial Sequence
  Synthetic
ugggggugaagaaggggggg

SEQ ID NO: 48804 - RNA, 21 nt, Artificial Sequence
  Synthetic
cugggggugaagaaggggggg

SEQ ID NO: 48805 - RNA, 22 nt, Artificial Sequence
  Synthetic
acugggggugaagaaggggggg

SEQ ID NO: 48806 - RNA, 23 nt, Artificial Sequence
  Synthetic
uacugggggugaagaaggggggg

SEQ ID NO: 48807 - RNA, 24 nt, Artificial Sequence
  Synthetic
guacugggggugaagaaggggggg

SEQ ID NO: 48808 - RNA, 18 nt, Artificial Sequence
  Synthetic
ggugaagaaggggggggg

SEQ ID NO: 48809 - RNA, 19 nt, Artificial Sequence
  Synthetic
gggugaagaaggggggggg

SEQ ID NO: 48810 - RNA, 20 nt, Artificial Sequence
  Synthetic
ggggugaagaaggggggggg

SEQ ID NO: 48811 - RNA, 21 nt, Artificial Sequence
  Synthetic
gggggugaagaaggggggggg

SEQ ID NO: 48812 - RNA, 22 nt, Artificial Sequence
  Synthetic
ugggggugaagaaggggggggg

SEQ ID NO: 48813 - RNA, 23 nt, Artificial Sequence
  Synthetic
cugggggugaagaaggggggggg

SEQ ID NO: 48814 - RNA, 24 nt, Artificial Sequence
  Synthetic
acugggggugaagaaggggggggg

SEQ ID NO: 48815 - RNA, 18 nt, Artificial Sequence
  Synthetic
aaggcgaggagacugggg

SEQ ID NO: 48816 - RNA, 19 nt, Artificial Sequence
  Synthetic
gaaggcgaggagacugggg

SEQ ID NO: 48817 - RNA, 20 nt, Artificial Sequence
  Synthetic
agaaggcgaggagacugggg

SEQ ID NO: 48818 - RNA, 21 nt, Artificial Sequence
  Synthetic
gagaaggcgaggagacugggg

SEQ ID NO: 48819 - RNA, 22 nt, Artificial Sequence
  Synthetic
ggagaaggcgaggagacugggg

SEQ ID NO: 48820 - RNA, 23 nt, Artificial Sequence
  Synthetic
gggagaaggcgaggagacugggg

SEQ ID NO: 48821 - RNA, 24 nt, Artificial Sequence
  Synthetic
ugggagaaggcgaggagacugggg

SEQ ID NO: 48822 - RNA, 18 nt, Artificial Sequence
  Synthetic
gggaggaggguacugggg

SEQ ID NO: 48823 - RNA, 19 nt, Artificial Sequence
  Synthetic
agggaggaggguacugggg

SEQ ID NO: 48824 - RNA, 20 nt, Artificial Sequence
  Synthetic
gagggaggaggguacugggg

SEQ ID NO: 48825 - RNA, 21 nt, Artificial Sequence
  Synthetic
ggagggaggaggguacugggg

SEQ ID NO: 48826 - RNA, 22 nt, Artificial Sequence
  Synthetic
gggagggaggaggguacugggg

SEQ ID NO: 48827 - RNA, 23 nt, Artificial Sequence
  Synthetic
agggagggaggaggguacugggg

SEQ ID NO: 48828 - RNA, 24 nt, Artificial Sequence
  Synthetic
aagggagggaggaggguacugggg

SEQ ID NO: 48829 - RNA, 18 nt, Artificial Sequence
  Synthetic
gaaggcgaggagacuggg

SEQ ID NO: 48830 - RNA, 19 nt, Artificial Sequence
  Synthetic
agaaggcgaggagacuggg

SEQ ID NO: 48831 - RNA, 20 nt, Artificial Sequence
  Synthetic
gagaaggcgaggagacuggg

SEQ ID NO: 48832 - RNA, 21 nt, Artificial Sequence
  Synthetic
ggagaaggcgaggagacuggg

SEQ ID NO: 48833 - RNA, 22 nt, Artificial Sequence
  Synthetic
gggagaaggcgaggagacuggg

SEQ ID NO: 48834 - RNA, 23 nt, Artificial Sequence
  Synthetic
ugggagaaggcgaggagacuggg

SEQ ID NO: 48835 - RNA, 24 nt, Artificial Sequence
  Synthetic
gugggagaaggcgaggagacuggg

SEQ ID NO: 48836 - RNA, 18 nt, Artificial Sequence
  Synthetic
caggggcgggggcguggg

SEQ ID NO: 48837 - RNA, 19 nt, Artificial Sequence
  Synthetic
gcaggggcgggggcguggg

SEQ ID NO: 48838 - RNA, 20 nt, Artificial Sequence
  Synthetic
ggcaggggcgggggcguggg

SEQ ID NO: 48839 - RNA, 21 nt, Artificial Sequence
  Synthetic
gggcaggggcgggggcguggg

SEQ ID NO: 48840 - RNA, 22 nt, Artificial Sequence
  Synthetic
ggggcaggggcgggggcguggg

SEQ ID NO: 48841 - RNA, 23 nt, Artificial Sequence
  Synthetic
cggggcaggggcgggggcguggg

SEQ ID NO: 48842 - RNA, 24 nt, Artificial Sequence
  Synthetic
ccggggcaggggcgggggcguggg

SEQ ID NO: 48843 - RNA, 18 nt, Artificial Sequence
  Synthetic
agucugacuaaggguggg

SEQ ID NO: 48844 - RNA, 19 nt, Artificial Sequence
  Synthetic
gagucugacuaaggguggg

SEQ ID NO: 48845 - RNA, 20 nt, Artificial Sequence
  Synthetic
agagucugacuaaggguggg

SEQ ID NO: 48846 - RNA, 21 nt, Artificial Sequence
  Synthetic
cagagucugacuaaggguggg

SEQ ID NO: 48847 - RNA, 22 nt, Artificial Sequence
  Synthetic
acagagucugacuaaggguggg

SEQ ID NO: 48848 - RNA, 23 nt, Artificial Sequence
  Synthetic
aacagagucugacuaaggguggg

SEQ ID NO: 48849 - RNA, 24 nt, Artificial Sequence
  Synthetic
uaacagagucugacuaaggguggg

SEQ ID NO: 48850 - RNA, 18 nt, Artificial Sequence
  Synthetic
gugggggcgugggguggg

SEQ ID NO: 48851 - RNA, 19 nt, Artificial Sequence
  Synthetic
agugggggcgugggguggg

SEQ ID NO: 48852 - RNA, 20 nt, Artificial Sequence
  Synthetic
cagugggggcgugggguggg

SEQ ID NO: 48853 - RNA, 21 nt, Artificial Sequence
  Synthetic
ucagugggggcgugggguggg

SEQ ID NO: 48854 - RNA, 22 nt, Artificial Sequence
  Synthetic
cucagugggggcgugggguggg

SEQ ID NO: 48855 - RNA, 23 nt, Artificial Sequence
  Synthetic
gcucagugggggcgugggguggg

SEQ ID NO: 48856 - RNA, 24 nt, Artificial Sequence
  Synthetic
ggcucagugggggcgugggguggg

SEQ ID NO: 48857 - RNA, 18 nt, Artificial Sequence
  Synthetic
uccccccccucuauuggg

SEQ ID NO: 48858 - RNA, 19 nt, Artificial Sequence
  Synthetic
guccccccccucuauuggg

SEQ ID NO: 48859 - RNA, 20 nt, Artificial Sequence
  Synthetic
gguccccccccucuauuggg

SEQ ID NO: 48860 - RNA, 21 nt, Artificial Sequence
  Synthetic
ggguccccccccucuauuggg

SEQ ID NO: 48861 - RNA, 22 nt, Artificial Sequence
  Synthetic
uggguccccccccucuauuggg

SEQ ID NO: 48862 - RNA, 23 nt, Artificial Sequence
  Synthetic
uuggguccccccccucuauuggg

SEQ ID NO: 48863 - RNA, 24 nt, Artificial Sequence
  Synthetic
uuuggguccccccccucuauuggg

SEQ ID NO: 48864 - RNA, 18 nt, Artificial Sequence
  Synthetic
gcaggggcgggggcgugg

SEQ ID NO: 48865 - RNA, 19 nt, Artificial Sequence
  Synthetic
ggcaggggcgggggcgugg

SEQ ID NO: 48866 - RNA, 20 nt, Artificial Sequence
  Synthetic
gggcaggggcgggggcgugg

SEQ ID NO: 48867 - RNA, 21 nt, Artificial Sequence
  Synthetic
ggggcaggggcgggggcgugg

SEQ ID NO: 48868 - RNA, 22 nt, Artificial Sequence
  Synthetic
cggggcaggggcgggggcgugg

SEQ ID NO: 48869 - RNA, 23 nt, Artificial Sequence
  Synthetic
ccggggcaggggcgggggcgugg

SEQ ID NO: 48870 - RNA, 24 nt, Artificial Sequence
  Synthetic
gccggggcaggggcgggggcgugg

SEQ ID NO: 48871 - RNA, 18 nt, Artificial Sequence
  Synthetic
gugggugggcggcggugg

SEQ ID NO: 48872 - RNA, 19 nt, Artificial Sequence
  Synthetic
ggugggugggcggcggugg

SEQ ID NO: 48873 - RNA, 20 nt, Artificial Sequence
  Synthetic
gggugggugggcggcggugg

SEQ ID NO: 48874 - RNA, 21 nt, Artificial Sequence
  Synthetic
ugggugggugggcggcggugg

SEQ ID NO: 48875 - RNA, 22 nt, Artificial Sequence
  Synthetic
gugggugggugggcggcggugg

SEQ ID NO: 48876 - RNA, 23 nt, Artificial Sequence
  Synthetic
ggugggugggugggcggcggugg

SEQ ID NO: 48877 - RNA, 24 nt, Artificial Sequence
  Synthetic
aggugggugggugggcggcggugg

SEQ ID NO: 48878 - RNA, 18 nt, Artificial Sequence
  Synthetic
gagucugacuaagggugg

SEQ ID NO: 48879 - RNA, 19 nt, Artificial Sequence
  Synthetic
agagucugacuaagggugg

SEQ ID NO: 48880 - RNA, 20 nt, Artificial Sequence
  Synthetic
cagagucugacuaagggugg

SEQ ID NO: 48881 - RNA, 21 nt, Artificial Sequence
  Synthetic
acagagucugacuaagggugg

SEQ ID NO: 48882 - RNA, 22 nt, Artificial Sequence
  Synthetic
aacagagucugacuaagggugg

SEQ ID NO: 48883 - RNA, 23 nt, Artificial Sequence
  Synthetic
uaacagagucugacuaagggugg

SEQ ID NO: 48884 - RNA, 24 nt, Artificial Sequence
  Synthetic
guaacagagucugacuaagggugg

SEQ ID NO: 48885 - RNA, 18 nt, Artificial Sequence
  Synthetic
agugggggcguggggugg

SEQ ID NO: 48886 - RNA, 19 nt, Artificial Sequence
  Synthetic
cagugggggcguggggugg

SEQ ID NO: 48887 - RNA, 20 nt, Artificial Sequence
  Synthetic
ucagugggggcguggggugg

SEQ ID NO: 48888 - RNA, 21 nt, Artificial Sequence
  Synthetic
cucagugggggcguggggugg

SEQ ID NO: 48889 - RNA, 22 nt, Artificial Sequence
  Synthetic
gcucagugggggcguggggugg

SEQ ID NO: 48890 - RNA, 23 nt, Artificial Sequence
  Synthetic
ggcucagugggggcguggggugg

SEQ ID NO: 48891 - RNA, 24 nt, Artificial Sequence
  Synthetic
gggcucagugggggcguggggugg

SEQ ID NO: 48892 - RNA, 18 nt, Artificial Sequence
  Synthetic
guaucccgaggugggugg

SEQ ID NO: 48893 - RNA, 19 nt, Artificial Sequence
  Synthetic
gguaucccgaggugggugg

SEQ ID NO: 48894 - RNA, 20 nt, Artificial Sequence
  Synthetic
ggguaucccgaggugggugg

SEQ ID NO: 48895 - RNA, 21 nt, Artificial Sequence
  Synthetic
uggguaucccgaggugggugg

SEQ ID NO: 48896 - RNA, 22 nt, Artificial Sequence
  Synthetic
cuggguaucccgaggugggugg

SEQ ID NO: 48897 - RNA, 23 nt, Artificial Sequence
  Synthetic
gcuggguaucccgaggugggugg

SEQ ID NO: 48898 - RNA, 24 nt, Artificial Sequence
  Synthetic
ggcuggguaucccgaggugggugg

SEQ ID NO: 48899 - RNA, 18 nt, Artificial Sequence
  Synthetic
ggggcguggggugggugg

SEQ ID NO: 48900 - RNA, 19 nt, Artificial Sequence
  Synthetic
gggggcguggggugggugg

SEQ ID NO: 48901 - RNA, 20 nt, Artificial Sequence
  Synthetic
ugggggcguggggugggugg

SEQ ID NO: 48902 - RNA, 21 nt, Artificial Sequence
  Synthetic
gugggggcguggggugggugg

SEQ ID NO: 48903 - RNA, 22 nt, Artificial Sequence
  Synthetic
agugggggcguggggugggugg

SEQ ID NO: 48904 - RNA, 23 nt, Artificial Sequence
  Synthetic
cagugggggcguggggugggugg

SEQ ID NO: 48905 - RNA, 24 nt, Artificial Sequence
  Synthetic
ucagugggggcguggggugggugg

SEQ ID NO: 48906 - RNA, 18 nt, Artificial Sequence
  Synthetic
uaagggggcaguuggugg

SEQ ID NO: 48907 - RNA, 19 nt, Artificial Sequence
  Synthetic
auaagggggcaguuggugg

SEQ ID NO: 48908 - RNA, 20 nt, Artificial Sequence
  Synthetic
gauaagggggcaguuggugg

SEQ ID NO: 48909 - RNA, 21 nt, Artificial Sequence
  Synthetic
agauaagggggcaguuggugg

SEQ ID NO: 48910 - RNA, 22 nt, Artificial Sequence
  Synthetic
uagauaagggggcaguuggugg

SEQ ID NO: 48911 - RNA, 23 nt, Artificial Sequence
  Synthetic
uuagauaagggggcaguuggugg

SEQ ID NO: 48912 - RNA, 24 nt, Artificial Sequence
  Synthetic
cuuagauaagggggcaguuggugg

SEQ ID NO: 48913 - RNA, 18 nt, Artificial Sequence
  Synthetic
gucuguucuugcgugugg

SEQ ID NO: 48914 - RNA, 19 nt, Artificial Sequence
  Synthetic
ugucuguucuugcgugugg

SEQ ID NO: 48915 - RNA, 20 nt, Artificial Sequence
  Synthetic
gugucuguucuugcgugugg

SEQ ID NO: 48916 - RNA, 21 nt, Artificial Sequence
  Synthetic
cgugucuguucuugcgugugg

SEQ ID NO: 48917 - RNA, 22 nt, Artificial Sequence
  Synthetic
gcgugucuguucuugcgugugg

SEQ ID NO: 48918 - RNA, 23 nt, Artificial Sequence
  Synthetic
ugcgugucuguucuugcgugugg

SEQ ID NO: 48919 - RNA, 24 nt, Artificial Sequence
  Synthetic
cugcgugucuguucuugcgugugg

SEQ ID NO: 48920 - RNA, 18 nt, Artificial Sequence
  Synthetic
aggaggguacugggggug

SEQ ID NO: 48921 - RNA, 19 nt, Artificial Sequence
  Synthetic
gaggaggguacugggggug

SEQ ID NO: 48922 - RNA, 20 nt, Artificial Sequence
  Synthetic
ggaggaggguacugggggug

SEQ ID NO: 48923 - RNA, 21 nt, Artificial Sequence
  Synthetic
gggaggaggguacugggggug

SEQ ID NO: 48924 - RNA, 22 nt, Artificial Sequence
  Synthetic
agggaggaggguacugggggug

SEQ ID NO: 48925 - RNA, 23 nt, Artificial Sequence
  Synthetic
gagggaggaggguacugggggug

SEQ ID NO: 48926 - RNA, 24 nt, Artificial Sequence
  Synthetic
ggagggaggaggguacugggggug

SEQ ID NO: 48927 - RNA, 18 nt, Artificial Sequence
  Synthetic
gguccccccccucuauug

SEQ ID NO: 48928 - RNA, 19 nt, Artificial Sequence
  Synthetic
ggguccccccccucuauug

SEQ ID NO: 48929 - RNA, 20 nt, Artificial Sequence
  Synthetic
uggguccccccccucuauug

SEQ ID NO: 48930 - RNA, 21 nt, Artificial Sequence
  Synthetic
uuggguccccccccucuauug

SEQ ID NO: 48931 - RNA, 22 nt, Artificial Sequence
  Synthetic
uuuggguccccccccucuauug

SEQ ID NO: 48932 - RNA, 23 nt, Artificial Sequence
  Synthetic
guuuggguccccccccucuauug

SEQ ID NO: 48933 - RNA, 24 nt, Artificial Sequence
  Synthetic
cguuuggguccccccccucuauug

SEQ ID NO: 48934 - RNA, 18 nt, Artificial Sequence
  Synthetic
uugggguuguuauuguug

SEQ ID NO: 48935 - RNA, 19 nt, Artificial Sequence
  Synthetic
guugggguuguuauuguug

SEQ ID NO: 48936 - RNA, 20 nt, Artificial Sequence
  Synthetic
cguugggguuguuauuguug

SEQ ID NO: 48937 - RNA, 21 nt, Artificial Sequence
  Synthetic
ccguugggguuguuauuguug

SEQ ID NO: 48938 - RNA, 22 nt, Artificial Sequence
  Synthetic
uccguugggguuguuauuguug

SEQ ID NO: 48939 - RNA, 23 nt, Artificial Sequence
  Synthetic
uuccguugggguuguuauuguug

SEQ ID NO: 48940 - RNA, 24 nt, Artificial Sequence
  Synthetic
uuuccguugggguuguuauuguug

SEQ ID NO: 48941 - RNA, 18 nt, Artificial Sequence
  Synthetic
ggaaacgcggcgucuuug

SEQ ID NO: 48942 - RNA, 19 nt, Artificial Sequence
  Synthetic
uggaaacgcggcgucuuug

SEQ ID NO: 48943 - RNA, 20 nt, Artificial Sequence
  Synthetic
cuggaaacgcggcgucuuug

SEQ ID NO: 48944 - RNA, 21 nt, Artificial Sequence
  Synthetic
ccuggaaacgcggcgucuuug

SEQ ID NO: 48945 - RNA, 22 nt, Artificial Sequence
  Synthetic
accuggaaacgcggcgucuuug

SEQ ID NO: 48946 - RNA, 23 nt, Artificial Sequence
  Synthetic
uaccuggaaacgcggcgucuuug

SEQ ID NO: 48947 - RNA, 24 nt, Artificial Sequence
  Synthetic
cuaccuggaaacgcggcgucuuug

SEQ ID NO: 48948 - RNA, 18 nt, Artificial Sequence
  Synthetic
uccagccggcccuuagau

SEQ ID NO: 48949 - RNA, 19 nt, Artificial Sequence
  Synthetic
uuccagccggcccuuagau

SEQ ID NO: 48950 - RNA, 20 nt, Artificial Sequence
  Synthetic
cuuccagccggcccuuagau

SEQ ID NO: 48951 - RNA, 21 nt, Artificial Sequence
  Synthetic
ucuuccagccggcccuuagau

SEQ ID NO: 48952 - RNA, 22 nt, Artificial Sequence
  Synthetic
gucuuccagccggcccuuagau

SEQ ID NO: 48953 - RNA, 23 nt, Artificial Sequence
  Synthetic
ggucuuccagccggcccuuagau

SEQ ID NO: 48954 - RNA, 24 nt, Artificial Sequence
  Synthetic
cggucuuccagccggcccuuagau

SEQ ID NO: 48955 - RNA, 18 nt, Artificial Sequence
  Synthetic
guggcugggggcuuauau

SEQ ID NO: 48956 - RNA, 19 nt, Artificial Sequence
  Synthetic
uguggcugggggcuuauau

SEQ ID NO: 48957 - RNA, 20 nt, Artificial Sequence
  Synthetic
guguggcugggggcuuauau

SEQ ID NO: 48958 - RNA, 21 nt, Artificial Sequence
  Synthetic
cguguggcugggggcuuauau

SEQ ID NO: 48959 - RNA, 22 nt, Artificial Sequence
  Synthetic
gcguguggcugggggcuuauau

SEQ ID NO: 48960 - RNA, 23 nt, Artificial Sequence
  Synthetic
ugcguguggcugggggcuuauau

SEQ ID NO: 48961 - RNA, 24 nt, Artificial Sequence
  Synthetic
uugcguguggcugggggcuuauau

SEQ ID NO: 48962 - RNA, 18 nt, Artificial Sequence
  Synthetic
uggguccccccccucuau

SEQ ID NO: 48963 - RNA, 19 nt, Artificial Sequence
  Synthetic
uuggguccccccccucuau

SEQ ID NO: 48964 - RNA, 20 nt, Artificial Sequence
  Synthetic
uuuggguccccccccucuau

SEQ ID NO: 48965 - RNA, 21 nt, Artificial Sequence
  Synthetic
guuuggguccccccccucuau

SEQ ID NO: 48966 - RNA, 22 nt, Artificial Sequence
  Synthetic
cguuuggguccccccccucuau

SEQ ID NO: 48967 - RNA, 23 nt, Artificial Sequence
  Synthetic
ucguuuggguccccccccucuau

SEQ ID NO: 48968 - RNA, 24 nt, Artificial Sequence
  Synthetic
gucguuuggguccccccccucuau

SEQ ID NO: 48969 - RNA, 18 nt, Artificial Sequence
  Synthetic
cguggccgaccuuagccu

SEQ ID NO: 48970 - RNA, 19 nt, Artificial Sequence
  Synthetic
gcguggccgaccuuagccu

SEQ ID NO: 48971 - RNA, 20 nt, Artificial Sequence
  Synthetic
ggcguggccgaccuuagccu

SEQ ID NO: 48972 - RNA, 21 nt, Artificial Sequence
  Synthetic
uggcguggccgaccuuagccu

SEQ ID NO: 48973 - RNA, 22 nt, Artificial Sequence
  Synthetic
guggcguggccgaccuuagccu

SEQ ID NO: 48974 - RNA, 23 nt, Artificial Sequence
  Synthetic
aguggcguggccgaccuuagccu

SEQ ID NO: 48975 - RNA, 24 nt, Artificial Sequence
  Synthetic
gaguggcguggccgaccuuagccu

SEQ ID NO: 48976 - RNA, 18 nt, Artificial Sequence
  Synthetic
cuguucuugcguguggcu

SEQ ID NO: 48977 - RNA, 19 nt, Artificial Sequence
  Synthetic
ucuguucuugcguguggcu

SEQ ID NO: 48978 - RNA, 20 nt, Artificial Sequence
  Synthetic
gucuguucuugcguguggcu

SEQ ID NO: 48979 - RNA, 21 nt, Artificial Sequence
  Synthetic
ugucuguucuugcguguggcu

SEQ ID NO: 48980 - RNA, 22 nt, Artificial Sequence
  Synthetic
gugucuguucuugcguguggcu

SEQ ID NO: 48981 - RNA, 23 nt, Artificial Sequence
  Synthetic
cgugucuguucuugcguguggcu

SEQ ID NO: 48982 - RNA, 24 nt, Artificial Sequence
  Synthetic
gcgugucuguucuugcguguggcu

SEQ ID NO: 48983 - RNA, 18 nt, Artificial Sequence
  Synthetic
cgaucgaccgggcucagu

SEQ ID NO: 48984 - RNA, 19 nt, Artificial Sequence
  Synthetic
ucgaucgaccgggcucagu

SEQ ID NO: 48985 - RNA, 20 nt, Artificial Sequence
  Synthetic
gucgaucgaccgggcucagu

SEQ ID NO: 48986 - RNA, 21 nt, Artificial Sequence
  Synthetic
cgucgaucgaccgggcucagu

SEQ ID NO: 48987 - RNA, 22 nt, Artificial Sequence
  Synthetic
ucgucgaucgaccgggcucagu

SEQ ID NO: 48988 - RNA, 23 nt, Artificial Sequence
  Synthetic
cucgucgaucgaccgggcucagu

SEQ ID NO: 48989 - RNA, 24 nt, Artificial Sequence
  Synthetic
gcucgucgaucgaccgggcucagu

SEQ ID NO: 48990 - RNA, 18 nt, Artificial Sequence
  Synthetic
uacgugggucauuggcgu

SEQ ID NO: 48991 - RNA, 19 nt, Artificial Sequence
  Synthetic
guacgugggucauuggcgu

SEQ ID NO: 48992 - RNA, 20 nt, Artificial Sequence
  Synthetic
aguacgugggucauuggcgu

SEQ ID NO: 48993 - RNA, 21 nt, Artificial Sequence
  Synthetic
gaguacgugggucauuggcgu

SEQ ID NO: 48994 - RNA, 22 nt, Artificial Sequence
  Synthetic
ggaguacgugggucauuggcgu

SEQ ID NO: 48995 - RNA, 23 nt, Artificial Sequence
  Synthetic
uggaguacgugggucauuggcgu

SEQ ID NO: 48996 - RNA, 24 nt, Artificial Sequence
  Synthetic
uuggaguacgugggucauuggcgu

SEQ ID NO: 48997 - RNA, 18 nt, Artificial Sequence
  Synthetic
uauuguugucgggaucgu

SEQ ID NO: 48998 - RNA, 19 nt, Artificial Sequence
  Synthetic
uuauuguugucgggaucgu

SEQ ID NO: 48999 - RNA, 20 nt, Artificial Sequence
  Synthetic
guuauuguugucgggaucgu

SEQ ID NO: 49000 - RNA, 21 nt, Artificial Sequence
  Synthetic
uguuauuguugucgggaucgu

SEQ ID NO: 49001 - RNA, 22 nt, Artificial Sequence
  Synthetic
uuguuauuguugucgggaucgu

SEQ ID NO: 49002 - RNA, 23 nt, Artificial Sequence
  Synthetic
guuguuauuguugucgggaucgu

SEQ ID NO: 49003 - RNA, 24 nt, Artificial Sequence
  Synthetic
gguuguuauuguugucgggaucgu

SEQ ID NO: 49004 - RNA, 18 nt, Artificial Sequence
  Synthetic
cagagucugacuaagggu

SEQ ID NO: 49005 - RNA, 19 nt, Artificial Sequence
  Synthetic
acagagucugacuaagggu

SEQ ID NO: 49006 - RNA, 20 nt, Artificial Sequence
  Synthetic
aacagagucugacuaagggu

SEQ ID NO: 49007 - RNA, 21 nt, Artificial Sequence
  Synthetic
uaacagagucugacuaagggu

SEQ ID NO: 49008 - RNA, 22 nt, Artificial Sequence
  Synthetic
guaacagagucugacuaagggu

SEQ ID NO: 49009 - RNA, 23 nt, Artificial Sequence
  Synthetic
aguaacagagucugacuaagggu

SEQ ID NO: 49010 - RNA, 24 nt, Artificial Sequence
  Synthetic
aaguaacagagucugacuaagggu

SEQ ID NO: 49011 - RNA, 18 nt, Artificial Sequence
  Synthetic
ugggggcguggggugggu

SEQ ID NO: 49012 - RNA, 19 nt, Artificial Sequence
  Synthetic
gugggggcguggggugggu

SEQ ID NO: 49013 - RNA, 20 nt, Artificial Sequence
  Synthetic
agugggggcguggggugggu

SEQ ID NO: 49014 - RNA, 21 nt, Artificial Sequence
  Synthetic
cagugggggcguggggugggu

SEQ ID NO: 49015 - RNA, 22 nt, Artificial Sequence
  Synthetic
ucagugggggcguggggugggu

SEQ ID NO: 49016 - RNA, 23 nt, Artificial Sequence
  Synthetic
cucagugggggcguggggugggu

SEQ ID NO: 49017 - RNA, 24 nt, Artificial Sequence
  Synthetic
gcucagugggggcguggggugggu

SEQ ID NO: 49018 - RNA, 18 nt, Artificial Sequence
  Synthetic
ggguccccccccucuauu

SEQ ID NO: 49019 - RNA, 19 nt, Artificial Sequence
  Synthetic
uggguccccccccucuauu

SEQ ID NO: 49020 - RNA, 20 nt, Artificial Sequence
  Synthetic
uuggguccccccccucuauu

SEQ ID NO: 49021 - RNA, 21 nt, Artificial Sequence
  Synthetic
uuuggguccccccccucuauu

SEQ ID NO: 49022 - RNA, 22 nt, Artificial Sequence
  Synthetic
guuuggguccccccccucuauu

SEQ ID NO: 49023 - RNA, 23 nt, Artificial Sequence
  Synthetic
cguuuggguccccccccucuauu

SEQ ID NO: 49024 - RNA, 24 nt, Artificial Sequence
  Synthetic
ucguuuggguccccccccucuauu

SEQ ID NO: 49025 - RNA, 18 nt, Artificial Sequence
  Synthetic
caacaauaacaaccccaa

SEQ ID NO: 49026 - RNA, 19 nt, Artificial Sequence
  Synthetic
acaacaauaacaaccccaa

SEQ ID NO: 49027 - RNA, 20 nt, Artificial Sequence
  Synthetic
gacaacaauaacaaccccaa

SEQ ID NO: 49028 - RNA, 21 nt, Artificial Sequence
  Synthetic
cgacaacaauaacaaccccaa

SEQ ID NO: 49029 - RNA, 22 nt, Artificial Sequence
  Synthetic
ccgacaacaauaacaaccccaa

SEQ ID NO: 49030 - RNA, 23 nt, Artificial Sequence
  Synthetic
cccgacaacaauaacaaccccaa

SEQ ID NO: 49031 - RNA, 24 nt, Artificial Sequence
  Synthetic
ucccgacaacaauaacaaccccaa

SEQ ID NO: 49032 - RNA, 18 nt, Artificial Sequence
  Synthetic
acaccugcuucuccccaa

SEQ ID NO: 49033 - RNA, 19 nt, Artificial Sequence
  Synthetic
gacaccugcuucuccccaa

SEQ ID NO: 49034 - RNA, 20 nt, Artificial Sequence
  Synthetic
agacaccugcuucuccccaa

SEQ ID NO: 49035 - RNA, 21 nt, Artificial Sequence
  Synthetic
uagacaccugcuucuccccaa

SEQ ID NO: 49036 - RNA, 22 nt, Artificial Sequence
  Synthetic
uuagacaccugcuucuccccaa

SEQ ID NO: 49037 - RNA, 23 nt, Artificial Sequence
  Synthetic
guuagacaccugcuucuccccaa

SEQ ID NO: 49038 - RNA, 24 nt, Artificial Sequence
  Synthetic
gguuagacaccugcuucuccccaa

SEQ ID NO: 49039 - RNA, 18 nt, Artificial Sequence
  Synthetic
ggggggacccaaacgaca

SEQ ID NO: 49040 - RNA, 19 nt, Artificial Sequence
  Synthetic
gggggggacccaaacgaca

SEQ ID NO: 49041 - RNA, 20 nt, Artificial Sequence
  Synthetic
ggggggggacccaaacgaca

SEQ ID NO: 49042 - RNA, 21 nt, Artificial Sequence
  Synthetic
aggggggggacccaaacgaca

SEQ ID NO: 49043 - RNA, 22 nt, Artificial Sequence
  Synthetic
gaggggggggacccaaacgaca

SEQ ID NO: 49044 - RNA, 23 nt, Artificial Sequence
  Synthetic
agaggggggggacccaaacgaca

SEQ ID NO: 49045 - RNA, 24 nt, Artificial Sequence
  Synthetic
uagaggggggggacccaaacgaca

SEQ ID NO: 49046 - RNA, 18 nt, Artificial Sequence
  Synthetic
acaacaauaacaacccca

SEQ ID NO: 49047 - RNA, 19 nt, Artificial Sequence
  Synthetic
gacaacaauaacaacccca

SEQ ID NO: 49048 - RNA, 20 nt, Artificial Sequence
  Synthetic
cgacaacaauaacaacccca

SEQ ID NO: 49049 - RNA, 21 nt, Artificial Sequence
  Synthetic
ccgacaacaauaacaacccca

SEQ ID NO: 49050 - RNA, 22 nt, Artificial Sequence
  Synthetic
cccgacaacaauaacaacccca

SEQ ID NO: 49051 - RNA, 23 nt, Artificial Sequence
  Synthetic
ucccgacaacaauaacaacccca

SEQ ID NO: 49052 - RNA, 24 nt, Artificial Sequence
  Synthetic
aucccgacaacaauaacaacccca

SEQ ID NO: 49053 - RNA, 18 nt, Artificial Sequence
  Synthetic
acccaccccacgccccca

SEQ ID NO: 49054 - RNA, 19 nt, Artificial Sequence
  Synthetic
cacccaccccacgccccca

SEQ ID NO: 49055 - RNA, 20 nt, Artificial Sequence
  Synthetic
ccacccaccccacgccccca

SEQ ID NO: 49056 - RNA, 21 nt, Artificial Sequence
  Synthetic
cccacccaccccacgccccca

SEQ ID NO: 49057 - RNA, 22 nt, Artificial Sequence
  Synthetic
ucccacccaccccacgccccca

SEQ ID NO: 49058 - RNA, 23 nt, Artificial Sequence
  Synthetic
cucccacccaccccacgccccca

SEQ ID NO: 49059 - RNA, 24 nt, Artificial Sequence
  Synthetic
ucucccacccaccccacgccccca

SEQ ID NO: 49060 - RNA, 18 nt, Artificial Sequence
  Synthetic
cugcuucuccccaauaga

SEQ ID NO: 49061 - RNA, 19 nt, Artificial Sequence
  Synthetic
ccugcuucuccccaauaga

SEQ ID NO: 49062 - RNA, 20 nt, Artificial Sequence
  Synthetic
accugcuucuccccaauaga

SEQ ID NO: 49063 - RNA, 21 nt, Artificial Sequence
  Synthetic
caccugcuucuccccaauaga

SEQ ID NO: 49064 - RNA, 22 nt, Artificial Sequence
  Synthetic
acaccugcuucuccccaauaga

SEQ ID NO: 49065 - RNA, 23 nt, Artificial Sequence
  Synthetic
gacaccugcuucuccccaauaga

SEQ ID NO: 49066 - RNA, 24 nt, Artificial Sequence
  Synthetic
agacaccugcuucuccccaauaga

SEQ ID NO: 49067 - RNA, 18 nt, Artificial Sequence
  Synthetic
ggggggggacccaaacga

SEQ ID NO: 49068 - RNA, 19 nt, Artificial Sequence
  Synthetic
aggggggggacccaaacga

SEQ ID NO: 49069 - RNA, 20 nt, Artificial Sequence
  Synthetic
gaggggggggacccaaacga

SEQ ID NO: 49070 - RNA, 21 nt, Artificial Sequence
  Synthetic
agaggggggggacccaaacga

SEQ ID NO: 49071 - RNA, 22 nt, Artificial Sequence
  Synthetic
uagaggggggggacccaaacga

SEQ ID NO: 49072 - RNA, 23 nt, Artificial Sequence
  Synthetic
auagaggggggggacccaaacga

SEQ ID NO: 49073 - RNA, 24 nt, Artificial Sequence
  Synthetic
aauagaggggggggacccaaacga

SEQ ID NO: 49074 - RNA, 18 nt, Artificial Sequence
  Synthetic
aaacacaaacacccgcga

SEQ ID NO: 49075 - RNA, 19 nt, Artificial Sequence
  Synthetic
caaacacaaacacccgcga

SEQ ID NO: 49076 - RNA, 20 nt, Artificial Sequence
  Synthetic
acaaacacaaacacccgcga

SEQ ID NO: 49077 - RNA, 21 nt, Artificial Sequence
  Synthetic
aacaaacacaaacacccgcga

SEQ ID NO: 49078 - RNA, 22 nt, Artificial Sequence
  Synthetic
aaacaaacacaaacacccgcga

SEQ ID NO: 49079 - RNA, 23 nt, Artificial Sequence
  Synthetic
uaaacaaacacaaacacccgcga

SEQ ID NO: 49080 - RNA, 24 nt, Artificial Sequence
  Synthetic
auaaacaaacacaaacacccgcga

SEQ ID NO: 49081 - RNA, 18 nt, Artificial Sequence
  Synthetic
ggggacggaggggacgga

SEQ ID NO: 49082 - RNA, 19 nt, Artificial Sequence
  Synthetic
gggggacggaggggacgga

SEQ ID NO: 49083 - RNA, 20 nt, Artificial Sequence
  Synthetic
ggggggacggaggggacgga

SEQ ID NO: 49084 - RNA, 21 nt, Artificial Sequence
  Synthetic
cggggggacggaggggacgga

SEQ ID NO: 49085 - RNA, 22 nt, Artificial Sequence
  Synthetic
acggggggacggaggggacgga

SEQ ID NO: 49086 - RNA, 23 nt, Artificial Sequence
  Synthetic
gacggggggacggaggggacgga

SEQ ID NO: 49087 - RNA, 24 nt, Artificial Sequence
  Synthetic
cgacggggggacggaggggacgga

SEQ ID NO: 49088 - RNA, 18 nt, Artificial Sequence
  Synthetic
ccgcgacggggggacgga

SEQ ID NO: 49089 - RNA, 19 nt, Artificial Sequence
  Synthetic
cccgcgacggggggacgga

SEQ ID NO: 49090 - RNA, 20 nt, Artificial Sequence
  Synthetic
acccgcgacggggggacgga

SEQ ID NO: 49091 - RNA, 21 nt, Artificial Sequence
  Synthetic
cacccgcgacggggggacgga

SEQ ID NO: 49092 - RNA, 22 nt, Artificial Sequence
  Synthetic
acacccgcgacggggggacgga

SEQ ID NO: 49093 - RNA, 23 nt, Artificial Sequence
  Synthetic
aacacccgcgacggggggacgga

SEQ ID NO: 49094 - RNA, 24 nt, Artificial Sequence
  Synthetic
aaacacccgcgacggggggacgga

SEQ ID NO: 49095 - RNA, 18 nt, Artificial Sequence
  Synthetic
acggggggacggagggga

SEQ ID NO: 49096 - RNA, 19 nt, Artificial Sequence
  Synthetic
gacggggggacggagggga

SEQ ID NO: 49097 - RNA, 20 nt, Artificial Sequence
  Synthetic
cgacggggggacggagggga

SEQ ID NO: 49098 - RNA, 21 nt, Artificial Sequence
  Synthetic
gcgacggggggacggagggga

SEQ ID NO: 49099 - RNA, 22 nt, Artificial Sequence
  Synthetic
cgcgacggggggacggagggga

SEQ ID NO: 49100 - RNA, 23 nt, Artificial Sequence
  Synthetic
ccgcgacggggggacggagggga

SEQ ID NO: 49101 - RNA, 24 nt, Artificial Sequence
  Synthetic
cccgcgacggggggacggagggga

SEQ ID NO: 49102 - RNA, 18 nt, Artificial Sequence
  Synthetic
ggagggggugacggggga

SEQ ID NO: 49103 - RNA, 19 nt, Artificial Sequence
  Synthetic
gggagggggugacggggga

SEQ ID NO: 49104 - RNA, 20 nt, Artificial Sequence
  Synthetic
agggagggggugacggggga

SEQ ID NO: 49105 - RNA, 21 nt, Artificial Sequence
  Synthetic
gagggagggggugacggggga

SEQ ID NO: 49106 - RNA, 22 nt, Artificial Sequence
  Synthetic
ggagggagggggugacggggga

SEQ ID NO: 49107 - RNA, 23 nt, Artificial Sequence
  Synthetic
cggagggagggggugacggggga

SEQ ID NO: 49108 - RNA, 24 nt, Artificial Sequence
  Synthetic
acggagggagggggugacggggga

SEQ ID NO: 49109 - RNA, 18 nt, Artificial Sequence
  Synthetic
acacccgcgacgggggga

SEQ ID NO: 49110 - RNA, 19 nt, Artificial Sequence
  Synthetic
aacacccgcgacgggggga

SEQ ID NO: 49111 - RNA, 20 nt, Artificial Sequence
  Synthetic
aaacacccgcgacgggggga

SEQ ID NO: 49112 - RNA, 21 nt, Artificial Sequence
  Synthetic
caaacacccgcgacgggggga

SEQ ID NO: 49113 - RNA, 22 nt, Artificial Sequence
  Synthetic
acaaacacccgcgacgggggga

SEQ ID NO: 49114 - RNA, 23 nt, Artificial Sequence
  Synthetic
cacaaacacccgcgacgggggga

SEQ ID NO: 49115 - RNA, 24 nt, Artificial Sequence
  Synthetic
acacaaacacccgcgacgggggga

SEQ ID NO: 49116 - RNA, 18 nt, Artificial Sequence
  Synthetic
gacggagggaggggguga

SEQ ID NO: 49117 - RNA, 19 nt, Artificial Sequence
  Synthetic
ggacggagggaggggguga

SEQ ID NO: 49118 - RNA, 20 nt, Artificial Sequence
  Synthetic
gggacggagggaggggguga

SEQ ID NO: 49119 - RNA, 21 nt, Artificial Sequence
  Synthetic
ggggacggagggaggggguga

SEQ ID NO: 49120 - RNA, 22 nt, Artificial Sequence
  Synthetic
aggggacggagggaggggguga

SEQ ID NO: 49121 - RNA, 23 nt, Artificial Sequence
  Synthetic
gaggggacggagggaggggguga

SEQ ID NO: 49122 - RNA, 24 nt, Artificial Sequence
  Synthetic
ggaggggacggagggaggggguga

SEQ ID NO: 49123 - RNA, 18 nt, Artificial Sequence
  Synthetic
accugcuucuccccaaua

SEQ ID NO: 49124 - RNA, 19 nt, Artificial Sequence
  Synthetic
caccugcuucuccccaaua

SEQ ID NO: 49125 - RNA, 20 nt, Artificial Sequence
  Synthetic
acaccugcuucuccccaaua

SEQ ID NO: 49126 - RNA, 21 nt, Artificial Sequence
  Synthetic
gacaccugcuucuccccaaua

SEQ ID NO: 49127 - RNA, 22 nt, Artificial Sequence
  Synthetic
agacaccugcuucuccccaaua

SEQ ID NO: 49128 - RNA, 23 nt, Artificial Sequence
  Synthetic
uagacaccugcuucuccccaaua

SEQ ID NO: 49129 - RNA, 24 nt, Artificial Sequence
  Synthetic
uuagacaccugcuucuccccaaua

SEQ ID NO: 49130 - RNA, 18 nt, Artificial Sequence
  Synthetic
gggggggacccaaacgac

SEQ ID NO: 49131 - RNA, 19 nt, Artificial Sequence
  Synthetic
ggggggggacccaaacgac

SEQ ID NO: 49132 - RNA, 20 nt, Artificial Sequence
  Synthetic
aggggggggacccaaacgac

SEQ ID NO: 49133 - RNA, 21 nt, Artificial Sequence
  Synthetic
gaggggggggacccaaacgac

SEQ ID NO: 49134 - RNA, 22 nt, Artificial Sequence
  Synthetic
agaggggggggacccaaacgac

SEQ ID NO: 49135 - RNA, 23 nt, Artificial Sequence
  Synthetic
uagaggggggggacccaaacgac

SEQ ID NO: 49136 - RNA, 24 nt, Artificial Sequence
  Synthetic
auagaggggggggacccaaacgac

SEQ ID NO: 49137 - RNA, 18 nt, Artificial Sequence
  Synthetic
aacacaaacacccgcgac

SEQ ID NO: 49138 - RNA, 19 nt, Artificial Sequence
  Synthetic
aaacacaaacacccgcgac

SEQ ID NO: 49139 - RNA, 20 nt, Artificial Sequence
  Synthetic
caaacacaaacacccgcgac

SEQ ID NO: 49140 - RNA, 21 nt, Artificial Sequence
  Synthetic
acaaacacaaacacccgcgac

SEQ ID NO: 49141 - RNA, 22 nt, Artificial Sequence
  Synthetic
aacaaacacaaacacccgcgac

SEQ ID NO: 49142 - RNA, 23 nt, Artificial Sequence
  Synthetic
aaacaaacacaaacacccgcgac

SEQ ID NO: 49143 - RNA, 24 nt, Artificial Sequence
  Synthetic
uaaacaaacacaaacacccgcgac

SEQ ID NO: 49144 - RNA, 18 nt, Artificial Sequence
  Synthetic
gagggggugacgggggac

SEQ ID NO: 49145 - RNA, 19 nt, Artificial Sequence
  Synthetic
ggagggggugacgggggac

SEQ ID NO: 49146 - RNA, 20 nt, Artificial Sequence
  Synthetic
gggagggggugacgggggac

SEQ ID NO: 49147 - RNA, 21 nt, Artificial Sequence
  Synthetic
agggagggggugacgggggac

SEQ ID NO: 49148 - RNA, 22 nt, Artificial Sequence
  Synthetic
gagggagggggugacgggggac

SEQ ID NO: 49149 - RNA, 23 nt, Artificial Sequence
  Synthetic
ggagggagggggugacgggggac

SEQ ID NO: 49150 - RNA, 24 nt, Artificial Sequence
  Synthetic
cggagggagggggugacgggggac

SEQ ID NO: 49151 - RNA, 18 nt, Artificial Sequence
  Synthetic
acggagggagggggugac

SEQ ID NO: 49152 - RNA, 19 nt, Artificial Sequence
  Synthetic
gacggagggagggggugac

SEQ ID NO: 49153 - RNA, 20 nt, Artificial Sequence
  Synthetic
ggacggagggagggggugac

SEQ ID NO: 49154 - RNA, 21 nt, Artificial Sequence
  Synthetic
gggacggagggagggggugac

SEQ ID NO: 49155 - RNA, 22 nt, Artificial Sequence
  Synthetic
ggggacggagggagggggugac

SEQ ID NO: 49156 - RNA, 23 nt, Artificial Sequence
  Synthetic
aggggacggagggagggggugac

SEQ ID NO: 49157 - RNA, 24 nt, Artificial Sequence
  Synthetic
gaggggacggagggagggggugac

SEQ ID NO: 49158 - RNA, 18 nt, Artificial Sequence
  Synthetic
gccgcccacccacccacc

SEQ ID NO: 49159 - RNA, 19 nt, Artificial Sequence
  Synthetic
cgccgcccacccacccacc

SEQ ID NO: 49160 - RNA, 20 nt, Artificial Sequence
  Synthetic
ccgccgcccacccacccacc

SEQ ID NO: 49161 - RNA, 21 nt, Artificial Sequence
  Synthetic
accgccgcccacccacccacc

SEQ ID NO: 49162 - RNA, 22 nt, Artificial Sequence
  Synthetic
caccgccgcccacccacccacc

SEQ ID NO: 49163 - RNA, 23 nt, Artificial Sequence
  Synthetic
ccaccgccgcccacccacccacc

SEQ ID NO: 49164 - RNA, 24 nt, Artificial Sequence
  Synthetic
gccaccgccgcccacccacccacc

SEQ ID NO: 49165 - RNA, 18 nt, Artificial Sequence
  Synthetic
uaaaccccaucccgcccc

SEQ ID NO: 49166 - RNA, 19 nt, Artificial Sequence
  Synthetic
cuaaaccccaucccgcccc

SEQ ID NO: 49167 - RNA, 20 nt, Artificial Sequence
  Synthetic
gcuaaaccccaucccgcccc

SEQ ID NO: 49168 - RNA, 21 nt, Artificial Sequence
  Synthetic
cgcuaaaccccaucccgcccc

SEQ ID NO: 49169 - RNA, 22 nt, Artificial Sequence
  Synthetic
ccgcuaaaccccaucccgcccc

SEQ ID NO: 49170 - RNA, 23 nt, Artificial Sequence
  Synthetic
gccgcuaaaccccaucccgcccc

SEQ ID NO: 49171 - RNA, 24 nt, Artificial Sequence
  Synthetic
cgccgcuaaaccccaucccgcccc

SEQ ID NO: 49172 - RNA, 18 nt, Artificial Sequence
  Synthetic
cccggucccccguucccc

SEQ ID NO: 49173 - RNA, 19 nt, Artificial Sequence
  Synthetic
ccccggucccccguucccc

SEQ ID NO: 49174 - RNA, 20 nt, Artificial Sequence
  Synthetic
gccccggucccccguucccc

SEQ ID NO: 49175 - RNA, 21 nt, Artificial Sequence
  Synthetic
agccccggucccccguucccc

SEQ ID NO: 49176 - RNA, 22 nt, Artificial Sequence
  Synthetic
cagccccggucccccguucccc

SEQ ID NO: 49177 - RNA, 23 nt, Artificial Sequence
  Synthetic
ccagccccggucccccguucccc

SEQ ID NO: 49178 - RNA, 24 nt, Artificial Sequence
  Synthetic
cccagccccggucccccguucccc

SEQ ID NO: 49179 - RNA, 18 nt, Artificial Sequence
  Synthetic
cuaaaccccaucccgccc

SEQ ID NO: 49180 - RNA, 19 nt, Artificial Sequence
  Synthetic
gcuaaaccccaucccgccc

SEQ ID NO: 49181 - RNA, 20 nt, Artificial Sequence
  Synthetic
cgcuaaaccccaucccgccc

SEQ ID NO: 49182 - RNA, 21 nt, Artificial Sequence
  Synthetic
ccgcuaaaccccaucccgccc

SEQ ID NO: 49183 - RNA, 22 nt, Artificial Sequence
  Synthetic
gccgcuaaaccccaucccgccc

SEQ ID NO: 49184 - RNA, 23 nt, Artificial Sequence
  Synthetic
cgccgcuaaaccccaucccgccc

SEQ ID NO: 49185 - RNA, 24 nt, Artificial Sequence
  Synthetic
ccgccgcuaaaccccaucccgccc

SEQ ID NO: 49186 - RNA, 18 nt, Artificial Sequence
  Synthetic
aaacgacagggggcgccc

SEQ ID NO: 49187 - RNA, 19 nt, Artificial Sequence
  Synthetic
caaacgacagggggcgccc

SEQ ID NO: 49188 - RNA, 20 nt, Artificial Sequence
  Synthetic
ccaaacgacagggggcgccc

SEQ ID NO: 49189 - RNA, 21 nt, Artificial Sequence
  Synthetic
cccaaacgacagggggcgccc

SEQ ID NO: 49190 - RNA, 22 nt, Artificial Sequence
  Synthetic
acccaaacgacagggggcgccc

SEQ ID NO: 49191 - RNA, 23 nt, Artificial Sequence
  Synthetic
gacccaaacgacagggggcgccc

SEQ ID NO: 49192 - RNA, 24 nt, Artificial Sequence
  Synthetic
ggacccaaacgacagggggcgccc

SEQ ID NO: 49193 - RNA, 18 nt, Artificial Sequence
  Synthetic
ccccggucccccguuccc

SEQ ID NO: 49194 - RNA, 19 nt, Artificial Sequence
  Synthetic
gccccggucccccguuccc

SEQ ID NO: 49195 - RNA, 20 nt, Artificial Sequence
  Synthetic
agccccggucccccguuccc

SEQ ID NO: 49196 - RNA, 21 nt, Artificial Sequence
  Synthetic
cagccccggucccccguuccc

SEQ ID NO: 49197 - RNA, 22 nt, Artificial Sequence
  Synthetic
ccagccccggucccccguuccc

SEQ ID NO: 49198 - RNA, 23 nt, Artificial Sequence
  Synthetic
cccagccccggucccccguuccc

SEQ ID NO: 49199 - RNA, 24 nt, Artificial Sequence
  Synthetic
acccagccccggucccccguuccc

SEQ ID NO: 49200 - RNA, 18 nt, Artificial Sequence
  Synthetic
gccggcuggaagaccgcc

SEQ ID NO: 49201 - RNA, 19 nt, Artificial Sequence
  Synthetic
ggccggcuggaagaccgcc

SEQ ID NO: 49202 - RNA, 20 nt, Artificial Sequence
  Synthetic
gggccggcuggaagaccgcc

SEQ ID NO: 49203 - RNA, 21 nt, Artificial Sequence
  Synthetic
agggccggcuggaagaccgcc

SEQ ID NO: 49204 - RNA, 22 nt, Artificial Sequence
  Synthetic
aagggccggcuggaagaccgcc

SEQ ID NO: 49205 - RNA, 23 nt, Artificial Sequence
  Synthetic
uaagggccggcuggaagaccgcc

SEQ ID NO: 49206 - RNA, 24 nt, Artificial Sequence
  Synthetic
cuaagggccggcuggaagaccgcc

SEQ ID NO: 49207 - RNA, 18 nt, Artificial Sequence
  Synthetic
caaugacccacguacucc

SEQ ID NO: 49208 - RNA, 19 nt, Artificial Sequence
  Synthetic
ccaaugacccacguacucc

SEQ ID NO: 49209 - RNA, 20 nt, Artificial Sequence
  Synthetic
gccaaugacccacguacucc

SEQ ID NO: 49210 - RNA, 21 nt, Artificial Sequence
  Synthetic
cgccaaugacccacguacucc

SEQ ID NO: 49211 - RNA, 22 nt, Artificial Sequence
  Synthetic
acgccaaugacccacguacucc

SEQ ID NO: 49212 - RNA, 23 nt, Artificial Sequence
  Synthetic
cacgccaaugacccacguacucc

SEQ ID NO: 49213 - RNA, 24 nt, Artificial Sequence
  Synthetic
ccacgccaaugacccacguacucc

SEQ ID NO: 49214 - RNA, 18 nt, Artificial Sequence
  Synthetic
gccccggucccccguucc

SEQ ID NO: 49215 - RNA, 19 nt, Artificial Sequence
  Synthetic
agccccggucccccguucc

SEQ ID NO: 49216 - RNA, 20 nt, Artificial Sequence
  Synthetic
cagccccggucccccguucc

SEQ ID NO: 49217 - RNA, 21 nt, Artificial Sequence
  Synthetic
ccagccccggucccccguucc

SEQ ID NO: 49218 - RNA, 22 nt, Artificial Sequence
  Synthetic
cccagccccggucccccguucc

SEQ ID NO: 49219 - RNA, 23 nt, Artificial Sequence
  Synthetic
acccagccccggucccccguucc

SEQ ID NO: 49220 - RNA, 24 nt, Artificial Sequence
  Synthetic
uacccagccccggucccccguucc

SEQ ID NO: 49221 - RNA, 18 nt, Artificial Sequence
  Synthetic
aagcccccagccacacgc

SEQ ID NO: 49222 - RNA, 19 nt, Artificial Sequence
  Synthetic
uaagcccccagccacacgc

SEQ ID NO: 49223 - RNA, 20 nt, Artificial Sequence
  Synthetic
auaagcccccagccacacgc

SEQ ID NO: 49224 - RNA, 21 nt, Artificial Sequence
  Synthetic
uauaagcccccagccacacgc

SEQ ID NO: 49225 - RNA, 22 nt, Artificial Sequence
  Synthetic
auauaagcccccagccacacgc

SEQ ID NO: 49226 - RNA, 23 nt, Artificial Sequence
  Synthetic
cauauaagcccccagccacacgc

SEQ ID NO: 49227 - RNA, 24 nt, Artificial Sequence
  Synthetic
acauauaagcccccagccacacgc

SEQ ID NO: 49228 - RNA, 18 nt, Artificial Sequence
  Synthetic
ggccggcuggaagaccgc

SEQ ID NO: 49229 - RNA, 19 nt, Artificial Sequence
  Synthetic
gggccggcuggaagaccgc

SEQ ID NO: 49230 - RNA, 20 nt, Artificial Sequence
  Synthetic
agggccggcuggaagaccgc

SEQ ID NO: 49231 - RNA, 21 nt, Artificial Sequence
  Synthetic
aagggccggcuggaagaccgc

SEQ ID NO: 49232 - RNA, 22 nt, Artificial Sequence
  Synthetic
uaagggccggcuggaagaccgc

SEQ ID NO: 49233 - RNA, 23 nt, Artificial Sequence
  Synthetic
cuaagggccggcuggaagaccgc

SEQ ID NO: 49234 - RNA, 24 nt, Artificial Sequence
  Synthetic
ucuaagggccggcuggaagaccgc

SEQ ID NO: 49235 - RNA, 18 nt, Artificial Sequence
  Synthetic
ccuuaucuaagggccggc

SEQ ID NO: 49236 - RNA, 19 nt, Artificial Sequence
  Synthetic
cccuuaucuaagggccggc

SEQ ID NO: 49237 - RNA, 20 nt, Artificial Sequence
  Synthetic
ccccuuaucuaagggccggc

SEQ ID NO: 49238 - RNA, 21 nt, Artificial Sequence
  Synthetic
cccccuuaucuaagggccggc

SEQ ID NO: 49239 - RNA, 22 nt, Artificial Sequence
  Synthetic
gcccccuuaucuaagggccggc

SEQ ID NO: 49240 - RNA, 23 nt, Artificial Sequence
  Synthetic
ugcccccuuaucuaagggccggc

SEQ ID NO: 49241 - RNA, 24 nt, Artificial Sequence
  Synthetic
cugcccccuuaucuaagggccggc

SEQ ID NO: 49242 - RNA, 18 nt, Artificial Sequence
  Synthetic
augcuugggucuuacugc

SEQ ID NO: 49243 - RNA, 19 nt, Artificial Sequence
  Synthetic
uaugcuugggucuuacugc

SEQ ID NO: 49244 - RNA, 20 nt, Artificial Sequence
  Synthetic
cuaugcuugggucuuacugc

SEQ ID NO: 49245 - RNA, 21 nt, Artificial Sequence
  Synthetic
ucuaugcuugggucuuacugc

SEQ ID NO: 49246 - RNA, 22 nt, Artificial Sequence
  Synthetic
cucuaugcuugggucuuacugc

SEQ ID NO: 49247 - RNA, 23 nt, Artificial Sequence
  Synthetic
ucucuaugcuugggucuuacugc

SEQ ID NO: 49248 - RNA, 24 nt, Artificial Sequence
  Synthetic
cucucuaugcuugggucuuacugc

SEQ ID NO: 49249 - RNA, 18 nt, Artificial Sequence
  Synthetic
cccguuaucccacucguc

SEQ ID NO: 49250 - RNA, 19 nt, Artificial Sequence
  Synthetic
ccccguuaucccacucguc

SEQ ID NO: 49251 - RNA, 20 nt, Artificial Sequence
  Synthetic
cccccguuaucccacucguc

SEQ ID NO: 49252 - RNA, 21 nt, Artificial Sequence
  Synthetic
ucccccguuaucccacucguc

SEQ ID NO: 49253 - RNA, 22 nt, Artificial Sequence
  Synthetic
cucccccguuaucccacucguc

SEQ ID NO: 49254 - RNA, 23 nt, Artificial Sequence
  Synthetic
ccucccccguuaucccacucguc

SEQ ID NO: 49255 - RNA, 24 nt, Artificial Sequence
  Synthetic
uccucccccguuaucccacucguc

SEQ ID NO: 49256 - RNA, 18 nt, Artificial Sequence
  Synthetic
ugcuucuccccaauagag

SEQ ID NO: 49257 - RNA, 19 nt, Artificial Sequence
  Synthetic
cugcuucuccccaauagag

SEQ ID NO: 49258 - RNA, 20 nt, Artificial Sequence
  Synthetic
ccugcuucuccccaauagag

SEQ ID NO: 49259 - RNA, 21 nt, Artificial Sequence
  Synthetic
accugcuucuccccaauagag

SEQ ID NO: 49260 - RNA, 22 nt, Artificial Sequence
  Synthetic
caccugcuucuccccaauagag

SEQ ID NO: 49261 - RNA, 23 nt, Artificial Sequence
  Synthetic
acaccugcuucuccccaauagag

SEQ ID NO: 49262 - RNA, 24 nt, Artificial Sequence
  Synthetic
gacaccugcuucuccccaauagag

SEQ ID NO: 49263 - RNA, 18 nt, Artificial Sequence
  Synthetic
ccugcuucuccccaauag

SEQ ID NO: 49264 - RNA, 19 nt, Artificial Sequence
  Synthetic
accugcuucuccccaauag

SEQ ID NO: 49265 - RNA, 20 nt, Artificial Sequence
  Synthetic
caccugcuucuccccaauag

SEQ ID NO: 49266 - RNA, 21 nt, Artificial Sequence
  Synthetic
acaccugcuucuccccaauag

SEQ ID NO: 49267 - RNA, 22 nt, Artificial Sequence
  Synthetic
gacaccugcuucuccccaauag

SEQ ID NO: 49268 - RNA, 23 nt, Artificial Sequence
  Synthetic
agacaccugcuucuccccaauag

SEQ ID NO: 49269 - RNA, 24 nt, Artificial Sequence
  Synthetic
uagacaccugcuucuccccaauag

SEQ ID NO: 49270 - RNA, 18 nt, Artificial Sequence
  Synthetic
cacgcaagaacagacacg

SEQ ID NO: 49271 - RNA, 19 nt, Artificial Sequence
  Synthetic
acacgcaagaacagacacg

SEQ ID NO: 49272 - RNA, 20 nt, Artificial Sequence
  Synthetic
cacacgcaagaacagacacg

SEQ ID NO: 49273 - RNA, 21 nt, Artificial Sequence
  Synthetic
ccacacgcaagaacagacacg

SEQ ID NO: 49274 - RNA, 22 nt, Artificial Sequence
  Synthetic
gccacacgcaagaacagacacg

SEQ ID NO: 49275 - RNA, 23 nt, Artificial Sequence
  Synthetic
agccacacgcaagaacagacacg

SEQ ID NO: 49276 - RNA, 24 nt, Artificial Sequence
  Synthetic
cagccacacgcaagaacagacacg

SEQ ID NO: 49277 - RNA, 18 nt, Artificial Sequence
  Synthetic
acacaaacacccgcgacg

SEQ ID NO: 49278 - RNA, 19 nt, Artificial Sequence
  Synthetic
aacacaaacacccgcgacg

SEQ ID NO: 49279 - RNA, 20 nt, Artificial Sequence
  Synthetic
aaacacaaacacccgcgacg

SEQ ID NO: 49280 - RNA, 21 nt, Artificial Sequence
  Synthetic
caaacacaaacacccgcgacg

SEQ ID NO: 49281 - RNA, 22 nt, Artificial Sequence
  Synthetic
acaaacacaaacacccgcgacg

SEQ ID NO: 49282 - RNA, 23 nt, Artificial Sequence
  Synthetic
aacaaacacaaacacccgcgacg

SEQ ID NO: 49283 - RNA, 24 nt, Artificial Sequence
  Synthetic
aaacaaacacaaacacccgcgacg

SEQ ID NO: 49284 - RNA, 18 nt, Artificial Sequence
  Synthetic
ggggggacggaggggacg

SEQ ID NO: 49285 - RNA, 19 nt, Artificial Sequence
  Synthetic
cggggggacggaggggacg

SEQ ID NO: 49286 - RNA, 20 nt, Artificial Sequence
  Synthetic
acggggggacggaggggacg

SEQ ID NO: 49287 - RNA, 21 nt, Artificial Sequence
  Synthetic
gacggggggacggaggggacg

SEQ ID NO: 49288 - RNA, 22 nt, Artificial Sequence
  Synthetic
cgacggggggacggaggggacg

SEQ ID NO: 49289 - RNA, 23 nt, Artificial Sequence
  Synthetic
gcgacggggggacggaggggacg

SEQ ID NO: 49290 - RNA, 24 nt, Artificial Sequence
  Synthetic
cgcgacggggggacggaggggacg

SEQ ID NO: 49291 - RNA, 18 nt, Artificial Sequence
  Synthetic
acccgcgacggggggacg

SEQ ID NO: 49292 - RNA, 19 nt, Artificial Sequence
  Synthetic
cacccgcgacggggggacg

SEQ ID NO: 49293 - RNA, 20 nt, Artificial Sequence
  Synthetic
acacccgcgacggggggacg

SEQ ID NO: 49294 - RNA, 21 nt, Artificial Sequence
  Synthetic
aacacccgcgacggggggacg

SEQ ID NO: 49295 - RNA, 22 nt, Artificial Sequence
  Synthetic
aaacacccgcgacggggggacg

SEQ ID NO: 49296 - RNA, 23 nt, Artificial Sequence
  Synthetic
caaacacccgcgacggggggacg

SEQ ID NO: 49297 - RNA, 24 nt, Artificial Sequence
  Synthetic
acaaacacccgcgacggggggacg

SEQ ID NO: 49298 - RNA, 18 nt, Artificial Sequence
  Synthetic
cggagggagggggugacg

SEQ ID NO: 49299 - RNA, 19 nt, Artificial Sequence
  Synthetic
acggagggagggggugacg

SEQ ID NO: 49300 - RNA, 20 nt, Artificial Sequence
  Synthetic
gacggagggagggggugacg

SEQ ID NO: 49301 - RNA, 21 nt, Artificial Sequence
  Synthetic
ggacggagggagggggugacg

SEQ ID NO: 49302 - RNA, 22 nt, Artificial Sequence
  Synthetic
gggacggagggagggggugacg

SEQ ID NO: 49303 - RNA, 23 nt, Artificial Sequence
  Synthetic
ggggacggagggagggggugacg

SEQ ID NO: 49304 - RNA, 24 nt, Artificial Sequence
  Synthetic
aggggacggagggagggggugacg

SEQ ID NO: 49305 - RNA, 18 nt, Artificial Sequence
  Synthetic
caaccccaacggaaagcg

SEQ ID NO: 49306 - RNA, 19 nt, Artificial Sequence
  Synthetic
acaaccccaacggaaagcg

SEQ ID NO: 49307 - RNA, 20 nt, Artificial Sequence
  Synthetic
aacaaccccaacggaaagcg

SEQ ID NO: 49308 - RNA, 21 nt, Artificial Sequence
  Synthetic
uaacaaccccaacggaaagcg

SEQ ID NO: 49309 - RNA, 22 nt, Artificial Sequence
  Synthetic
auaacaaccccaacggaaagcg

SEQ ID NO: 49310 - RNA, 23 nt, Artificial Sequence
  Synthetic
aauaacaaccccaacggaaagcg

SEQ ID NO: 49311 - RNA, 24 nt, Artificial Sequence
  Synthetic
caauaacaaccccaacggaaagcg

SEQ ID NO: 49312 - RNA, 18 nt, Artificial Sequence
  Synthetic
caaacacaaacacccgcg

SEQ ID NO: 49313 - RNA, 19 nt, Artificial Sequence
  Synthetic
acaaacacaaacacccgcg

SEQ ID NO: 49314 - RNA, 20 nt, Artificial Sequence
  Synthetic
aacaaacacaaacacccgcg

SEQ ID NO: 49315 - RNA, 21 nt, Artificial Sequence
  Synthetic
aaacaaacacaaacacccgcg

SEQ ID NO: 49316 - RNA, 22 nt, Artificial Sequence
  Synthetic
uaaacaaacacaaacacccgcg

SEQ ID NO: 49317 - RNA, 23 nt, Artificial Sequence
  Synthetic
auaaacaaacacaaacacccgcg

SEQ ID NO: 49318 - RNA, 24 nt, Artificial Sequence
  Synthetic
aauaaacaaacacaaacacccgcg

SEQ ID NO: 49319 - RNA, 18 nt, Artificial Sequence
  Synthetic
acugagcccggucgaucg

SEQ ID NO: 49320 - RNA, 19 nt, Artificial Sequence
  Synthetic
cacugagcccggucgaucg

SEQ ID NO: 49321 - RNA, 20 nt, Artificial Sequence
  Synthetic
ccacugagcccggucgaucg

SEQ ID NO: 49322 - RNA, 21 nt, Artificial Sequence
  Synthetic
cccacugagcccggucgaucg

SEQ ID NO: 49323 - RNA, 22 nt, Artificial Sequence
  Synthetic
ccccacugagcccggucgaucg

SEQ ID NO: 49324 - RNA, 23 nt, Artificial Sequence
  Synthetic
cccccacugagcccggucgaucg

SEQ ID NO: 49325 - RNA, 24 nt, Artificial Sequence
  Synthetic
gcccccacugagcccggucgaucg

SEQ ID NO: 49326 - RNA, 18 nt, Artificial Sequence
  Synthetic
cccccguuaucccacucg

SEQ ID NO: 49327 - RNA, 19 nt, Artificial Sequence
  Synthetic
ucccccguuaucccacucg

SEQ ID NO: 49328 - RNA, 20 nt, Artificial Sequence
  Synthetic
cucccccguuaucccacucg

SEQ ID NO: 49329 - RNA, 21 nt, Artificial Sequence
  Synthetic
ccucccccguuaucccacucg

SEQ ID NO: 49330 - RNA, 22 nt, Artificial Sequence
  Synthetic
uccucccccguuaucccacucg

SEQ ID NO: 49331 - RNA, 23 nt, Artificial Sequence
  Synthetic
uuccucccccguuaucccacucg

SEQ ID NO: 49332 - RNA, 24 nt, Artificial Sequence
  Synthetic
cuuccucccccguuaucccacucg

SEQ ID NO: 49333 - RNA, 18 nt, Artificial Sequence
  Synthetic
gcuucuccccaauagagg

SEQ ID NO: 49334 - RNA, 19 nt, Artificial Sequence
  Synthetic
ugcuucuccccaauagagg

SEQ ID NO: 49335 - RNA, 20 nt, Artificial Sequence
  Synthetic
cugcuucuccccaauagagg

SEQ ID NO: 49336 - RNA, 21 nt, Artificial Sequence
  Synthetic
ccugcuucuccccaauagagg

SEQ ID NO: 49337 - RNA, 22 nt, Artificial Sequence
  Synthetic
accugcuucuccccaauagagg

SEQ ID NO: 49338 - RNA, 23 nt, Artificial Sequence
  Synthetic
caccugcuucuccccaauagagg

SEQ ID NO: 49339 - RNA, 24 nt, Artificial Sequence
  Synthetic
acaccugcuucuccccaauagagg

SEQ ID NO: 49340 - RNA, 18 nt, Artificial Sequence
  Synthetic
ggacggaggggacggagg

SEQ ID NO: 49341 - RNA, 19 nt, Artificial Sequence
  Synthetic
gggacggaggggacggagg

SEQ ID NO: 49342 - RNA, 20 nt, Artificial Sequence
  Synthetic
ggggacggaggggacggagg

SEQ ID NO: 49343 - RNA, 21 nt, Artificial Sequence
  Synthetic
gggggacggaggggacggagg

SEQ ID NO: 49344 - RNA, 22 nt, Artificial Sequence
  Synthetic
ggggggacggaggggacggagg

SEQ ID NO: 49345 - RNA, 23 nt, Artificial Sequence
  Synthetic
cggggggacggaggggacggagg

SEQ ID NO: 49346 - RNA, 24 nt, Artificial Sequence
  Synthetic
acggggggacggaggggacggagg

SEQ ID NO: 49347 - RNA, 18 nt, Artificial Sequence
  Synthetic
cacaaacacccgcgacgg

SEQ ID NO: 49348 - RNA, 19 nt, Artificial Sequence
  Synthetic
acacaaacacccgcgacgg

SEQ ID NO: 49349 - RNA, 20 nt, Artificial Sequence
  Synthetic
aacacaaacacccgcgacgg

SEQ ID NO: 49350 - RNA, 21 nt, Artificial Sequence
  Synthetic
aaacacaaacacccgcgacgg

SEQ ID NO: 49351 - RNA, 22 nt, Artificial Sequence
  Synthetic
caaacacaaacacccgcgacgg

SEQ ID NO: 49352 - RNA, 23 nt, Artificial Sequence
  Synthetic
acaaacacaaacacccgcgacgg

SEQ ID NO: 49353 - RNA, 24 nt, Artificial Sequence
  Synthetic
aacaaacacaaacacccgcgacgg

SEQ ID NO: 49354 - RNA, 18 nt, Artificial Sequence
  Synthetic
gggggacggaggggacgg

SEQ ID NO: 49355 - RNA, 19 nt, Artificial Sequence
  Synthetic
ggggggacggaggggacgg

SEQ ID NO: 49356 - RNA, 20 nt, Artificial Sequence
  Synthetic
cggggggacggaggggacgg

SEQ ID NO: 49357 - RNA, 21 nt, Artificial Sequence
  Synthetic
acggggggacggaggggacgg

SEQ ID NO: 49358 - RNA, 22 nt, Artificial Sequence
  Synthetic
gacggggggacggaggggacgg

SEQ ID NO: 49359 - RNA, 23 nt, Artificial Sequence
  Synthetic
cgacggggggacggaggggacgg

SEQ ID NO: 49360 - RNA, 24 nt, Artificial Sequence
  Synthetic
gcgacggggggacggaggggacgg

SEQ ID NO: 49361 - RNA, 18 nt, Artificial Sequence
  Synthetic
cccgcgacggggggacgg

SEQ ID NO: 49362 - RNA, 19 nt, Artificial Sequence
  Synthetic
acccgcgacggggggacgg

SEQ ID NO: 49363 - RNA, 20 nt, Artificial Sequence
  Synthetic
cacccgcgacggggggacgg

SEQ ID NO: 49364 - RNA, 21 nt, Artificial Sequence
  Synthetic
acacccgcgacggggggacgg

SEQ ID NO: 49365 - RNA, 22 nt, Artificial Sequence
  Synthetic
aacacccgcgacggggggacgg

SEQ ID NO: 49366 - RNA, 23 nt, Artificial Sequence
  Synthetic
aaacacccgcgacggggggacgg

SEQ ID NO: 49367 - RNA, 24 nt, Artificial Sequence
  Synthetic
caaacacccgcgacggggggacgg

SEQ ID NO: 49368 - RNA, 18 nt, Artificial Sequence
  Synthetic
cccuuaucuaagggccgg

SEQ ID NO: 49369 - RNA, 19 nt, Artificial Sequence
  Synthetic
ccccuuaucuaagggccgg

SEQ ID NO: 49370 - RNA, 20 nt, Artificial Sequence
  Synthetic
cccccuuaucuaagggccgg

SEQ ID NO: 49371 - RNA, 21 nt, Artificial Sequence
  Synthetic
gcccccuuaucuaagggccgg

SEQ ID NO: 49372 - RNA, 22 nt, Artificial Sequence
  Synthetic
ugcccccuuaucuaagggccgg

SEQ ID NO: 49373 - RNA, 23 nt, Artificial Sequence
  Synthetic
cugcccccuuaucuaagggccgg

SEQ ID NO: 49374 - RNA, 24 nt, Artificial Sequence
  Synthetic
acugcccccuuaucuaagggccgg

SEQ ID NO: 49375 - RNA, 18 nt, Artificial Sequence
  Synthetic
cggccacgccacucgcgg

SEQ ID NO: 49376 - RNA, 19 nt, Artificial Sequence
  Synthetic
ucggccacgccacucgcgg

SEQ ID NO: 49377 - RNA, 20 nt, Artificial Sequence
  Synthetic
gucggccacgccacucgcgg

SEQ ID NO: 49378 - RNA, 21 nt, Artificial Sequence
  Synthetic
ggucggccacgccacucgcgg

SEQ ID NO: 49379 - RNA, 22 nt, Artificial Sequence
  Synthetic
aggucggccacgccacucgcgg

SEQ ID NO: 49380 - RNA, 23 nt, Artificial Sequence
  Synthetic
aaggucggccacgccacucgcgg

SEQ ID NO: 49381 - RNA, 24 nt, Artificial Sequence
  Synthetic
uaaggucggccacgccacucgcgg

SEQ ID NO: 49382 - RNA, 18 nt, Artificial Sequence
  Synthetic
cuucuccccaauagaggg

SEQ ID NO: 49383 - RNA, 19 nt, Artificial Sequence
  Synthetic
gcuucuccccaauagaggg

SEQ ID NO: 49384 - RNA, 20 nt, Artificial Sequence
  Synthetic
ugcuucuccccaauagaggg

SEQ ID NO: 49385 - RNA, 21 nt, Artificial Sequence
  Synthetic
cugcuucuccccaauagaggg

SEQ ID NO: 49386 - RNA, 22 nt, Artificial Sequence
  Synthetic
ccugcuucuccccaauagaggg

SEQ ID NO: 49387 - RNA, 23 nt, Artificial Sequence
  Synthetic
accugcuucuccccaauagaggg

SEQ ID NO: 49388 - RNA, 24 nt, Artificial Sequence
  Synthetic
caccugcuucuccccaauagaggg

SEQ ID NO: 49389 - RNA, 18 nt, Artificial Sequence
  Synthetic
gacggaggggacggaggg

SEQ ID NO: 49390 - RNA, 19 nt, Artificial Sequence
  Synthetic
ggacggaggggacggaggg

SEQ ID NO: 49391 - RNA, 20 nt, Artificial Sequence
  Synthetic
gggacggaggggacggaggg

SEQ ID NO: 49392 - RNA, 21 nt, Artificial Sequence
  Synthetic
ggggacggaggggacggaggg

SEQ ID NO: 49393 - RNA, 22 nt, Artificial Sequence
  Synthetic
gggggacggaggggacggaggg

SEQ ID NO: 49394 - RNA, 23 nt, Artificial Sequence
  Synthetic
ggggggacggaggggacggaggg

SEQ ID NO: 49395 - RNA, 24 nt, Artificial Sequence
  Synthetic
cggggggacggaggggacggaggg

SEQ ID NO: 49396 - RNA, 18 nt, Artificial Sequence
  Synthetic
uucuccccaauagagggg

SEQ ID NO: 49397 - RNA, 19 nt, Artificial Sequence
  Synthetic
cuucuccccaauagagggg

SEQ ID NO: 49398 - RNA, 20 nt, Artificial Sequence
  Synthetic
gcuucuccccaauagagggg

SEQ ID NO: 49399 - RNA, 21 nt, Artificial Sequence
  Synthetic
ugcuucuccccaauagagggg

SEQ ID NO: 49400 - RNA, 22 nt, Artificial Sequence
  Synthetic
cugcuucuccccaauagagggg

SEQ ID NO: 49401 - RNA, 23 nt, Artificial Sequence
  Synthetic
ccugcuucuccccaauagagggg

SEQ ID NO: 49402 - RNA, 24 nt, Artificial Sequence
  Synthetic
accugcuucuccccaauagagggg

SEQ ID NO: 49403 - RNA, 18 nt, Artificial Sequence
  Synthetic
gacggggggacggagggg

SEQ ID NO: 49404 - RNA, 19 nt, Artificial Sequence
  Synthetic
cgacggggggacggagggg

SEQ ID NO: 49405 - RNA, 20 nt, Artificial Sequence
  Synthetic
gcgacggggggacggagggg

SEQ ID NO: 49406 - RNA, 21 nt, Artificial Sequence
  Synthetic
cgcgacggggggacggagggg

SEQ ID NO: 49407 - RNA, 22 nt, Artificial Sequence
  Synthetic
ccgcgacggggggacggagggg

SEQ ID NO: 49408 - RNA, 23 nt, Artificial Sequence
  Synthetic
cccgcgacggggggacggagggg

SEQ ID NO: 49409 - RNA, 24 nt, Artificial Sequence
  Synthetic
acccgcgacggggggacggagggg

SEQ ID NO: 49410 - RNA, 18 nt, Artificial Sequence
  Synthetic
gggagggggugacggggg

SEQ ID NO: 49411 - RNA, 19 nt, Artificial Sequence
  Synthetic
agggagggggugacggggg

SEQ ID NO: 49412 - RNA, 20 nt, Artificial Sequence
  Synthetic
gagggagggggugacggggg

SEQ ID NO: 49413 - RNA, 21 nt, Artificial Sequence
  Synthetic
ggagggagggggugacggggg

SEQ ID NO: 49414 - RNA, 22 nt, Artificial Sequence
  Synthetic
cggagggagggggugacggggg

SEQ ID NO: 49415 - RNA, 23 nt, Artificial Sequence
  Synthetic
acggagggagggggugacggggg

SEQ ID NO: 49416 - RNA, 24 nt, Artificial Sequence
  Synthetic
gacggagggagggggugacggggg

SEQ ID NO: 49417 - RNA, 18 nt, Artificial Sequence
  Synthetic
aacacccgcgacgggggg

SEQ ID NO: 49418 - RNA, 19 nt, Artificial Sequence
  Synthetic
aaacacccgcgacgggggg

SEQ ID NO: 49419 - RNA, 20 nt, Artificial Sequence
  Synthetic
caaacacccgcgacgggggg

SEQ ID NO: 49420 - RNA, 21 nt, Artificial Sequence
  Synthetic
acaaacacccgcgacgggggg

SEQ ID NO: 49421 - RNA, 22 nt, Artificial Sequence
  Synthetic
cacaaacacccgcgacgggggg

SEQ ID NO: 49422 - RNA, 23 nt, Artificial Sequence
  Synthetic
acacaaacacccgcgacgggggg

SEQ ID NO: 49423 - RNA, 24 nt, Artificial Sequence
  Synthetic
aacacaaacacccgcgacgggggg

SEQ ID NO: 49424 - RNA, 18 nt, Artificial Sequence
  Synthetic
aaagcggcgggguguugg

SEQ ID NO: 49425 - RNA, 19 nt, Artificial Sequence
  Synthetic
gaaagcggcgggguguugg

SEQ ID NO: 49426 - RNA, 20 nt, Artificial Sequence
  Synthetic
ggaaagcggcgggguguugg

SEQ ID NO: 49427 - RNA, 21 nt, Artificial Sequence
  Synthetic
cggaaagcggcgggguguugg

SEQ ID NO: 49428 - RNA, 22 nt, Artificial Sequence
  Synthetic
acggaaagcggcgggguguugg

SEQ ID NO: 49429 - RNA, 23 nt, Artificial Sequence
  Synthetic
aacggaaagcggcgggguguugg

SEQ ID NO: 49430 - RNA, 24 nt, Artificial Sequence
  Synthetic
caacggaaagcggcgggguguugg

SEQ ID NO: 49431 - RNA, 18 nt, Artificial Sequence
  Synthetic
uauuuaaauaaaccaaug

SEQ ID NO: 49432 - RNA, 19 nt, Artificial Sequence
  Synthetic
uuauuuaaauaaaccaaug

SEQ ID NO: 49433 - RNA, 20 nt, Artificial Sequence
  Synthetic
uuuauuuaaauaaaccaaug

SEQ ID NO: 49434 - RNA, 21 nt, Artificial Sequence
  Synthetic
guuuauuuaaauaaaccaaug

SEQ ID NO: 49435 - RNA, 22 nt, Artificial Sequence
  Synthetic
uguuuauuuaaauaaaccaaug

SEQ ID NO: 49436 - RNA, 23 nt, Artificial Sequence
  Synthetic
guguuuauuuaaauaaaccaaug

SEQ ID NO: 49437 - RNA, 24 nt, Artificial Sequence
  Synthetic
uguguuuauuuaaauaaaccaaug

SEQ ID NO: 49438 - RNA, 18 nt, Artificial Sequence
  Synthetic
acggaaagcggcggggug

SEQ ID NO: 49439 - RNA, 19 nt, Artificial Sequence
  Synthetic
aacggaaagcggcggggug

SEQ ID NO: 49440 - RNA, 20 nt, Artificial Sequence
  Synthetic
caacggaaagcggcggggug

SEQ ID NO: 49441 - RNA, 21 nt, Artificial Sequence
  Synthetic
ccaacggaaagcggcggggug

SEQ ID NO: 49442 - RNA, 22 nt, Artificial Sequence
  Synthetic
cccaacggaaagcggcggggug

SEQ ID NO: 49443 - RNA, 23 nt, Artificial Sequence
  Synthetic
ccccaacggaaagcggcggggug

SEQ ID NO: 49444 - RNA, 24 nt, Artificial Sequence
  Synthetic
accccaacggaaagcggcggggug

SEQ ID NO: 49445 - RNA, 18 nt, Artificial Sequence
  Synthetic
ggacggagggagggggug

SEQ ID NO: 49446 - RNA, 19 nt, Artificial Sequence
  Synthetic
gggacggagggagggggug

SEQ ID NO: 49447 - RNA, 20 nt, Artificial Sequence
  Synthetic
ggggacggagggagggggug

SEQ ID NO: 49448 - RNA, 21 nt, Artificial Sequence
  Synthetic
aggggacggagggagggggug

SEQ ID NO: 49449 - RNA, 22 nt, Artificial Sequence
  Synthetic
gaggggacggagggagggggug

SEQ ID NO: 49450 - RNA, 23 nt, Artificial Sequence
  Synthetic
ggaggggacggagggagggggug

SEQ ID NO: 49451 - RNA, 24 nt, Artificial Sequence
  Synthetic
cggaggggacggagggagggggug

SEQ ID NO: 49452 - RNA, 18 nt, Artificial Sequence
  Synthetic
gaaagcggcgggguguug

SEQ ID NO: 49453 - RNA, 19 nt, Artificial Sequence
  Synthetic
ggaaagcggcgggguguug

SEQ ID NO: 49454 - RNA, 20 nt, Artificial Sequence
  Synthetic
cggaaagcggcgggguguug

SEQ ID NO: 49455 - RNA, 21 nt, Artificial Sequence
  Synthetic
acggaaagcggcgggguguug

SEQ ID NO: 49456 - RNA, 22 nt, Artificial Sequence
  Synthetic
aacggaaagcggcgggguguug

SEQ ID NO: 49457 - RNA, 23 nt, Artificial Sequence
  Synthetic
caacggaaagcggcgggguguug

SEQ ID NO: 49458 - RNA, 24 nt, Artificial Sequence
  Synthetic
ccaacggaaagcggcgggguguug

SEQ ID NO: 49459 - RNA, 18 nt, Artificial Sequence
  Synthetic
ccaacugcccccuuaucu

SEQ ID NO: 49460 - RNA, 19 nt, Artificial Sequence
  Synthetic
accaacugcccccuuaucu

SEQ ID NO: 49461 - RNA, 20 nt, Artificial Sequence
  Synthetic
caccaacugcccccuuaucu

SEQ ID NO: 49462 - RNA, 21 nt, Artificial Sequence
  Synthetic
ccaccaacugcccccuuaucu

SEQ ID NO: 49463 - RNA, 22 nt, Artificial Sequence
  Synthetic
accaccaacugcccccuuaucu

SEQ ID NO: 49464 - RNA, 23 nt, Artificial Sequence
  Synthetic
gaccaccaacugcccccuuaucu

SEQ ID NO: 49465 - RNA, 24 nt, Artificial Sequence
  Synthetic
cgaccaccaacugcccccuuaucu

SEQ ID NO: 49466 - RNA, 18 nt, Artificial Sequence
  Synthetic
cggaaagcggcggggugu

SEQ ID NO: 49467 - RNA, 19 nt, Artificial Sequence
  Synthetic
acggaaagcggcggggugu

SEQ ID NO: 49468 - RNA, 20 nt, Artificial Sequence
  Synthetic
aacggaaagcggcggggugu

SEQ ID NO: 49469 - RNA, 21 nt, Artificial Sequence
  Synthetic
caacggaaagcggcggggugu

SEQ ID NO: 49470 - RNA, 22 nt, Artificial Sequence
  Synthetic
ccaacggaaagcggcggggugu

SEQ ID NO: 49471 - RNA, 23 nt, Artificial Sequence
  Synthetic
cccaacggaaagcggcggggugu

SEQ ID NO: 49472 - RNA, 24 nt, Artificial Sequence
  Synthetic
ccccaacggaaagcggcggggugu

SEQ ID NO: 49473 - RNA, 18 nt, Artificial Sequence
  Synthetic
ggaaagcggcgggguguu

SEQ ID NO: 49474 - RNA, 19 nt, Artificial Sequence
  Synthetic
cggaaagcggcgggguguu

SEQ ID NO: 49475 - RNA, 20 nt, Artificial Sequence
  Synthetic
acggaaagcggcgggguguu

SEQ ID NO: 49476 - RNA, 21 nt, Artificial Sequence
  Synthetic
aacggaaagcggcgggguguu

SEQ ID NO: 49477 - RNA, 22 nt, Artificial Sequence
  Synthetic
caacggaaagcggcgggguguu

SEQ ID NO: 49478 - RNA, 23 nt, Artificial Sequence
  Synthetic
ccaacggaaagcggcgggguguu

SEQ ID NO: 49479 - RNA, 24 nt, Artificial Sequence
  Synthetic
cccaacggaaagcggcgggguguu

SEQ ID NO: 49480 - RNA, 17 nt, Artificial Sequence
  Synthetic
cgcgaaaaaggcccccc

SEQ ID NO: 49481 - RNA, 17 nt, Artificial Sequence
  Synthetic
acagaccagcggccggc

SEQ ID NO: 49482 - RNA, 17 nt, Artificial Sequence
  Synthetic
uuccucgucugcggccu

SEQ ID NO: 49483 - RNA, 17 nt, Artificial Sequence
  Synthetic
cugucugcagagcacuu

SEQ ID NO: 49484 - RNA, 20 nt, Artificial Sequence
  Synthetic
cgacgcgaaaaaggcccccc

SEQ ID NO: 49485 - RNA, 20 nt, Artificial Sequence
  Synthetic
aaaacagaccagcggccggc

SEQ ID NO: 49486 - RNA, 20 nt, Artificial Sequence
  Synthetic
acucugggccuuucugccuc

SEQ ID NO: 49487 - RNA, 20 nt, Artificial Sequence
  Synthetic
auuuuccucgucugcggccu

SEQ ID NO: 49488 - RNA, 20 nt, Artificial Sequence
  Synthetic
ccccugucugcagagcacuu

SEQ ID NO: 49489 - RNA, 17 nt, Artificial Sequence
  Synthetic
cugggccuuucugccuc

SEQ ID NO: 49490 - RNA, 17 nt, Artificial Sequence
  Synthetic
uuccagguagguuagac

SEQ ID NO: 49491 - RNA, 17 nt, Artificial Sequence
  Synthetic
uguucuugcguguggcu

SEQ ID NO: 49492 - RNA, 17 nt, Artificial Sequence
  Synthetic
uuuuugugccuggcucu

SEQ ID NO: 49493 - RNA, 17 nt, Artificial Sequence
  Synthetic
uccaucgccuuuccugu

SEQ ID NO: 49494 - RNA, 20 nt, Artificial Sequence
  Synthetic
cguuuccagguagguuagac

SEQ ID NO: 49495 - RNA, 20 nt, Artificial Sequence
  Synthetic
gucuguucuugcguguggcu

SEQ ID NO: 49496 - RNA, 20 nt, Artificial Sequence
  Synthetic
guguuuuugugccuggcucu

SEQ ID NO: 49497 - RNA, 20 nt, Artificial Sequence
  Synthetic
ggcuccaucgccuuuccugu

SEQ ID NO: 49498 - RNA, 17 nt, Artificial Sequence
  Synthetic
gggugguccggggaaaa

SEQ ID NO: 49499 - RNA, 17 nt, Artificial Sequence
  Synthetic
ggggcggcgcaugcuaa

SEQ ID NO: 49500 - RNA, 17 nt, Artificial Sequence
  Synthetic
gcggcccgaccgucaca

SEQ ID NO: 49501 - RNA, 17 nt, Artificial Sequence
  Synthetic
ggggcgggcaccacuca

SEQ ID NO: 49502 - RNA, 17 nt, Artificial Sequence
  Synthetic
guaggguagacucgaga

SEQ ID NO: 49503 - RNA, 17 nt, Artificial Sequence
  Synthetic
gauaggcgccggguaua

SEQ ID NO: 49504 - RNA, 17 nt, Artificial Sequence
  Synthetic
ggcggcgcacggcccac

SEQ ID NO: 49505 - RNA, 17 nt, Artificial Sequence
  Synthetic
gguugguccccggggac

SEQ ID NO: 49506 - RNA, 17 nt, Artificial Sequence
  Synthetic
gcccgagagcgggggac

SEQ ID NO: 49507 - RNA, 17 nt, Artificial Sequence
  Synthetic
gggcggggacgcuugac

SEQ ID NO: 49508 - RNA, 17 nt, Artificial Sequence
  Synthetic
gggccgcauucgcaccc

SEQ ID NO: 49509 - RNA, 17 nt, Artificial Sequence
  Synthetic
gugagagggcgaccccc

SEQ ID NO: 49510 - RNA, 17 nt, Artificial Sequence
  Synthetic
gggaguggauaggcgcc

SEQ ID NO: 49511 - RNA, 17 nt, Artificial Sequence
  Synthetic
gaccgcuuaagcgggcc

SEQ ID NO: 49512 - RNA, 17 nt, Artificial Sequence
  Synthetic
ggcccggcacgagcucc

SEQ ID NO: 49513 - RNA, 17 nt, Artificial Sequence
  Synthetic
ggggauuuagagggcgc

SEQ ID NO: 49514 - RNA, 17 nt, Artificial Sequence
  Synthetic
gggagcucgugccgggc

SEQ ID NO: 49515 - RNA, 17 nt, Artificial Sequence
  Synthetic
ggcgacccccgggucuc

SEQ ID NO: 49516 - RNA, 17 nt, Artificial Sequence
  Synthetic
ggcccgcuuaagcgguc

SEQ ID NO: 49517 - RNA, 17 nt, Artificial Sequence
  Synthetic
ggcccgaccgucacacg

SEQ ID NO: 49518 - RNA, 17 nt, Artificial Sequence
  Synthetic
ggcggggacgcuugacg

SEQ ID NO: 49519 - RNA, 17 nt, Artificial Sequence
  Synthetic
gagcucgugccgggccg

SEQ ID NO: 49520 - RNA, 17 nt, Artificial Sequence
  Synthetic
gcccucucaccgugccg

SEQ ID NO: 49521 - RNA, 17 nt, Artificial Sequence
  Synthetic
gggauuuagagggcgcg

SEQ ID NO: 49522 - RNA, 17 nt, Artificial Sequence
  Synthetic
gggggauuuagagggcg

SEQ ID NO: 49523 - RNA, 17 nt, Artificial Sequence
  Synthetic
ggaaucccccccucucg

SEQ ID NO: 49524 - RNA, 17 nt, Artificial Sequence
  Synthetic
gcccgcuuaagcggucg

SEQ ID NO: 49525 - RNA, 17 nt, Artificial Sequence
  Synthetic
ggguccguaaccaaagg

SEQ ID NO: 49526 - RNA, 17 nt, Artificial Sequence
  Synthetic
ggguagacucgagacgg

SEQ ID NO: 49527 - RNA, 17 nt, Artificial Sequence
  Synthetic
ggcggcgcaugcuaaug

SEQ ID NO: 49528 - RNA, 17 nt, Artificial Sequence
  Synthetic
ggggcgcgcggcuauug

SEQ ID NO: 49529 - RNA, 17 nt, Artificial Sequence
  Synthetic
gggcggcgcaugcuaau

SEQ ID NO: 49530 - RNA, 17 nt, Artificial Sequence
  Synthetic
ggcugaucggccccuau

SEQ ID NO: 49531 - RNA, 17 nt, Artificial Sequence
  Synthetic
ggucgggggacccccgu

SEQ ID NO: 49532 - RNA, 17 nt, Artificial Sequence
  Synthetic
gggacucccaucugcgu

SEQ ID NO: 49533 - RNA, 20 nt, Artificial Sequence
  Synthetic
gccgggugguccggggaaaa

SEQ ID NO: 49534 - RNA, 20 nt, Artificial Sequence
  Synthetic
guucggaagggggggagaaa

SEQ ID NO: 49535 - RNA, 20 nt, Artificial Sequence
  Synthetic
gcgccuauccacucccccaa

SEQ ID NO: 49536 - RNA, 20 nt, Artificial Sequence
  Synthetic
gacgaggggucggaauccaa

SEQ ID NO: 49537 - RNA, 20 nt, Artificial Sequence
  Synthetic
ggggggcggcgcacggccca

SEQ ID NO: 49538 - RNA, 20 nt, Artificial Sequence
  Synthetic
gccgcggcagacccccggca

SEQ ID NO: 49539 - RNA, 20 nt, Artificial Sequence
  Synthetic
ggaagcccaggggaccaaua

SEQ ID NO: 49540 - RNA, 20 nt, Artificial Sequence
  Synthetic
guggauaggcgccggguaua

SEQ ID NO: 49541 - RNA, 20 nt, Artificial Sequence
  Synthetic
gggcugcuugacaaagcaac

SEQ ID NO: 49542 - RNA, 20 nt, Artificial Sequence
  Synthetic
gggggcggcgcacggcccac

SEQ ID NO: 49543 - RNA, 20 nt, Artificial Sequence
  Synthetic
ggagcccgagagcgggggac

SEQ ID NO: 49544 - RNA, 20 nt, Artificial Sequence
  Synthetic
gucgggccgcauucgcaccc

SEQ ID NO: 49545 - RNA, 20 nt, Artificial Sequence
  Synthetic
gucucgagucuacccuaccc

SEQ ID NO: 49546 - RNA, 20 nt, Artificial Sequence
  Synthetic
gacgcagaugggaguccccc

SEQ ID NO: 49547 - RNA, 20 nt, Artificial Sequence
  Synthetic
gaguacacccgguugguccc

SEQ ID NO: 49548 - RNA, 20 nt, Artificial Sequence
  Synthetic
ggucgcccucucaccgugcc

SEQ ID NO: 49549 - RNA, 20 nt, Artificial Sequence
  Synthetic
gaguccccccggcgccccgc

SEQ ID NO: 49550 - RNA, 20 nt, Artificial Sequence
  Synthetic
ggcaccacucagggccgcgc

SEQ ID NO: 49551 - RNA, 20 nt, Artificial Sequence
  Synthetic
ggacacgggggacacggcgc

SEQ ID NO: 49552 - RNA, 20 nt, Artificial Sequence
  Synthetic
gggggggauuuagagggcgc

SEQ ID NO: 49553 - RNA, 20 nt, Artificial Sequence
  Synthetic
ggacucccaucugcgucggc

SEQ ID NO: 49554 - RNA, 20 nt, Artificial Sequence
  Synthetic
gggucgcccucucaccgugc

SEQ ID NO: 49555 - RNA, 20 nt, Artificial Sequence
  Synthetic
guccgcccgggagcucgugc

SEQ ID NO: 49556 - RNA, 20 nt, Artificial Sequence
  Synthetic
gcccgcggucucucucuugc

SEQ ID NO: 49557 - RNA, 20 nt, Artificial Sequence
  Synthetic
gucugccgcggcggccgcuc

SEQ ID NO: 49558 - RNA, 20 nt, Artificial Sequence
  Synthetic
gagggcgacccccgggucuc

SEQ ID NO: 49559 - RNA, 20 nt, Artificial Sequence
  Synthetic
ggcagccccgugugacgguc

SEQ ID NO: 49560 - RNA, 20 nt, Artificial Sequence
  Synthetic
gggucccccgaccgcuuaag

SEQ ID NO: 49561 - RNA, 20 nt, Artificial Sequence
  Synthetic
ggggacggggccgccccgag

SEQ ID NO: 49562 - RNA, 20 nt, Artificial Sequence
  Synthetic
gggcggaccccggccccgag

SEQ ID NO: 49563 - RNA, 20 nt, Artificial Sequence
  Synthetic
ggggcggcgcacggcccacg

SEQ ID NO: 49564 - RNA, 20 nt, Artificial Sequence
  Synthetic
guacacccgguugguccccg

SEQ ID NO: 49565 - RNA, 20 nt, Artificial Sequence
  Synthetic
gucgcccucucaccgugccg

SEQ ID NO: 49566 - RNA, 20 nt, Artificial Sequence
  Synthetic
ggggggauuuagagggcgcg

SEQ ID NO: 49567 - RNA, 20 nt, Artificial Sequence
  Synthetic
ggucgcgggcggugggcucg

SEQ ID NO: 49568 - RNA, 20 nt, Artificial Sequence
  Synthetic
gagggaaucccccccucucg

SEQ ID NO: 49569 - RNA, 20 nt, Artificial Sequence
  Synthetic
gcccgagagcgggggacagg

SEQ ID NO: 49570 - RNA, 20 nt, Artificial Sequence
  Synthetic
gcugcuugacaaagcaacgg

SEQ ID NO: 49571 - RNA, 20 nt, Artificial Sequence
  Synthetic
gggcggcgcacggcccacgg

SEQ ID NO: 49572 - RNA, 20 nt, Artificial Sequence
  Synthetic
guaggguagacucgagacgg

SEQ ID NO: 49573 - RNA, 20 nt, Artificial Sequence
  Synthetic
gcuaaugaauuucuccccgg

SEQ ID NO: 49574 - RNA, 20 nt, Artificial Sequence
  Synthetic
gcgacggagcggcggcccgg

SEQ ID NO: 49575 - RNA, 20 nt, Artificial Sequence
  Synthetic
gugccgggggucugccgcgg

SEQ ID NO: 49576 - RNA, 20 nt, Artificial Sequence
  Synthetic
gggacucccaucugcgucgg

SEQ ID NO: 49577 - RNA, 20 nt, Artificial Sequence
  Synthetic
gagccucgcgcgccgccggg

SEQ ID NO: 49578 - RNA, 20 nt, Artificial Sequence
  Synthetic
ggugguccggggaaaagggg

SEQ ID NO: 49579 - RNA, 20 nt, Artificial Sequence
  Synthetic
gcagugccggggugcgaaug

SEQ ID NO: 49580 - RNA, 20 nt, Artificial Sequence
  Synthetic
gggggcggcgcaugcuaaug

SEQ ID NO: 49581 - RNA, 20 nt, Artificial Sequence
  Synthetic
gccggggcgcgcggcuauug

SEQ ID NO: 49582 - RNA, 20 nt, Artificial Sequence
  Synthetic
gaccacccggcugcggguug

SEQ ID NO: 49583 - RNA, 20 nt, Artificial Sequence
  Synthetic
ggggggcggcgcaugcuaau

SEQ ID NO: 49584 - RNA, 20 nt, Artificial Sequence
  Synthetic
gccccuuugggggaguggau

SEQ ID NO: 49585 - RNA, 20 nt, Artificial Sequence
  Synthetic
gugggcugaucggccccuau

SEQ ID NO: 49586 - RNA, 20 nt, Artificial Sequence
  Synthetic
gcgcaugcuaaugggguucu

SEQ ID NO: 49587 - RNA, 20 nt, Artificial Sequence
  Synthetic
guucuuggaguacacccggu

SEQ ID NO: 49588 - RNA, 17 nt, Artificial Sequence
  Synthetic
cgggugguccggggaaa

SEQ ID NO: 49589 - RNA, 17 nt, Artificial Sequence
  Synthetic
aagggguccguaaccaa

SEQ ID NO: 49590 - RNA, 17 nt, Artificial Sequence
  Synthetic
ccccccgccgacgcaga

SEQ ID NO: 49591 - RNA, 17 nt, Artificial Sequence
  Synthetic
acggggccgccccgaga

SEQ ID NO: 49592 - RNA, 17 nt, Artificial Sequence
  Synthetic
cccccggcacggugaga

SEQ ID NO: 49593 - RNA, 17 nt, Artificial Sequence
  Synthetic
aacgggggggauuuaga

SEQ ID NO: 49594 - RNA, 17 nt, Artificial Sequence
  Synthetic
cccggcacugcgagcga

SEQ ID NO: 49595 - RNA, 17 nt, Artificial Sequence
  Synthetic
acccucugggggggcga

SEQ ID NO: 49596 - RNA, 17 nt, Artificial Sequence
  Synthetic
cagaccaccuuugguua

SEQ ID NO: 49597 - RNA, 17 nt, Artificial Sequence
  Synthetic
cggcccgaccgucacac

SEQ ID NO: 49598 - RNA, 17 nt, Artificial Sequence
  Synthetic
cuuuuccccggaccacc

SEQ ID NO: 49599 - RNA, 17 nt, Artificial Sequence
  Synthetic
cgaucagcccacccacc

SEQ ID NO: 49600 - RNA, 17 nt, Artificial Sequence
  Synthetic
cggggcugccuuauacc

SEQ ID NO: 49601 - RNA, 17 nt, Artificial Sequence
  Synthetic
ucgagucuacccuaccc

SEQ ID NO: 49602 - RNA, 17 nt, Artificial Sequence
  Synthetic
ccgccgcggcagacccc

SEQ ID NO: 49603 - RNA, 17 nt, Artificial Sequence
  Synthetic
uugacggggccgacccc

SEQ ID NO: 49604 - RNA, 17 nt, Artificial Sequence
  Synthetic
cccccgaccgcuuaagc

SEQ ID NO: 49605 - RNA, 17 nt, Artificial Sequence
  Synthetic
agagccucgcgcgccgc

SEQ ID NO: 49606 - RNA, 17 nt, Artificial Sequence
  Synthetic
cacgggggacacggcgc

SEQ ID NO: 49607 - RNA, 17 nt, Artificial Sequence
  Synthetic
cgaccgcuuaagcgggc

SEQ ID NO: 49608 - RNA, 17 nt, Artificial Sequence
  Synthetic
uccgucgcucgcagugc

SEQ ID NO: 49609 - RNA, 17 nt, Artificial Sequence
  Synthetic
cgcggucucucucuugc

SEQ ID NO: 49610 - RNA, 17 nt, Artificial Sequence
  Synthetic
ucgcgggcggugggcuc

SEQ ID NO: 49611 - RNA, 17 nt, Artificial Sequence
  Synthetic
agccccgugugacgguc

SEQ ID NO: 49612 - RNA, 17 nt, Artificial Sequence
  Synthetic
cgcccccccagaggguc

SEQ ID NO: 49613 - RNA, 17 nt, Artificial Sequence
  Synthetic
ucccccgaccgcuuaag

SEQ ID NO: 49614 - RNA, 17 nt, Artificial Sequence
  Synthetic
cccccggcccgcuuaag

SEQ ID NO: 49615 - RNA, 17 nt, Artificial Sequence
  Synthetic
cacugcgagcgacggag

SEQ ID NO: 49616 - RNA, 17 nt, Artificial Sequence
  Synthetic
acccccggcacggugag

SEQ ID NO: 49617 - RNA, 17 nt, Artificial Sequence
  Synthetic
caacgggggggauuuag

SEQ ID NO: 49618 - RNA, 17 nt, Artificial Sequence
  Synthetic
ugcuugacaaagcaacg

SEQ ID NO: 49619 - RNA, 17 nt, Artificial Sequence
  Synthetic
aguggugcccgcccccg

SEQ ID NO: 49620 - RNA, 17 nt, Artificial Sequence
  Synthetic
cacccgguugguccccg

SEQ ID NO: 49621 - RNA, 17 nt, Artificial Sequence
  Synthetic
cucgagacggcggcccg

SEQ ID NO: 49622 - RNA, 17 nt, Artificial Sequence
  Synthetic
accgcuuaagcgggccg

SEQ ID NO: 49623 - RNA, 17 nt, Artificial Sequence
  Synthetic
cgucgcucgcagugccg

SEQ ID NO: 49624 - RNA, 17 nt, Artificial Sequence
  Synthetic
cgcagccgggugguccg

SEQ ID NO: 49625 - RNA, 17 nt, Artificial Sequence
  Synthetic
acgggggacacggcgcg

SEQ ID NO: 49626 - RNA, 17 nt, Artificial Sequence
  Synthetic
acacgggggacacggcg

SEQ ID NO: 49627 - RNA, 17 nt, Artificial Sequence
  Synthetic
ucccaucugcgucggcg

SEQ ID NO: 49628 - RNA, 17 nt, Artificial Sequence
  Synthetic
cgcgggcggugggcucg

SEQ ID NO: 49629 - RNA, 17 nt, Artificial Sequence
  Synthetic
cggcgcacggcccacgg

SEQ ID NO: 49630 - RNA, 17 nt, Artificial Sequence
  Synthetic
acucagggccgcgccgg

SEQ ID NO: 49631 - RNA, 17 nt, Artificial Sequence
  Synthetic
ccgcuuaagcgggccgg

SEQ ID NO: 49632 - RNA, 17 nt, Artificial Sequence
  Synthetic
ugcgagcgacggagcgg

SEQ ID NO: 49633 - RNA, 17 nt, Artificial Sequence
  Synthetic
cccaucugcgucggcgg

SEQ ID NO: 49634 - RNA, 17 nt, Artificial Sequence
  Synthetic
acucccaucugcgucgg

SEQ ID NO: 49635 - RNA, 17 nt, Artificial Sequence
  Synthetic
cccgcuuaagcggucgg

SEQ ID NO: 49636 - RNA, 17 nt, Artificial Sequence
  Synthetic
cccccccagagggucgg

SEQ ID NO: 49637 - RNA, 17 nt, Artificial Sequence
  Synthetic
ucugcgucggcgggggg

SEQ ID NO: 49638 - RNA, 17 nt, Artificial Sequence
  Synthetic
aaaugccgccccuuugg

SEQ ID NO: 49639 - RNA, 17 nt, Artificial Sequence
  Synthetic
cccccgccgacgcagau

SEQ ID NO: 49640 - RNA, 17 nt, Artificial Sequence
  Synthetic
ccggggcgcgcggcuau

SEQ ID NO: 49641 - RNA, 17 nt, Artificial Sequence
  Synthetic
cagccccgugugacggu

SEQ ID NO: 49642 - RNA, 17 nt, Artificial Sequence
  Synthetic
cggcccgcuuaagcggu

SEQ ID NO: 49643 - RNA, 17 nt, Artificial Sequence
  Synthetic
cucgcgcgccgccgggu

SEQ ID NO: 49644 - RNA, 17 nt, Artificial Sequence
  Synthetic
accacccggcugcgggu

SEQ ID NO: 49645 - RNA, 17 nt, Artificial Sequence
  Synthetic
uuaagcgggccgggggu

SEQ ID NO: 49646 - RNA, 17 nt, Artificial Sequence
  Synthetic
cgcgccgccgggugggu

SEQ ID NO: 49647 - RNA, 17 nt, Artificial Sequence
  Synthetic
cggggcgcgcggcuauu

SEQ ID NO: 49648 - RNA, 17 nt, Artificial Sequence
  Synthetic
aggacgcagaccaccuu

SEQ ID NO: 49649 - RNA, 17 nt, Artificial Sequence
  Synthetic
cguaaaugccgccccuu

SEQ ID NO: 49650 - RNA, 20 nt, Artificial Sequence
  Synthetic
agaaagggguccguaaccaa

SEQ ID NO: 49651 - RNA, 20 nt, Artificial Sequence
  Synthetic
ccgcugcuuuuuguucggaa

SEQ ID NO: 49652 - RNA, 20 nt, Artificial Sequence
  Synthetic
cggggggcggcgcaugcuaa

SEQ ID NO: 49653 - RNA, 20 nt, Artificial Sequence
  Synthetic
aaugcggcccgaccgucaca

SEQ ID NO: 49654 - RNA, 20 nt, Artificial Sequence
  Synthetic
ccgggggcgggcaccacuca

SEQ ID NO: 49655 - RNA, 20 nt, Artificial Sequence
  Synthetic
ccgccccccgccgacgcaga

SEQ ID NO: 49656 - RNA, 20 nt, Artificial Sequence
  Synthetic
agacccccggcacggugaga

SEQ ID NO: 49657 - RNA, 20 nt, Artificial Sequence
  Synthetic
agcaacgggggggauuuaga

SEQ ID NO: 49658 - RNA, 20 nt, Artificial Sequence
  Synthetic
cccgcugcuuuuuguucgga

SEQ ID NO: 49659 - RNA, 20 nt, Artificial Sequence
  Synthetic
acccgguugguccccgggga

SEQ ID NO: 49660 - RNA, 20 nt, Artificial Sequence
  Synthetic
uauaaggcagccccguguga

SEQ ID NO: 49661 - RNA, 20 nt, Artificial Sequence
  Synthetic
ucgggggcggggacgcuuga

SEQ ID NO: 49662 - RNA, 20 nt, Artificial Sequence
  Synthetic
augcggcccgaccgucacac

SEQ ID NO: 49663 - RNA, 20 nt, Artificial Sequence
  Synthetic
cgggggcggggacgcuugac

SEQ ID NO: 49664 - RNA, 20 nt, Artificial Sequence
  Synthetic
cccguccccggggaccaacc

SEQ ID NO: 49665 - RNA, 20 nt, Artificial Sequence
  Synthetic
acacggggcugccuuauacc

SEQ ID NO: 49666 - RNA, 20 nt, Artificial Sequence
  Synthetic
cgcuugacggggccgacccc

SEQ ID NO: 49667 - RNA, 20 nt, Artificial Sequence
  Synthetic
cacggugagagggcgacccc

SEQ ID NO: 49668 - RNA, 20 nt, Artificial Sequence
  Synthetic
aucggccccuauuggucccc

SEQ ID NO: 49669 - RNA, 20 nt, Artificial Sequence
  Synthetic
aguacacccgguuggucccc

SEQ ID NO: 49670 - RNA, 20 nt, Artificial Sequence
  Synthetic
cucggggccgggguccgccc

SEQ ID NO: 49671 - RNA, 20 nt, Artificial Sequence
  Synthetic
ccggcccggcacgagcuccc

SEQ ID NO: 49672 - RNA, 20 nt, Artificial Sequence
  Synthetic
ugggggaguggauaggcgcc

SEQ ID NO: 49673 - RNA, 20 nt, Artificial Sequence
  Synthetic
cccgaccgcuuaagcgggcc

SEQ ID NO: 49674 - RNA, 20 nt, Artificial Sequence
  Synthetic
aaagcagcgggcggggggcc

SEQ ID NO: 49675 - RNA, 20 nt, Artificial Sequence
  Synthetic
cgcagagccucgcgcgccgc

SEQ ID NO: 49676 - RNA, 20 nt, Artificial Sequence
  Synthetic
uugggggaguggauaggcgc

SEQ ID NO: 49677 - RNA, 20 nt, Artificial Sequence
  Synthetic
caauagccgcgcgccccggc

SEQ ID NO: 49678 - RNA, 20 nt, Artificial Sequence
  Synthetic
cccgggagcucgugccgggc

SEQ ID NO: 49679 - RNA, 20 nt, Artificial Sequence
  Synthetic
ccccgaccgcuuaagcgggc

SEQ ID NO: 49680 - RNA, 20 nt, Artificial Sequence
  Synthetic
uccccggaccacccggcugc

SEQ ID NO: 49681 - RNA, 20 nt, Artificial Sequence
  Synthetic
cgcuccgucgcucgcagugc

SEQ ID NO: 49682 - RNA, 20 nt, Artificial Sequence
  Synthetic
cccgggggcgggcaccacuc

SEQ ID NO: 49683 - RNA, 20 nt, Artificial Sequence
  Synthetic
cccggcccgcuuaagcgguc

SEQ ID NO: 49684 - RNA, 20 nt, Artificial Sequence
  Synthetic
caacccgcagccgggugguc

SEQ ID NO: 49685 - RNA, 20 nt, Artificial Sequence
  Synthetic
cgcugcuuuuuguucggaag

SEQ ID NO: 49686 - RNA, 20 nt, Artificial Sequence
  Synthetic
cgacccccggcccgcuuaag

SEQ ID NO: 49687 - RNA, 20 nt, Artificial Sequence
  Synthetic
uagcauacuaggaagcccag

SEQ ID NO: 49688 - RNA, 20 nt, Artificial Sequence
  Synthetic
cccuuccgaacaaaaagcag

SEQ ID NO: 49689 - RNA, 20 nt, Artificial Sequence
  Synthetic
cggcacugcgagcgacggag

SEQ ID NO: 49690 - RNA, 20 nt, Artificial Sequence
  Synthetic
ugcggcccgaccgucacacg

SEQ ID NO: 49691 - RNA, 20 nt, Artificial Sequence
  Synthetic
ccgguugguccccggggacg

SEQ ID NO: 49692 - RNA, 20 nt, Artificial Sequence
  Synthetic
acccggcaagagagagaccg

SEQ ID NO: 49693 - RNA, 20 nt, Artificial Sequence
  Synthetic
aagcggucgggggacccccg

SEQ ID NO: 49694 - RNA, 20 nt, Artificial Sequence
  Synthetic
agacucgagacggcggcccg

SEQ ID NO: 49695 - RNA, 20 nt, Artificial Sequence
  Synthetic
cgggagcucgugccgggccg

SEQ ID NO: 49696 - RNA, 20 nt, Artificial Sequence
  Synthetic
ccgaccgcuuaagcgggccg

SEQ ID NO: 49697 - RNA, 20 nt, Artificial Sequence
  Synthetic
accgugccgggggucugccg

SEQ ID NO: 49698 - RNA, 20 nt, Artificial Sequence
  Synthetic
cuccgucgcucgcagugccg

SEQ ID NO: 49699 - RNA, 20 nt, Artificial Sequence
  Synthetic
acccgcagccgggugguccg

SEQ ID NO: 49700 - RNA, 20 nt, Artificial Sequence
  Synthetic
aauagccgcgcgccccggcg

SEQ ID NO: 49701 - RNA, 20 nt, Artificial Sequence
  Synthetic
cgaacaaaaagcagcgggcg

SEQ ID NO: 49702 - RNA, 20 nt, Artificial Sequence
  Synthetic
cccgacccucugggggggcg

SEQ ID NO: 49703 - RNA, 20 nt, Artificial Sequence
  Synthetic
ccggcccgcuuaagcggucg

SEQ ID NO: 49704 - RNA, 20 nt, Artificial Sequence
  Synthetic
cucgcccccccagagggucg

SEQ ID NO: 49705 - RNA, 20 nt, Artificial Sequence
  Synthetic
aagggguccguaaccaaagg

SEQ ID NO: 49706 - RNA, 20 nt, Artificial Sequence
  Synthetic
ccaauagccgcgcgccccgg

SEQ ID NO: 49707 - RNA, 20 nt, Artificial Sequence
  Synthetic
accacucagggccgcgccgg

SEQ ID NO: 49708 - RNA, 20 nt, Artificial Sequence
  Synthetic
cgaccgcuuaagcgggccgg

SEQ ID NO: 49709 - RNA, 20 nt, Artificial Sequence
  Synthetic
ucgcccucucaccgugccgg

SEQ ID NO: 49710 - RNA, 20 nt, Artificial Sequence
  Synthetic
cacugcgagcgacggagcgg

SEQ ID NO: 49711 - RNA, 20 nt, Artificial Sequence
  Synthetic
acucccaucugcgucggcgg

SEQ ID NO: 49712 - RNA, 20 nt, Artificial Sequence
  Synthetic
cggcccgcuuaagcggucgg

SEQ ID NO: 49713 - RNA, 20 nt, Artificial Sequence
  Synthetic
ucgcccccccagagggucgg

SEQ ID NO: 49714 - RNA, 20 nt, Artificial Sequence
  Synthetic
acggggccgccccgagaggg

SEQ ID NO: 49715 - RNA, 20 nt, Artificial Sequence
  Synthetic
cugcuugacaaagcaacggg

SEQ ID NO: 49716 - RNA, 20 nt, Artificial Sequence
  Synthetic
acccccaacccgcagccggg

SEQ ID NO: 49717 - RNA, 20 nt, Artificial Sequence
  Synthetic
uccgaacaaaaagcagcggg

SEQ ID NO: 49718 - RNA, 20 nt, Artificial Sequence
  Synthetic
cucccaucugcgucggcggg

SEQ ID NO: 49719 - RNA, 20 nt, Artificial Sequence
  Synthetic
cgcccccccagagggucggg

SEQ ID NO: 49720 - RNA, 20 nt, Artificial Sequence
  Synthetic
ugcuuuuuguucggaagggg

SEQ ID NO: 49721 - RNA, 20 nt, Artificial Sequence
  Synthetic
cggggccgccccgagagggg

SEQ ID NO: 49722 - RNA, 20 nt, Artificial Sequence
  Synthetic
ugcuugacaaagcaacgggg

SEQ ID NO: 49723 - RNA, 20 nt, Artificial Sequence
  Synthetic
aaugaauuucuccccggggg

SEQ ID NO: 49724 - RNA, 20 nt, Artificial Sequence
  Synthetic
cguaaaugccgccccuuugg

SEQ ID NO: 49725 - RNA, 20 nt, Artificial Sequence
  Synthetic
uuuagagggcgcggggcgug

SEQ ID NO: 49726 - RNA, 20 nt, Artificial Sequence
  Synthetic
ucguaaaugccgccccuuug

SEQ ID NO: 49727 - RNA, 20 nt, Artificial Sequence
  Synthetic
cgccccccgccgacgcagau

SEQ ID NO: 49728 - RNA, 20 nt, Artificial Sequence
  Synthetic
cgccgggugggugggcugau

SEQ ID NO: 49729 - RNA, 20 nt, Artificial Sequence
  Synthetic
ccgccggggcgcgcggcuau

SEQ ID NO: 49730 - RNA, 20 nt, Artificial Sequence
  Synthetic
agcggucgggggacccccgu

SEQ ID NO: 49731 - RNA, 20 nt, Artificial Sequence
  Synthetic
ccccggcccgcuuaagcggu

SEQ ID NO: 49732 - RNA, 20 nt, Artificial Sequence
  Synthetic
cgcuuaagcgggccgggggu

SEQ ID NO: 49733 - RNA, 20 nt, Artificial Sequence
  Synthetic
ucgcgcgccgccgggugggu

SEQ ID NO: 49734 - RNA, 20 nt, Artificial Sequence
  Synthetic
cgccggggcgcgcggcuauu

SEQ ID NO: 49735 - RNA, 20 nt, Artificial Sequence
  Synthetic
aaucguaaaugccgccccuu

SEQ ID NO: 49736 - RNA, 20 nt, Artificial Sequence
  Synthetic
caaagguggucugcguccuu

SEQ ID NO: 49737 - RNA, 20 nt, Artificial Sequence
  Synthetic
cccgcccgcugcuuuuuguu

SEQ ID NO: 49738 - RNA, 20 nt, Artificial Sequence
  Synthetic
aucguaaaugccgccccuuu

SEQ ID NO: 49739 - RNA, 17 nt, Artificial Sequence
  Synthetic
gaggggucggaauccaa

SEQ ID NO: 49740 - RNA, 17 nt, Artificial Sequence
  Synthetic
gcugcuugacaaagcaa

SEQ ID NO: 49741 - RNA, 17 nt, Artificial Sequence
  Synthetic
ggggugagggagggaca

SEQ ID NO: 49742 - RNA, 17 nt, Artificial Sequence
  Synthetic
gagggacacgggggaca

SEQ ID NO: 49743 - RNA, 17 nt, Artificial Sequence
  Synthetic
gcauacuaggaagccca

SEQ ID NO: 49744 - RNA, 17 nt, Artificial Sequence
  Synthetic
gggcggcgcacggccca

SEQ ID NO: 49745 - RNA, 17 nt, Artificial Sequence
  Synthetic
ggucggggggcggcgca

SEQ ID NO: 49746 - RNA, 17 nt, Artificial Sequence
  Synthetic
ggggggcgagggaggca

SEQ ID NO: 49747 - RNA, 17 nt, Artificial Sequence
  Synthetic
gcggcagacccccggca

SEQ ID NO: 49748 - RNA, 17 nt, Artificial Sequence
  Synthetic
gacagggggggagacga

SEQ ID NO: 49749 - RNA, 17 nt, Artificial Sequence
  Synthetic
gccccggcgggggcgga

SEQ ID NO: 49750 - RNA, 17 nt, Artificial Sequence
  Synthetic
gcugcuuuuuguucgga

SEQ ID NO: 49751 - RNA, 17 nt, Artificial Sequence
  Synthetic
ggggccggggugaggga

SEQ ID NO: 49752 - RNA, 17 nt, Artificial Sequence
  Synthetic
gcggggggccgggguga

SEQ ID NO: 49753 - RNA, 17 nt, Artificial Sequence
  Synthetic
ggggcggggacgcuuga

SEQ ID NO: 49754 - RNA, 17 nt, Artificial Sequence
  Synthetic
gggugagggagggacac

SEQ ID NO: 49755 - RNA, 17 nt, Artificial Sequence
  Synthetic
guccccggggaccaacc

SEQ ID NO: 49756 - RNA, 17 nt, Artificial Sequence
  Synthetic
gguucuuggaguacacc

SEQ ID NO: 49757 - RNA, 17 nt, Artificial Sequence
  Synthetic
ggcgggaggaggagacc

SEQ ID NO: 49758 - RNA, 17 nt, Artificial Sequence
  Synthetic
gugucccucccucaccc

SEQ ID NO: 49759 - RNA, 17 nt, Artificial Sequence
  Synthetic
gggggggccugagaccc

SEQ ID NO: 49760 - RNA, 17 nt, Artificial Sequence
  Synthetic
ggugagagggcgacccc

SEQ ID NO: 49761 - RNA, 17 nt, Artificial Sequence
  Synthetic
gaguggugcccgccccc

SEQ ID NO: 49762 - RNA, 17 nt, Artificial Sequence
  Synthetic
gcagaugggaguccccc

SEQ ID NO: 49763 - RNA, 17 nt, Artificial Sequence
  Synthetic
ggggcggccccgucccc

SEQ ID NO: 49764 - RNA, 17 nt, Artificial Sequence
  Synthetic
ggccccuauuggucccc

SEQ ID NO: 49765 - RNA, 17 nt, Artificial Sequence
  Synthetic
ggggccgggguccgccc

SEQ ID NO: 49766 - RNA, 17 nt, Artificial Sequence
  Synthetic
gcccggcacgagcuccc

SEQ ID NO: 49767 - RNA, 17 nt, Artificial Sequence
  Synthetic
gcuaaugaauuucuccc

SEQ ID NO: 49768 - RNA, 17 nt, Artificial Sequence
  Synthetic
ggucuccuccucccgcc

SEQ ID NO: 49769 - RNA, 17 nt, Artificial Sequence
  Synthetic
gagccucgcgcgccgcc

SEQ ID NO: 49770 - RNA, 17 nt, Artificial Sequence
  Synthetic
gcgacggagcggcggcc

SEQ ID NO: 49771 - RNA, 17 nt, Artificial Sequence
  Synthetic
ggagcucgugccgggcc

SEQ ID NO: 49772 - RNA, 17 nt, Artificial Sequence
  Synthetic
ggcggccgcucggggcc

SEQ ID NO: 49773 - RNA, 17 nt, Artificial Sequence
  Synthetic
gcagcgggcggggggcc

SEQ ID NO: 49774 - RNA, 17 nt, Artificial Sequence
  Synthetic
gcccgggagcucgugcc

SEQ ID NO: 49775 - RNA, 17 nt, Artificial Sequence
  Synthetic
gcggucucucucuugcc

SEQ ID NO: 49776 - RNA, 17 nt, Artificial Sequence
  Synthetic
gggaggagcccgagagc

SEQ ID NO: 49777 - RNA, 17 nt, Artificial Sequence
  Synthetic
ggcaagagagagaccgc

SEQ ID NO: 49778 - RNA, 17 nt, Artificial Sequence
  Synthetic
gggucuccuccucccgc

SEQ ID NO: 49779 - RNA, 17 nt, Artificial Sequence
  Synthetic
ggggaguggauaggcgc

SEQ ID NO: 49780 - RNA, 17 nt, Artificial Sequence
  Synthetic
ggguuggggguggucgc

SEQ ID NO: 49781 - RNA, 17 nt, Artificial Sequence
  Synthetic
gggggggcgagggaggc

SEQ ID NO: 49782 - RNA, 17 nt, Artificial Sequence
  Synthetic
ggcgcggggcgugaggc

SEQ ID NO: 49783 - RNA, 17 nt, Artificial Sequence
  Synthetic
gcggugggcucgggggc

SEQ ID NO: 49784 - RNA, 17 nt, Artificial Sequence
  Synthetic
gggggcgggcaccacuc

SEQ ID NO: 49785 - RNA, 17 nt, Artificial Sequence
  Synthetic
gccgccccccgacccuc

SEQ ID NO: 49786 - RNA, 17 nt, Artificial Sequence
  Synthetic
gggaaucccccccucuc

SEQ ID NO: 49787 - RNA, 17 nt, Artificial Sequence
  Synthetic
ggugguccggggaaaag

SEQ ID NO: 49788 - RNA, 17 nt, Artificial Sequence
  Synthetic
ggaagggggggagaaag

SEQ ID NO: 49789 - RNA, 17 nt, Artificial Sequence
  Synthetic
gacggggccgccccgag

SEQ ID NO: 49790 - RNA, 17 nt, Artificial Sequence
  Synthetic
gccggcgcggcccugag

SEQ ID NO: 49791 - RNA, 17 nt, Artificial Sequence
  Synthetic
gcccaggggaccaauag

SEQ ID NO: 49792 - RNA, 17 nt, Artificial Sequence
  Synthetic
ggugagggagggacacg

SEQ ID NO: 49793 - RNA, 17 nt, Artificial Sequence
  Synthetic
gcggcgcacggcccacg

SEQ ID NO: 49794 - RNA, 17 nt, Artificial Sequence
  Synthetic
ggacagggggggagacg

SEQ ID NO: 49795 - RNA, 17 nt, Artificial Sequence
  Synthetic
guugguccccggggacg

SEQ ID NO: 49796 - RNA, 17 nt, Artificial Sequence
  Synthetic
ggggggccugagacccg

SEQ ID NO: 49797 - RNA, 17 nt, Artificial Sequence
  Synthetic
gggcggccccguccccg

SEQ ID NO: 49798 - RNA, 17 nt, Artificial Sequence
  Synthetic
gccccgagcggccgccg

SEQ ID NO: 49799 - RNA, 17 nt, Artificial Sequence
  Synthetic
gcgccggcggggcgccg

SEQ ID NO: 49800 - RNA, 17 nt, Artificial Sequence
  Synthetic
gcggccgcucggggccg

SEQ ID NO: 49801 - RNA, 17 nt, Artificial Sequence
  Synthetic
gugccgggggucugccg

SEQ ID NO: 49802 - RNA, 17 nt, Artificial Sequence
  Synthetic
ggaggagcccgagagcg

SEQ ID NO: 49803 - RNA, 17 nt, Artificial Sequence
  Synthetic
gcccccgccggggcgcg

SEQ ID NO: 49804 - RNA, 17 nt, Artificial Sequence
  Synthetic
gacccucugggggggcg

SEQ ID NO: 49805 - RNA, 17 nt, Artificial Sequence
  Synthetic
gccgcggcggccgcucg

SEQ ID NO: 49806 - RNA, 17 nt, Artificial Sequence
  Synthetic
gcccccccagagggucg

SEQ ID NO: 49807 - RNA, 17 nt, Artificial Sequence
  Synthetic
gugguccggggaaaagg

SEQ ID NO: 49808 - RNA, 17 nt, Artificial Sequence
  Synthetic
gcuuuuuguucggaagg

SEQ ID NO: 49809 - RNA, 17 nt, Artificial Sequence
  Synthetic
ggggccgccccgagagg

SEQ ID NO: 49810 - RNA, 17 nt, Artificial Sequence
  Synthetic
ggcggcccggcgggagg

SEQ ID NO: 49811 - RNA, 17 nt, Artificial Sequence
  Synthetic
gggcgcggggcgugagg

SEQ ID NO: 49812 - RNA, 17 nt, Artificial Sequence
  Synthetic
gcuugacaaagcaacgg

SEQ ID NO: 49813 - RNA, 17 nt, Artificial Sequence
  Synthetic
gugagggagggacacgg

SEQ ID NO: 49814 - RNA, 17 nt, Artificial Sequence
  Synthetic
gggggccugagacccgg

SEQ ID NO: 49815 - RNA, 17 nt, Artificial Sequence
  Synthetic
gaggagcccgagagcgg

SEQ ID NO: 49816 - RNA, 17 nt, Artificial Sequence
  Synthetic
gccgcgcgccccggcgg

SEQ ID NO: 49817 - RNA, 17 nt, Artificial Sequence
  Synthetic
gggguggucgcgggcgg

SEQ ID NO: 49818 - RNA, 17 nt, Artificial Sequence
  Synthetic
gcgggcggugggcucgg

SEQ ID NO: 49819 - RNA, 17 nt, Artificial Sequence
  Synthetic
gagagcgggggacaggg

SEQ ID NO: 49820 - RNA, 17 nt, Artificial Sequence
  Synthetic
gggcgagggaggcaggg

SEQ ID NO: 49821 - RNA, 17 nt, Artificial Sequence
  Synthetic
gggccgccccgagaggg

SEQ ID NO: 49822 - RNA, 17 nt, Artificial Sequence
  Synthetic
gggggccggggugaggg

SEQ ID NO: 49823 - RNA, 17 nt, Artificial Sequence
  Synthetic
gccggcggggcgccggg

SEQ ID NO: 49824 - RNA, 17 nt, Artificial Sequence
  Synthetic
gaacaaaaagcagcggg

SEQ ID NO: 49825 - RNA, 17 nt, Artificial Sequence
  Synthetic
gguccggggaaaagggg

SEQ ID NO: 49826 - RNA, 17 nt, Artificial Sequence
  Synthetic
ggccgccccgagagggg

SEQ ID NO: 49827 - RNA, 17 nt, Artificial Sequence
  Synthetic
gaauuucuccccggggg

SEQ ID NO: 49828 - RNA, 17 nt, Artificial Sequence
  Synthetic
gcgcgccccggcggggg

SEQ ID NO: 49829 - RNA, 17 nt, Artificial Sequence
  Synthetic
ggcggugggcucggggg

SEQ ID NO: 49830 - RNA, 17 nt, Artificial Sequence
  Synthetic
gcgcgccgccggguggg

SEQ ID NO: 49831 - RNA, 17 nt, Artificial Sequence
  Synthetic
gccccccgacccucugg

SEQ ID NO: 49832 - RNA, 17 nt, Artificial Sequence
  Synthetic
gggcgcgcggcuauugg

SEQ ID NO: 49833 - RNA, 17 nt, Artificial Sequence
  Synthetic
gugccggggugcgaaug

SEQ ID NO: 49834 - RNA, 17 nt, Artificial Sequence
  Synthetic
ggcggggggccggggug

SEQ ID NO: 49835 - RNA, 17 nt, Artificial Sequence
  Synthetic
gccccuauugguccccu

SEQ ID NO: 49836 - RNA, 17 nt, Artificial Sequence
  Synthetic
gucgcgggcggugggcu

SEQ ID NO: 49837 - RNA, 17 nt, Artificial Sequence
  Synthetic
ggguggucgcgggcggu

SEQ ID NO: 49838 - RNA, 17 nt, Artificial Sequence
  Synthetic
ggggggagacgaggggu

SEQ ID NO: 49839 - RNA, 17 nt, Artificial Sequence
  Synthetic
gcccgcugcuuuuuguu

SEQ ID NO: 49840 - RNA, 17 nt, Artificial Sequence
  Synthetic
guaaaugccgccccuuu

SEQ ID NO: 49841 - RNA, 20 nt, Artificial Sequence
  Synthetic
gccggggugagggagggaca

SEQ ID NO: 49842 - RNA, 20 nt, Artificial Sequence
  Synthetic
gagcccgagagcgggggaca

SEQ ID NO: 49843 - RNA, 20 nt, Artificial Sequence
  Synthetic
gagggucggggggcggcgca

SEQ ID NO: 49844 - RNA, 20 nt, Artificial Sequence
  Synthetic
gccucccucgcccccccaga

SEQ ID NO: 49845 - RNA, 20 nt, Artificial Sequence
  Synthetic
gggacggggccgccccgaga

SEQ ID NO: 49846 - RNA, 20 nt, Artificial Sequence
  Synthetic
gggguaggguagacucgaga

SEQ ID NO: 49847 - RNA, 20 nt, Artificial Sequence
  Synthetic
ggggacagggggggagacga

SEQ ID NO: 49848 - RNA, 20 nt, Artificial Sequence
  Synthetic
gagagacagagacuaaaacc

SEQ ID NO: 49849 - RNA, 20 nt, Artificial Sequence
  Synthetic
ggccgaucagcccacccacc

SEQ ID NO: 49850 - RNA, 20 nt, Artificial Sequence
  Synthetic
gcagagccucgcgcgccgcc

SEQ ID NO: 49851 - RNA, 20 nt, Artificial Sequence
  Synthetic
gcucggggccgggguccgcc

SEQ ID NO: 49852 - RNA, 20 nt, Artificial Sequence
  Synthetic
ggccgcgccggcggggcgcc

SEQ ID NO: 49853 - RNA, 20 nt, Artificial Sequence
  Synthetic
gcuccgucgcucgcagugcc

SEQ ID NO: 49854 - RNA, 20 nt, Artificial Sequence
  Synthetic
guuuuagucucugucucucc

SEQ ID NO: 49855 - RNA, 20 nt, Artificial Sequence
  Synthetic
ggucccccgaccgcuuaagc

SEQ ID NO: 49856 - RNA, 20 nt, Artificial Sequence
  Synthetic
gaccacccccaacccgcagc

SEQ ID NO: 49857 - RNA, 20 nt, Artificial Sequence
  Synthetic
gcagggaggagcccgagagc

SEQ ID NO: 49858 - RNA, 20 nt, Artificial Sequence
  Synthetic
gggccgcgccggcggggcgc

SEQ ID NO: 49859 - RNA, 20 nt, Artificial Sequence
  Synthetic
gagggcgcggggcgugaggc

SEQ ID NO: 49860 - RNA, 20 nt, Artificial Sequence
  Synthetic
ggagggaaucccccccucuc

SEQ ID NO: 49861 - RNA, 20 nt, Artificial Sequence
  Synthetic
gguuuuagucucugucucuc

SEQ ID NO: 49862 - RNA, 20 nt, Artificial Sequence
  Synthetic
gccuauccacucccccaaag

SEQ ID NO: 49863 - RNA, 20 nt, Artificial Sequence
  Synthetic
ggacggggccgccccgagag

SEQ ID NO: 49864 - RNA, 20 nt, Artificial Sequence
  Synthetic
ggcagggaggagcccgagag

SEQ ID NO: 49865 - RNA, 20 nt, Artificial Sequence
  Synthetic
gggacagggggggagacgag

SEQ ID NO: 49866 - RNA, 20 nt, Artificial Sequence
  Synthetic
gaagcccaggggaccaauag

SEQ ID NO: 49867 - RNA, 20 nt, Artificial Sequence
  Synthetic
ggcugcuugacaaagcaacg

SEQ ID NO: 49868 - RNA, 20 nt, Artificial Sequence
  Synthetic
gggggacagggggggagacg

SEQ ID NO: 49869 - RNA, 20 nt, Artificial Sequence
  Synthetic
gggggcggggacgcuugacg

SEQ ID NO: 49870 - RNA, 20 nt, Artificial Sequence
  Synthetic
gccgcgccggcggggcgccg

SEQ ID NO: 49871 - RNA, 20 nt, Artificial Sequence
  Synthetic
gcggcggccgcucggggccg

SEQ ID NO: 49872 - RNA, 20 nt, Artificial Sequence
  Synthetic
gacacgggggacacggcgcg

SEQ ID NO: 49873 - RNA, 20 nt, Artificial Sequence
  Synthetic
gggacacgggggacacggcg

SEQ ID NO: 49874 - RNA, 20 nt, Artificial Sequence
  Synthetic
gacucccaucugcgucggcg

SEQ ID NO: 49875 - RNA, 20 nt, Artificial Sequence
  Synthetic
gggcggugggcucgggggcg

SEQ ID NO: 49876 - RNA, 20 nt, Artificial Sequence
  Synthetic
gcugcuuuuuguucggaagg

SEQ ID NO: 49877 - RNA, 20 nt, Artificial Sequence
  Synthetic
gacggggccgccccgagagg

SEQ ID NO: 49878 - RNA, 20 nt, Artificial Sequence
  Synthetic
ggggugagggagggacacgg

SEQ ID NO: 49879 - RNA, 20 nt, Artificial Sequence
  Synthetic
gaacaaaaagcagcgggcgg

SEQ ID NO: 49880 - RNA, 20 nt, Artificial Sequence
  Synthetic
gcgcgccccggcgggggcgg

SEQ ID NO: 49881 - RNA, 20 nt, Artificial Sequence
  Synthetic
gucgcgggcggugggcucgg

SEQ ID NO: 49882 - RNA, 20 nt, Artificial Sequence
  Synthetic
gggugguccggggaaaaggg

SEQ ID NO: 49883 - RNA, 20 nt, Artificial Sequence
  Synthetic
ggggggcgagggaggcaggg

SEQ ID NO: 49884 - RNA, 20 nt, Artificial Sequence
  Synthetic
gccccggcgggggcggaggg

SEQ ID NO: 49885 - RNA, 20 nt, Artificial Sequence
  Synthetic
gcggggggccggggugaggg

SEQ ID NO: 49886 - RNA, 20 nt, Artificial Sequence
  Synthetic
gcccggcacgagcucccggg

SEQ ID NO: 49887 - RNA, 20 nt, Artificial Sequence
  Synthetic
ggguuggggguggucgcggg

SEQ ID NO: 49888 - RNA, 20 nt, Artificial Sequence
  Synthetic
ggaaucccccccucucgggg

SEQ ID NO: 49889 - RNA, 20 nt, Artificial Sequence
  Synthetic
gccgcgcgccccggcggggg

SEQ ID NO: 49890 - RNA, 20 nt, Artificial Sequence
  Synthetic
gcgggcggugggcucggggg

SEQ ID NO: 49891 - RNA, 20 nt, Artificial Sequence
  Synthetic
gccgccccccgacccucugg

SEQ ID NO: 49892 - RNA, 20 nt, Artificial Sequence
  Synthetic
gcgggcggggggccggggug

SEQ ID NO: 49893 - RNA, 20 nt, Artificial Sequence
  Synthetic
gagaaauucauuagcauacu

SEQ ID NO: 49894 - RNA, 20 nt, Artificial Sequence
  Synthetic
ggucugccgcggcggccgcu

SEQ ID NO: 49895 - RNA, 20 nt, Artificial Sequence
  Synthetic
guggucgcgggcggugggcu

SEQ ID NO: 49896 - RNA, 20 nt, Artificial Sequence
  Synthetic
gcgccgccccccgacccucu

SEQ ID NO: 49897 - RNA, 20 nt, Artificial Sequence
  Synthetic
gggagggaaucccccccucu

SEQ ID NO: 49898 - RNA, 20 nt, Artificial Sequence
  Synthetic
ggggggacucccaucugcgu

SEQ ID NO: 49899 - RNA, 20 nt, Artificial Sequence
  Synthetic
ggaccacccggcugcggguu

SEQ ID NO: 49900 - RNA, 17 nt, Artificial Sequence
  Synthetic
cuauccacucccccaaa

SEQ ID NO: 49901 - RNA, 17 nt, Artificial Sequence
  Synthetic
cggaagggggggagaaa

SEQ ID NO: 49902 - RNA, 17 nt, Artificial Sequence
  Synthetic
ccuauccacucccccaa

SEQ ID NO: 49903 - RNA, 17 nt, Artificial Sequence
  Synthetic
ucggaagggggggagaa

SEQ ID NO: 49904 - RNA, 17 nt, Artificial Sequence
  Synthetic
cugcuuuuuguucggaa

SEQ ID NO: 49905 - RNA, 17 nt, Artificial Sequence
  Synthetic
cccgagagcgggggaca

SEQ ID NO: 49906 - RNA, 17 nt, Artificial Sequence
  Synthetic
ucccucgcccccccaga

SEQ ID NO: 49907 - RNA, 17 nt, Artificial Sequence
  Synthetic
cggcgggggcggaggga

SEQ ID NO: 49908 - RNA, 17 nt, Artificial Sequence
  Synthetic
cgguugguccccgggga

SEQ ID NO: 49909 - RNA, 17 nt, Artificial Sequence
  Synthetic
aaggcagccccguguga

SEQ ID NO: 49910 - RNA, 17 nt, Artificial Sequence
  Synthetic
agcccaggggaccaaua

SEQ ID NO: 49911 - RNA, 17 nt, Artificial Sequence
  Synthetic
cguccccggggaccaac

SEQ ID NO: 49912 - RNA, 17 nt, Artificial Sequence
  Synthetic
cugcuugacaaagcaac

SEQ ID NO: 49913 - RNA, 17 nt, Artificial Sequence
  Synthetic
agacagagacuaaaacc

SEQ ID NO: 49914 - RNA, 17 nt, Artificial Sequence
  Synthetic
agggggggccugagacc

SEQ ID NO: 49915 - RNA, 17 nt, Artificial Sequence
  Synthetic
agcucccgggcggaccc

SEQ ID NO: 49916 - RNA, 17 nt, Artificial Sequence
  Synthetic
ugaguggugcccgcccc

SEQ ID NO: 49917 - RNA, 17 nt, Artificial Sequence
  Synthetic
cuaaugaauuucucccc

SEQ ID NO: 49918 - RNA, 17 nt, Artificial Sequence
  Synthetic
acacccgguuggucccc

SEQ ID NO: 49919 - RNA, 17 nt, Artificial Sequence
  Synthetic
agcauacuaggaagccc

SEQ ID NO: 49920 - RNA, 17 nt, Artificial Sequence
  Synthetic
ccaauagccgcgcgccc

SEQ ID NO: 49921 - RNA, 17 nt, Artificial Sequence
  Synthetic
cggggcggccccguccc

SEQ ID NO: 49922 - RNA, 17 nt, Artificial Sequence
  Synthetic
uacacccgguugguccc

SEQ ID NO: 49923 - RNA, 17 nt, Artificial Sequence
  Synthetic
aggcccccccuuuuccc

SEQ ID NO: 49924 - RNA, 17 nt, Artificial Sequence
  Synthetic
acccccaacccgcagcc

SEQ ID NO: 49925 - RNA, 17 nt, Artificial Sequence
  Synthetic
cucccuccgcccccgcc

SEQ ID NO: 49926 - RNA, 17 nt, Artificial Sequence
  Synthetic
cggggccgggguccgcc

SEQ ID NO: 49927 - RNA, 17 nt, Artificial Sequence
  Synthetic
cgcgccggcggggcgcc

SEQ ID NO: 49928 - RNA, 17 nt, Artificial Sequence
  Synthetic
ccgucgcucgcagugcc

SEQ ID NO: 49929 - RNA, 17 nt, Artificial Sequence
  Synthetic
cgcccucucaccgugcc

SEQ ID NO: 49930 - RNA, 17 nt, Artificial Sequence
  Synthetic
uuagucucugucucucc

SEQ ID NO: 49931 - RNA, 17 nt, Artificial Sequence
  Synthetic
ccgcagccggguggucc

SEQ ID NO: 49932 - RNA, 17 nt, Artificial Sequence
  Synthetic
uccgaacaaaaagcagc

SEQ ID NO: 49933 - RNA, 17 nt, Artificial Sequence
  Synthetic
cacccccaacccgcagc

SEQ ID NO: 49934 - RNA, 17 nt, Artificial Sequence
  Synthetic
ccucccuccgcccccgc

SEQ ID NO: 49935 - RNA, 17 nt, Artificial Sequence
  Synthetic
uccccccggcgccccgc

SEQ ID NO: 49936 - RNA, 17 nt, Artificial Sequence
  Synthetic
accacucagggccgcgc

SEQ ID NO: 49937 - RNA, 17 nt, Artificial Sequence
  Synthetic
ccgcgccggcggggcgc

SEQ ID NO: 49938 - RNA, 17 nt, Artificial Sequence
  Synthetic
uagccgcgcgccccggc

SEQ ID NO: 49939 - RNA, 17 nt, Artificial Sequence
  Synthetic
cggagcggcggcccggc

SEQ ID NO: 49940 - RNA, 17 nt, Artificial Sequence
  Synthetic
cucagggccgcgccggc

SEQ ID NO: 49941 - RNA, 17 nt, Artificial Sequence
  Synthetic
cucccaucugcgucggc

SEQ ID NO: 49942 - RNA, 17 nt, Artificial Sequence
  Synthetic
aacaaaaagcagcgggc

SEQ ID NO: 49943 - RNA, 17 nt, Artificial Sequence
  Synthetic
cggcggccgcucggggc

SEQ ID NO: 49944 - RNA, 17 nt, Artificial Sequence
  Synthetic
aauuucuccccgggggc

SEQ ID NO: 49945 - RNA, 17 nt, Artificial Sequence
  Synthetic
agcagcgggcggggggc

SEQ ID NO: 49946 - RNA, 17 nt, Artificial Sequence
  Synthetic
ccggaccacccggcugc

SEQ ID NO: 49947 - RNA, 17 nt, Artificial Sequence
  Synthetic
ucgcccucucaccgugc

SEQ ID NO: 49948 - RNA, 17 nt, Artificial Sequence
  Synthetic
cgcccgggagcucgugc

SEQ ID NO: 49949 - RNA, 17 nt, Artificial Sequence
  Synthetic
ugccgcggcggccgcuc

SEQ ID NO: 49950 - RNA, 17 nt, Artificial Sequence
  Synthetic
cccugucccccgcucuc

SEQ ID NO: 49951 - RNA, 17 nt, Artificial Sequence
  Synthetic
uuuagucucugucucuc

SEQ ID NO: 49952 - RNA, 17 nt, Artificial Sequence
  Synthetic
cccgcagccgggugguc

SEQ ID NO: 49953 - RNA, 17 nt, Artificial Sequence
  Synthetic
uauccacucccccaaag

SEQ ID NO: 49954 - RNA, 17 nt, Artificial Sequence
  Synthetic
ugcuuuuuguucggaag

SEQ ID NO: 49955 - RNA, 17 nt, Artificial Sequence
  Synthetic
ccgagagcgggggacag

SEQ ID NO: 49956 - RNA, 17 nt, Artificial Sequence
  Synthetic
cucccucgcccccccag

SEQ ID NO: 49957 - RNA, 17 nt, Artificial Sequence
  Synthetic
cauacuaggaagcccag

SEQ ID NO: 49958 - RNA, 17 nt, Artificial Sequence
  Synthetic
uuccgaacaaaaagcag

SEQ ID NO: 49959 - RNA, 17 nt, Artificial Sequence
  Synthetic
cggggccgccccgagag

SEQ ID NO: 49960 - RNA, 17 nt, Artificial Sequence
  Synthetic
agggaggagcccgagag

SEQ ID NO: 49961 - RNA, 17 nt, Artificial Sequence
  Synthetic
acagggggggagacgag

SEQ ID NO: 49962 - RNA, 17 nt, Artificial Sequence
  Synthetic
cggaccccggccccgag

SEQ ID NO: 49963 - RNA, 17 nt, Artificial Sequence
  Synthetic
ccgccccuuugggggag

SEQ ID NO: 49964 - RNA, 17 nt, Artificial Sequence
  Synthetic
cggcaagagagagaccg

SEQ ID NO: 49965 - RNA, 17 nt, Artificial Sequence
  Synthetic
cggucgggggacccccg

SEQ ID NO: 49966 - RNA, 17 nt, Artificial Sequence
  Synthetic
uaaugaauuucuccccg

SEQ ID NO: 49967 - RNA, 17 nt, Artificial Sequence
  Synthetic
ucccuccgcccccgccg

SEQ ID NO: 49968 - RNA, 17 nt, Artificial Sequence
  Synthetic
cagcgggcggggggccg

SEQ ID NO: 49969 - RNA, 17 nt, Artificial Sequence
  Synthetic
ccacccggcggcgcgcg

SEQ ID NO: 49970 - RNA, 17 nt, Artificial Sequence
  Synthetic
agccgcgcgccccggcg

SEQ ID NO: 49971 - RNA, 17 nt, Artificial Sequence
  Synthetic
ccggcgccccgccggcg

SEQ ID NO: 49972 - RNA, 17 nt, Artificial Sequence
  Synthetic
ucagggccgcgccggcg

SEQ ID NO: 49973 - RNA, 17 nt, Artificial Sequence
  Synthetic
acaaaaagcagcgggcg

SEQ ID NO: 49974 - RNA, 17 nt, Artificial Sequence
  Synthetic
cggugggcucgggggcg

SEQ ID NO: 49975 - RNA, 17 nt, Artificial Sequence
  Synthetic
cggguuggggguggucg

SEQ ID NO: 49976 - RNA, 17 nt, Artificial Sequence
  Synthetic
cgagagcgggggacagg

SEQ ID NO: 49977 - RNA, 17 nt, Artificial Sequence
  Synthetic
ucagcccacccacccgg

SEQ ID NO: 49978 - RNA, 17 nt, Artificial Sequence
  Synthetic
auagccgcgcgccccgg

SEQ ID NO: 49979 - RNA, 17 nt, Artificial Sequence
  Synthetic
aaugaauuucuccccgg

SEQ ID NO: 49980 - RNA, 17 nt, Artificial Sequence
  Synthetic
acggagcggcggcccgg

SEQ ID NO: 49981 - RNA, 17 nt, Artificial Sequence
  Synthetic
cgccggcggggcgccgg

SEQ ID NO: 49982 - RNA, 17 nt, Artificial Sequence
  Synthetic
cccucucaccgugccgg

SEQ ID NO: 49983 - RNA, 17 nt, Artificial Sequence
  Synthetic
ccgggggucugccgcgg

SEQ ID NO: 49984 - RNA, 17 nt, Artificial Sequence
  Synthetic
cgggggacacggcgcgg

SEQ ID NO: 49985 - RNA, 17 nt, Artificial Sequence
  Synthetic
caaaaagcagcgggcgg

SEQ ID NO: 49986 - RNA, 17 nt, Artificial Sequence
  Synthetic
cgccccggcgggggcgg

SEQ ID NO: 49987 - RNA, 17 nt, Artificial Sequence
  Synthetic
ugguccggggaaaaggg

SEQ ID NO: 49988 - RNA, 17 nt, Artificial Sequence
  Synthetic
cuuuuuguucggaaggg

SEQ ID NO: 49989 - RNA, 17 nt, Artificial Sequence
  Synthetic
cucugggggggcgaggg

SEQ ID NO: 49990 - RNA, 17 nt, Artificial Sequence
  Synthetic
ccggcgggggcggaggg

SEQ ID NO: 49991 - RNA, 17 nt, Artificial Sequence
  Synthetic
cuugacaaagcaacggg

SEQ ID NO: 49992 - RNA, 17 nt, Artificial Sequence
  Synthetic
cggcacgagcucccggg

SEQ ID NO: 49993 - RNA, 17 nt, Artificial Sequence
  Synthetic
cccaacccgcagccggg

SEQ ID NO: 49994 - RNA, 17 nt, Artificial Sequence
  Synthetic
ccucgcgcgccgccggg

SEQ ID NO: 49995 - RNA, 17 nt, Artificial Sequence
  Synthetic
uuggggguggucgcggg

SEQ ID NO: 49996 - RNA, 17 nt, Artificial Sequence
  Synthetic
agcggcggcccggcggg

SEQ ID NO: 49997 - RNA, 17 nt, Artificial Sequence
  Synthetic
ccaucugcgucggcggg

SEQ ID NO: 49998 - RNA, 17 nt, Artificial Sequence
  Synthetic
aaaaagcagcgggcggg

SEQ ID NO: 49999 - RNA, 17 nt, Artificial Sequence
  Synthetic
ccccccagagggucggg

SEQ ID NO: 50000 - RNA, 17 nt, Artificial Sequence
  Synthetic
ccacucccccaaagggg

SEQ ID NO: 50001 - RNA, 17 nt, Artificial Sequence
  Synthetic
uuuuuguucggaagggg

SEQ ID NO: 50002 - RNA, 17 nt, Artificial Sequence
  Synthetic
agagcgggggacagggg

SEQ ID NO: 50003 - RNA, 17 nt, Artificial Sequence
  Synthetic
uugacaaagcaacgggg

SEQ ID NO: 50004 - RNA, 17 nt, Artificial Sequence
  Synthetic
aucccccccucucgggg

SEQ ID NO: 50005 - RNA, 17 nt, Artificial Sequence
  Synthetic
cccagagggucgggggg

SEQ ID NO: 50006 - RNA, 17 nt, Artificial Sequence
  Synthetic
cggcugcggguuggggg

SEQ ID NO: 50007 - RNA, 17 nt, Artificial Sequence
  Synthetic
cccccgacccucugggg

SEQ ID NO: 50008 - RNA, 17 nt, Artificial Sequence
  Synthetic
ccccccgacccucuggg

SEQ ID NO: 50009 - RNA, 17 nt, Artificial Sequence
  Synthetic
acccggcugcggguugg

SEQ ID NO: 50010 - RNA, 17 nt, Artificial Sequence
  Synthetic
cccggaccacccggcug

SEQ ID NO: 50011 - RNA, 17 nt, Artificial Sequence
  Synthetic
cgccccccgacccucug

SEQ ID NO: 50012 - RNA, 17 nt, Artificial Sequence
  Synthetic
agagggcgcggggcgug

SEQ ID NO: 50013 - RNA, 17 nt, Artificial Sequence
  Synthetic
cacccggcugcggguug

SEQ ID NO: 50014 - RNA, 17 nt, Artificial Sequence
  Synthetic
uaaaugccgccccuuug

SEQ ID NO: 50015 - RNA, 17 nt, Artificial Sequence
  Synthetic
aagcccaggggaccaau

SEQ ID NO: 50016 - RNA, 17 nt, Artificial Sequence
  Synthetic
ccuuugggggaguggau

SEQ ID NO: 50017 - RNA, 17 nt, Artificial Sequence
  Synthetic
cgggugggugggcugau

SEQ ID NO: 50018 - RNA, 17 nt, Artificial Sequence
  Synthetic
aaauucauuagcauacu

SEQ ID NO: 50019 - RNA, 17 nt, Artificial Sequence
  Synthetic
cugccgcggcggccgcu

SEQ ID NO: 50020 - RNA, 17 nt, Artificial Sequence
  Synthetic
ccgccccccgacccucu

SEQ ID NO: 50021 - RNA, 17 nt, Artificial Sequence
  Synthetic
agggaaucccccccucu

SEQ ID NO: 50022 - RNA, 17 nt, Artificial Sequence
  Synthetic
ccccugucccccgcucu

SEQ ID NO: 50023 - RNA, 17 nt, Artificial Sequence
  Synthetic
caugcuaaugggguucu

SEQ ID NO: 50024 - RNA, 17 nt, Artificial Sequence
  Synthetic
cuuggaguacacccggu

SEQ ID NO: 50025 - RNA, 17 nt, Artificial Sequence
  Synthetic
ucgcccccccagagggu

SEQ ID NO: 50026 - RNA, 17 nt, Artificial Sequence
  Synthetic
agguggucugcguccuu

SEQ ID NO: 50027 - RNA, 17 nt, Artificial Sequence
  Synthetic
ccacccggcugcggguu

SEQ ID NO: 50028 - RNA, 20 nt, Artificial Sequence
  Synthetic
cgccuauccacucccccaaa

SEQ ID NO: 50029 - RNA, 20 nt, Artificial Sequence
  Synthetic
agccgggugguccggggaaa

SEQ ID NO: 50030 - RNA, 20 nt, Artificial Sequence
  Synthetic
cgggcugcuugacaaagcaa

SEQ ID NO: 50031 - RNA, 20 nt, Artificial Sequence
  Synthetic
uguucggaagggggggagaa

SEQ ID NO: 50032 - RNA, 20 nt, Artificial Sequence
  Synthetic
agggagggacacgggggaca

SEQ ID NO: 50033 - RNA, 20 nt, Artificial Sequence
  Synthetic
uuagcauacuaggaagccca

SEQ ID NO: 50034 - RNA, 20 nt, Artificial Sequence
  Synthetic
cugggggggcgagggaggca

SEQ ID NO: 50035 - RNA, 20 nt, Artificial Sequence
  Synthetic
caccccggcacugcgagcga

SEQ ID NO: 50036 - RNA, 20 nt, Artificial Sequence
  Synthetic
ccgacccucugggggggcga

SEQ ID NO: 50037 - RNA, 20 nt, Artificial Sequence
  Synthetic
cgcgccccggcgggggcgga

SEQ ID NO: 50038 - RNA, 20 nt, Artificial Sequence
  Synthetic
ccccggcgggggcggaggga

SEQ ID NO: 50039 - RNA, 20 nt, Artificial Sequence
  Synthetic
cggggggccggggugaggga

SEQ ID NO: 50040 - RNA, 20 nt, Artificial Sequence
  Synthetic
cgggcggggggccgggguga

SEQ ID NO: 50041 - RNA, 20 nt, Artificial Sequence
  Synthetic
acgcagaccaccuuugguua

SEQ ID NO: 50042 - RNA, 20 nt, Artificial Sequence
  Synthetic
ccccguccccggggaccaac

SEQ ID NO: 50043 - RNA, 20 nt, Artificial Sequence
  Synthetic
ccggggugagggagggacac

SEQ ID NO: 50044 - RNA, 20 nt, Artificial Sequence
  Synthetic
cccgguugguccccggggac

SEQ ID NO: 50045 - RNA, 20 nt, Artificial Sequence
  Synthetic
ugggguucuuggaguacacc

SEQ ID NO: 50046 - RNA, 20 nt, Artificial Sequence
  Synthetic
ccccuuuuccccggaccacc

SEQ ID NO: 50047 - RNA, 20 nt, Artificial Sequence
  Synthetic
cccggcgggaggaggagacc

SEQ ID NO: 50048 - RNA, 20 nt, Artificial Sequence
  Synthetic
aaaagggggggccugagacc

SEQ ID NO: 50049 - RNA, 20 nt, Artificial Sequence
  Synthetic
cccgugucccucccucaccc

SEQ ID NO: 50050 - RNA, 20 nt, Artificial Sequence
  Synthetic
aaagggggggccugagaccc

SEQ ID NO: 50051 - RNA, 20 nt, Artificial Sequence
  Synthetic
acgagcucccgggcggaccc

SEQ ID NO: 50052 - RNA, 20 nt, Artificial Sequence
  Synthetic
cggccgccgcggcagacccc

SEQ ID NO: 50053 - RNA, 20 nt, Artificial Sequence
  Synthetic
acggugagagggcgaccccc

SEQ ID NO: 50054 - RNA, 20 nt, Artificial Sequence
  Synthetic
ccugaguggugcccgccccc

SEQ ID NO: 50055 - RNA, 20 nt, Artificial Sequence
  Synthetic
cccugaguggugcccgcccc

SEQ ID NO: 50056 - RNA, 20 nt, Artificial Sequence
  Synthetic
augcuaaugaauuucucccc

SEQ ID NO: 50057 - RNA, 20 nt, Artificial Sequence
  Synthetic
cucggggcggccccgucccc

SEQ ID NO: 50058 - RNA, 20 nt, Artificial Sequence
  Synthetic
auuagcauacuaggaagccc

SEQ ID NO: 50059 - RNA, 20 nt, Artificial Sequence
  Synthetic
cccccaauagccgcgcgccc

SEQ ID NO: 50060 - RNA, 20 nt, Artificial Sequence
  Synthetic
uaugcuaaugaauuucuccc

SEQ ID NO: 50061 - RNA, 20 nt, Artificial Sequence
  Synthetic
ucucggggcggccccguccc

SEQ ID NO: 50062 - RNA, 20 nt, Artificial Sequence
  Synthetic
cucaggcccccccuuuuccc

SEQ ID NO: 50063 - RNA, 20 nt, Artificial Sequence
  Synthetic
accacccccaacccgcagcc

SEQ ID NO: 50064 - RNA, 20 nt, Artificial Sequence
  Synthetic
ucccucccuccgcccccgcc

SEQ ID NO: 50065 - RNA, 20 nt, Artificial Sequence
  Synthetic
ccgggucuccuccucccgcc

SEQ ID NO: 50066 - RNA, 20 nt, Artificial Sequence
  Synthetic
cgagcgacggagcggcggcc

SEQ ID NO: 50067 - RNA, 20 nt, Artificial Sequence
  Synthetic
ccgggagcucgugccgggcc

SEQ ID NO: 50068 - RNA, 20 nt, Artificial Sequence
  Synthetic
cgcggcggccgcucggggcc

SEQ ID NO: 50069 - RNA, 20 nt, Artificial Sequence
  Synthetic
uccgcccgggagcucgugcc

SEQ ID NO: 50070 - RNA, 20 nt, Artificial Sequence
  Synthetic
cccgcggucucucucuugcc

SEQ ID NO: 50071 - RNA, 20 nt, Artificial Sequence
  Synthetic
cccggcccggcacgagcucc

SEQ ID NO: 50072 - RNA, 20 nt, Artificial Sequence
  Synthetic
aacccgcagccggguggucc

SEQ ID NO: 50073 - RNA, 20 nt, Artificial Sequence
  Synthetic
ccuuccgaacaaaaagcagc

SEQ ID NO: 50074 - RNA, 20 nt, Artificial Sequence
  Synthetic
cccggcaagagagagaccgc

SEQ ID NO: 50075 - RNA, 20 nt, Artificial Sequence
  Synthetic
uucccucccuccgcccccgc

SEQ ID NO: 50076 - RNA, 20 nt, Artificial Sequence
  Synthetic
uccgggucuccuccucccgc

SEQ ID NO: 50077 - RNA, 20 nt, Artificial Sequence
  Synthetic
ugcggguuggggguggucgc

SEQ ID NO: 50078 - RNA, 20 nt, Artificial Sequence
  Synthetic
ucugggggggcgagggaggc

SEQ ID NO: 50079 - RNA, 20 nt, Artificial Sequence
  Synthetic
cgacggagcggcggcccggc

SEQ ID NO: 50080 - RNA, 20 nt, Artificial Sequence
  Synthetic
ccacucagggccgcgccggc

SEQ ID NO: 50081 - RNA, 20 nt, Artificial Sequence
  Synthetic
ccgaacaaaaagcagcgggc

SEQ ID NO: 50082 - RNA, 20 nt, Artificial Sequence
  Synthetic
ccgcggcggccgcucggggc

SEQ ID NO: 50083 - RNA, 20 nt, Artificial Sequence
  Synthetic
augaauuucuccccgggggc

SEQ ID NO: 50084 - RNA, 20 nt, Artificial Sequence
  Synthetic
cgggcggugggcucgggggc

SEQ ID NO: 50085 - RNA, 20 nt, Artificial Sequence
  Synthetic
aaaagcagcgggcggggggc

SEQ ID NO: 50086 - RNA, 20 nt, Artificial Sequence
  Synthetic
ugcgccgccccccgacccuc

SEQ ID NO: 50087 - RNA, 20 nt, Artificial Sequence
  Synthetic
uggucgcgggcggugggcuc

SEQ ID NO: 50088 - RNA, 20 nt, Artificial Sequence
  Synthetic
ccccccugucccccgcucuc

SEQ ID NO: 50089 - RNA, 20 nt, Artificial Sequence
  Synthetic
ccucgcccccccagaggguc

SEQ ID NO: 50090 - RNA, 20 nt, Artificial Sequence
  Synthetic
ccgggugguccggggaaaag

SEQ ID NO: 50091 - RNA, 20 nt, Artificial Sequence
  Synthetic
uucggaagggggggagaaag

SEQ ID NO: 50092 - RNA, 20 nt, Artificial Sequence
  Synthetic
agcccgagagcgggggacag

SEQ ID NO: 50093 - RNA, 20 nt, Artificial Sequence
  Synthetic
ugccucccucgcccccccag

SEQ ID NO: 50094 - RNA, 20 nt, Artificial Sequence
  Synthetic
augccgccccuuugggggag

SEQ ID NO: 50095 - RNA, 20 nt, Artificial Sequence
  Synthetic
cccgccggcgcggcccugag

SEQ ID NO: 50096 - RNA, 20 nt, Artificial Sequence
  Synthetic
cagacccccggcacggugag

SEQ ID NO: 50097 - RNA, 20 nt, Artificial Sequence
  Synthetic
aagcaacgggggggauuuag

SEQ ID NO: 50098 - RNA, 20 nt, Artificial Sequence
  Synthetic
cggggugagggagggacacg

SEQ ID NO: 50099 - RNA, 20 nt, Artificial Sequence
  Synthetic
aagggggggccugagacccg

SEQ ID NO: 50100 - RNA, 20 nt, Artificial Sequence
  Synthetic
cugaguggugcccgcccccg

SEQ ID NO: 50101 - RNA, 20 nt, Artificial Sequence
  Synthetic
ugcuaaugaauuucuccccg

SEQ ID NO: 50102 - RNA, 20 nt, Artificial Sequence
  Synthetic
ucggggcggccccguccccg

SEQ ID NO: 50103 - RNA, 20 nt, Artificial Sequence
  Synthetic
cccucccuccgcccccgccg

SEQ ID NO: 50104 - RNA, 20 nt, Artificial Sequence
  Synthetic
ccggccccgagcggccgccg

SEQ ID NO: 50105 - RNA, 20 nt, Artificial Sequence
  Synthetic
aagcagcgggcggggggccg

SEQ ID NO: 50106 - RNA, 20 nt, Artificial Sequence
  Synthetic
cagggaggagcccgagagcg

SEQ ID NO: 50107 - RNA, 20 nt, Artificial Sequence
  Synthetic
cacccacccggcggcgcgcg

SEQ ID NO: 50108 - RNA, 20 nt, Artificial Sequence
  Synthetic
uccgcccccgccggggcgcg

SEQ ID NO: 50109 - RNA, 20 nt, Artificial Sequence
  Synthetic
cccccggcgccccgccggcg

SEQ ID NO: 50110 - RNA, 20 nt, Artificial Sequence
  Synthetic
cacucagggccgcgccggcg

SEQ ID NO: 50111 - RNA, 20 nt, Artificial Sequence
  Synthetic
cgggggggauuuagagggcg

SEQ ID NO: 50112 - RNA, 20 nt, Artificial Sequence
  Synthetic
ucugccgcggcggccgcucg

SEQ ID NO: 50113 - RNA, 20 nt, Artificial Sequence
  Synthetic
cugcggguuggggguggucg

SEQ ID NO: 50114 - RNA, 20 nt, Artificial Sequence
  Synthetic
cgggugguccggggaaaagg

SEQ ID NO: 50115 - RNA, 20 nt, Artificial Sequence
  Synthetic
agcggcggcccggcgggagg

SEQ ID NO: 50116 - RNA, 20 nt, Artificial Sequence
  Synthetic
agagggcgcggggcgugagg

SEQ ID NO: 50117 - RNA, 20 nt, Artificial Sequence
  Synthetic
cgaucagcccacccacccgg

SEQ ID NO: 50118 - RNA, 20 nt, Artificial Sequence
  Synthetic
agggggggccugagacccgg

SEQ ID NO: 50119 - RNA, 20 nt, Artificial Sequence
  Synthetic
ccgcgccggcggggcgccgg

SEQ ID NO: 50120 - RNA, 20 nt, Artificial Sequence
  Synthetic
agggaggagcccgagagcgg

SEQ ID NO: 50121 - RNA, 20 nt, Artificial Sequence
  Synthetic
acacgggggacacggcgcgg

SEQ ID NO: 50122 - RNA, 20 nt, Artificial Sequence
  Synthetic
auagccgcgcgccccggcgg

SEQ ID NO: 50123 - RNA, 20 nt, Artificial Sequence
  Synthetic
uuggggguggucgcgggcgg

SEQ ID NO: 50124 - RNA, 20 nt, Artificial Sequence
  Synthetic
cugcuuuuuguucggaaggg

SEQ ID NO: 50125 - RNA, 20 nt, Artificial Sequence
  Synthetic
cccgagagcgggggacaggg

SEQ ID NO: 50126 - RNA, 20 nt, Artificial Sequence
  Synthetic
acccucugggggggcgaggg

SEQ ID NO: 50127 - RNA, 20 nt, Artificial Sequence
  Synthetic
cgcgccggcggggcgccggg

SEQ ID NO: 50128 - RNA, 20 nt, Artificial Sequence
  Synthetic
cggagcggcggcccggcggg

SEQ ID NO: 50129 - RNA, 20 nt, Artificial Sequence
  Synthetic
aacaaaaagcagcgggcggg

SEQ ID NO: 50130 - RNA, 20 nt, Artificial Sequence
  Synthetic
uauccacucccccaaagggg

SEQ ID NO: 50131 - RNA, 20 nt, Artificial Sequence
  Synthetic
ccgagagcgggggacagggg

SEQ ID NO: 50132 - RNA, 20 nt, Artificial Sequence
  Synthetic
ccaucugcgucggcgggggg

SEQ ID NO: 50133 - RNA, 20 nt, Artificial Sequence
  Synthetic
ccccccagagggucgggggg

SEQ ID NO: 50134 - RNA, 20 nt, Artificial Sequence
  Synthetic
acccggcugcggguuggggg

SEQ ID NO: 50135 - RNA, 20 nt, Artificial Sequence
  Synthetic
cgccccccgacccucugggg

SEQ ID NO: 50136 - RNA, 20 nt, Artificial Sequence
  Synthetic
ccgccccccgacccucuggg

SEQ ID NO: 50137 - RNA, 20 nt, Artificial Sequence
  Synthetic
cucgcgcgccgccggguggg

SEQ ID NO: 50138 - RNA, 20 nt, Artificial Sequence
  Synthetic
ccggggcgcgcggcuauugg

SEQ ID NO: 50139 - RNA, 20 nt, Artificial Sequence
  Synthetic
accacccggcugcggguugg

SEQ ID NO: 50140 - RNA, 20 nt, Artificial Sequence
  Synthetic
uuccccggaccacccggcug

SEQ ID NO: 50141 - RNA, 20 nt, Artificial Sequence
  Synthetic
cgccgccccccgacccucug

SEQ ID NO: 50142 - RNA, 20 nt, Artificial Sequence
  Synthetic
aggaagcccaggggaccaau

SEQ ID NO: 50143 - RNA, 20 nt, Artificial Sequence
  Synthetic
ucggccccuauugguccccu

SEQ ID NO: 50144 - RNA, 20 nt, Artificial Sequence
  Synthetic
cccccccugucccccgcucu

SEQ ID NO: 50145 - RNA, 20 nt, Artificial Sequence
  Synthetic
aggcagccccgugugacggu

SEQ ID NO: 50146 - RNA, 20 nt, Artificial Sequence
  Synthetic
uggggguggucgcgggcggu

SEQ ID NO: 50147 - RNA, 20 nt, Artificial Sequence
  Synthetic
cccucgcccccccagagggu

SEQ ID NO: 50148 - RNA, 20 nt, Artificial Sequence
  Synthetic
agccucgcgcgccgccgggu

SEQ ID NO: 50149 - RNA, 20 nt, Artificial Sequence
  Synthetic
cggaccacccggcugcgggu

SEQ ID NO: 50150 - RNA, 20 nt, Artificial Sequence
  Synthetic
cagggggggagacgaggggu

SEQ ID NO: 50151 - RNA, 20 nt, Artificial Sequence
  Synthetic
caaaggacgcagaccaccuu

SEQ ID NO: 50152 - RNA, 17 nt, Artificial Sequence
  Synthetic
ggacacguguugcgcaa

SEQ ID NO: 50153 - RNA, 17 nt, Artificial Sequence
  Synthetic
augcacgggaugcagaa

SEQ ID NO: 50154 - RNA, 17 nt, Artificial Sequence
  Synthetic
auuaccauaagcgggaa

SEQ ID NO: 50155 - RNA, 17 nt, Artificial Sequence
  Synthetic
uaauuagcaacuuuuaa

SEQ ID NO: 50156 - RNA, 17 nt, Artificial Sequence
  Synthetic
uaauuagcagcuuuuaa

SEQ ID NO: 50157 - RNA, 17 nt, Artificial Sequence
  Synthetic
gaucucguccgugcaca

SEQ ID NO: 50158 - RNA, 17 nt, Artificial Sequence
  Synthetic
caccgggguguugcaca

SEQ ID NO: 50159 - RNA, 17 nt, Artificial Sequence
  Synthetic
ggcgggcagcacggaca

SEQ ID NO: 50160 - RNA, 17 nt, Artificial Sequence
  Synthetic
cgcuuccuccucaccca

SEQ ID NO: 50161 - RNA, 17 nt, Artificial Sequence
  Synthetic
ccgcuccgcccgcccca

SEQ ID NO: 50162 - RNA, 17 nt, Artificial Sequence
  Synthetic
cccccggccgagcgcca

SEQ ID NO: 50163 - RNA, 17 nt, Artificial Sequence
  Synthetic
cuccgaggcgggcagca

SEQ ID NO: 50164 - RNA, 17 nt, Artificial Sequence
  Synthetic
aaaacucuggcagcgca

SEQ ID NO: 50165 - RNA, 17 nt, Artificial Sequence
  Synthetic
acgcccgccgacgcgca

SEQ ID NO: 50166 - RNA, 17 nt, Artificial Sequence
  Synthetic
gccgccauccccgcgca

SEQ ID NO: 50167 - RNA, 17 nt, Artificial Sequence
  Synthetic
cagaaggggugcaggca

SEQ ID NO: 50168 - RNA, 17 nt, Artificial Sequence
  Synthetic
auccaggucuucaugca

SEQ ID NO: 50169 - RNA, 17 nt, Artificial Sequence
  Synthetic
cgugugcgccgugugca

SEQ ID NO: 50170 - RNA, 17 nt, Artificial Sequence
  Synthetic
caugcacgggaugcaga

SEQ ID NO: 50171 - RNA, 17 nt, Artificial Sequence
  Synthetic
gcucuccgaagagacga

SEQ ID NO: 50172 - RNA, 17 nt, Artificial Sequence
  Synthetic
auaacccggaaccccga

SEQ ID NO: 50173 - RNA, 17 nt, Artificial Sequence
  Synthetic
aacccuagaccgcccga

SEQ ID NO: 50174 - RNA, 17 nt, Artificial Sequence
  Synthetic
gagccccggagcuccga

SEQ ID NO: 50175 - RNA, 17 nt, Artificial Sequence
  Synthetic
aauuacgcggggagcga

SEQ ID NO: 50176 - RNA, 17 nt, Artificial Sequence
  Synthetic
cgcguauauauccgcga

SEQ ID NO: 50177 - RNA, 17 nt, Artificial Sequence
  Synthetic
uaggguugaaccggcga

SEQ ID NO: 50178 - RNA, 17 nt, Artificial Sequence
  Synthetic
aauuaaaaacguucgga

SEQ ID NO: 50179 - RNA, 17 nt, Artificial Sequence
  Synthetic
aggaagcggaagcggga

SEQ ID NO: 50180 - RNA, 17 nt, Artificial Sequence
  Synthetic
gucguucacuaucggga

SEQ ID NO: 50181 - RNA, 17 nt, Artificial Sequence
  Synthetic
auuaccaugcgcgggga

SEQ ID NO: 50182 - RNA, 17 nt, Artificial Sequence
  Synthetic
guucgaggcgggccuga

SEQ ID NO: 50183 - RNA, 17 nt, Artificial Sequence
  Synthetic
agguggagucgcgguga

SEQ ID NO: 50184 - RNA, 17 nt, Artificial Sequence
  Synthetic
ggccgucgggcggucua

SEQ ID NO: 50185 - RNA, 17 nt, Artificial Sequence
  Synthetic
gcgccggcuucccggua

SEQ ID NO: 50186 - RNA, 17 nt, Artificial Sequence
  Synthetic
gccgccauucccgcuua

SEQ ID NO: 50187 - RNA, 17 nt, Artificial Sequence
  Synthetic
gcggucuaggguugaac

SEQ ID NO: 50188 - RNA, 17 nt, Artificial Sequence
  Synthetic
aauuagcagcuuuuaac

SEQ ID NO: 50189 - RNA, 17 nt, Artificial Sequence
  Synthetic
gcuuccuccucacccac

SEQ ID NO: 50190 - RNA, 17 nt, Artificial Sequence
  Synthetic
acuaucagguacgccac

SEQ ID NO: 50191 - RNA, 17 nt, Artificial Sequence
  Synthetic
uccaggucuucaugcac

SEQ ID NO: 50192 - RNA, 17 nt, Artificial Sequence
  Synthetic
ccaccgggguguugcac

SEQ ID NO: 50193 - RNA, 17 nt, Artificial Sequence
  Synthetic
guuucuaauuaccauac

SEQ ID NO: 50194 - RNA, 17 nt, Artificial Sequence
  Synthetic
cuaucagguacgccacc

SEQ ID NO: 50195 - RNA, 17 nt, Artificial Sequence
  Synthetic
ucccgugcaugaagacc

SEQ ID NO: 50196 - RNA, 17 nt, Artificial Sequence
  Synthetic
uuucuaauuaccauacc

SEQ ID NO: 50197 - RNA, 17 nt, Artificial Sequence
  Synthetic
uccccugugcaacaccc

SEQ ID NO: 50198 - RNA, 17 nt, Artificial Sequence
  Synthetic
cgauagugaacgacccc

SEQ ID NO: 50199 - RNA, 17 nt, Artificial Sequence
  Synthetic
uggccggcgccgccccc

SEQ ID NO: 50200 - RNA, 17 nt, Artificial Sequence
  Synthetic
gucguugagcauccccc

SEQ ID NO: 50201 - RNA, 17 nt, Artificial Sequence
  Synthetic
ggacgcggccacgcccc

SEQ ID NO: 50202 - RNA, 17 nt, Artificial Sequence
  Synthetic
gccgcuccgcccgcccc

SEQ ID NO: 50203 - RNA, 17 nt, Artificial Sequence
  Synthetic
gcccccggcccggcccc

SEQ ID NO: 50204 - RNA, 17 nt, Artificial Sequence
  Synthetic
cucggccggcggagccc

SEQ ID NO: 50205 - RNA, 17 nt, Artificial Sequence
  Synthetic
gggcccggacuccgccc

SEQ ID NO: 50206 - RNA, 17 nt, Artificial Sequence
  Synthetic
agaccgcccgacggccc

SEQ ID NO: 50207 - RNA, 17 nt, Artificial Sequence
  Synthetic
uccgccgccgcgggccc

SEQ ID NO: 50208 - RNA, 17 nt, Artificial Sequence
  Synthetic
cgggcguggggcugccc

SEQ ID NO: 50209 - RNA, 17 nt, Artificial Sequence
  Synthetic
gcccccggccgagcgcc

SEQ ID NO: 50210 - RNA, 17 nt, Artificial Sequence
  Synthetic
agcggcggggcggcgcc

SEQ ID NO: 50211 - RNA, 17 nt, Artificial Sequence
  Synthetic
ggcgcggggcggucgcc

SEQ ID NO: 50212 - RNA, 17 nt, Artificial Sequence
  Synthetic
uagaccgcccgacggcc

SEQ ID NO: 50213 - RNA, 17 nt, Artificial Sequence
  Synthetic
cggccacgcccccggcc

SEQ ID NO: 50214 - RNA, 17 nt, Artificial Sequence
  Synthetic
gcgcggggauggcggcc

SEQ ID NO: 50215 - RNA, 17 nt, Artificial Sequence
  Synthetic
ugcccuggcgcucggcc

SEQ ID NO: 50216 - RNA, 17 nt, Artificial Sequence
  Synthetic
auauauccgcgagggcc

SEQ ID NO: 50217 - RNA, 17 nt, Artificial Sequence
  Synthetic
cggccgggggccgggcc

SEQ ID NO: 50218 - RNA, 17 nt, Artificial Sequence
  Synthetic
cuccgccgccgcgggcc

SEQ ID NO: 50219 - RNA, 17 nt, Artificial Sequence
  Synthetic
gcgccgccgcgcgggcc

SEQ ID NO: 50220 - RNA, 17 nt, Artificial Sequence
  Synthetic
gcgcucggccgggggcc

SEQ ID NO: 50221 - RNA, 17 nt, Artificial Sequence
  Synthetic
guugcgcaacggaaucc

SEQ ID NO: 50222 - RNA, 17 nt, Artificial Sequence
  Synthetic
cagaccuucggagcucc

SEQ ID NO: 50223 - RNA, 17 nt, Artificial Sequence
  Synthetic
ucgccggggcggagucc

SEQ ID NO: 50224 - RNA, 17 nt, Artificial Sequence
  Synthetic
cuuuuaauaggcggucc

SEQ ID NO: 50225 - RNA, 17 nt, Artificial Sequence
  Synthetic
gccccgcgccggcuucc

SEQ ID NO: 50226 - RNA, 17 nt, Artificial Sequence
  Synthetic
uacucccucgggguucc

SEQ ID NO: 50227 - RNA, 17 nt, Artificial Sequence
  Synthetic
gaggaggaagcggaagc

SEQ ID NO: 50228 - RNA, 17 nt, Artificial Sequence
  Synthetic
uuaccauaccgggaagc

SEQ ID NO: 50229 - RNA, 17 nt, Artificial Sequence
  Synthetic
uuuuaauuaccauaagc

SEQ ID NO: 50230 - RNA, 17 nt, Artificial Sequence
  Synthetic
ugggcgugaccgccagc

SEQ ID NO: 50231 - RNA, 17 nt, Artificial Sequence
  Synthetic
ugcuaauuaccgcgagc

SEQ ID NO: 50232 - RNA, 17 nt, Artificial Sequence
  Synthetic
accgcgagcgggaacgc

SEQ ID NO: 50233 - RNA, 17 nt, Artificial Sequence
  Synthetic
cucgcggauauauacgc

SEQ ID NO: 50234 - RNA, 17 nt, Artificial Sequence
  Synthetic
cgagggaguaauuacgc

SEQ ID NO: 50235 - RNA, 17 nt, Artificial Sequence
  Synthetic
ggugcugaacgacccgc

SEQ ID NO: 50236 - RNA, 17 nt, Artificial Sequence
  Synthetic
cacgggcccacccccgc

SEQ ID NO: 50237 - RNA, 17 nt, Artificial Sequence
  Synthetic
ggguccuccgccgccgc

SEQ ID NO: 50238 - RNA, 17 nt, Artificial Sequence
  Synthetic
gagcuccggggcuccgc

SEQ ID NO: 50239 - RNA, 17 nt, Artificial Sequence
  Synthetic
gaaaacucuggcagcgc

SEQ ID NO: 50240 - RNA, 17 nt, Artificial Sequence
  Synthetic
cacgcccgccgacgcgc

SEQ ID NO: 50241 - RNA, 17 nt, Artificial Sequence
  Synthetic
cggcgaccgccccgcgc

SEQ ID NO: 50242 - RNA, 17 nt, Artificial Sequence
  Synthetic
accgcgcgccgccgcgc

SEQ ID NO: 50243 - RNA, 17 nt, Artificial Sequence
  Synthetic
cggcggcggcggcgcgc

SEQ ID NO: 50244 - RNA, 17 nt, Artificial Sequence
  Synthetic
uaccgggaagccggcgc

SEQ ID NO: 50245 - RNA, 17 nt, Artificial Sequence
  Synthetic
gagcggcggggcggcgc

SEQ ID NO: 50246 - RNA, 17 nt, Artificial Sequence
  Synthetic
gccccagggggcggcgc

SEQ ID NO: 50247 - RNA, 17 nt, Artificial Sequence
  Synthetic
ugcuaauuaccaugcgc

SEQ ID NO: 50248 - RNA, 17 nt, Artificial Sequence
  Synthetic
gccgaggccgcccucgc

SEQ ID NO: 50249 - RNA, 17 nt, Artificial Sequence
  Synthetic
cggcgcggggcggucgc

SEQ ID NO: 50250 - RNA, 17 nt, Artificial Sequence
  Synthetic
gcagaaggggugcaggc

SEQ ID NO: 50251 - RNA, 17 nt, Artificial Sequence
  Synthetic
gacuccaccuccgaggc

SEQ ID NO: 50252 - RNA, 17 nt, Artificial Sequence
  Synthetic
acggagauguucgaggc

SEQ ID NO: 50253 - RNA, 17 nt, Artificial Sequence
  Synthetic
ggggcgggcggagcggc

SEQ ID NO: 50254 - RNA, 17 nt, Artificial Sequence
  Synthetic
ugcgcggggauggcggc

SEQ ID NO: 50255 - RNA, 17 nt, Artificial Sequence
  Synthetic
gcgagggcggccucggc

SEQ ID NO: 50256 - RNA, 17 nt, Artificial Sequence
  Synthetic
cugcccuggcgcucggc

SEQ ID NO: 50257 - RNA, 17 nt, Artificial Sequence
  Synthetic
gaucccugcgcgucggc

SEQ ID NO: 50258 - RNA, 17 nt, Artificial Sequence
  Synthetic
ucggccgggggccgggc

SEQ ID NO: 50259 - RNA, 17 nt, Artificial Sequence
  Synthetic
ucuggcagcgcaggggc

SEQ ID NO: 50260 - RNA, 17 nt, Artificial Sequence
  Synthetic
ggcgcucggccgggggc

SEQ ID NO: 50261 - RNA, 17 nt, Artificial Sequence
  Synthetic
gcgccgcccccuggggc

SEQ ID NO: 50262 - RNA, 17 nt, Artificial Sequence
  Synthetic
agcaacuuuuaaugggc

SEQ ID NO: 50263 - RNA, 17 nt, Artificial Sequence
  Synthetic
ggcggcgcgcgguuggc

SEQ ID NO: 50264 - RNA, 17 nt, Artificial Sequence
  Synthetic
acgcgcagggauccugc

SEQ ID NO: 50265 - RNA, 17 nt, Artificial Sequence
  Synthetic
cuccuccgagucgcugc

SEQ ID NO: 50266 - RNA, 17 nt, Artificial Sequence
  Synthetic
ggaugcagaaggggugc

SEQ ID NO: 50267 - RNA, 17 nt, Artificial Sequence
  Synthetic
gcguggccgcguccauc

SEQ ID NO: 50268 - RNA, 17 nt, Artificial Sequence
  Synthetic
cggucacgcccacuauc

SEQ ID NO: 50269 - RNA, 17 nt, Artificial Sequence
  Synthetic
gggggucguucacuauc

SEQ ID NO: 50270 - RNA, 17 nt, Artificial Sequence
  Synthetic
gcaggcagggaaaacuc

SEQ ID NO: 50271 - RNA, 17 nt, Artificial Sequence
  Synthetic
cgcguaauuacucccuc

SEQ ID NO: 50272 - RNA, 17 nt, Artificial Sequence
  Synthetic
gcagaccuucggagcuc

SEQ ID NO: 50273 - RNA, 17 nt, Artificial Sequence
  Synthetic
gucgccggggcggaguc

SEQ ID NO: 50274 - RNA, 17 nt, Artificial Sequence
  Synthetic
cgcgggcccgggccguc

SEQ ID NO: 50275 - RNA, 17 nt, Artificial Sequence
  Synthetic
uuacucccucgggguuc

SEQ ID NO: 50276 - RNA, 17 nt, Artificial Sequence
  Synthetic
ugcacgggaugcagaag

SEQ ID NO: 50277 - RNA, 17 nt, Artificial Sequence
  Synthetic
cgugggugaggaggaag

SEQ ID NO: 50278 - RNA, 17 nt, Artificial Sequence
  Synthetic
ugaggaggaagcggaag

SEQ ID NO: 50279 - RNA, 17 nt, Artificial Sequence
  Synthetic
uuuuuaauuaccauaag

SEQ ID NO: 50280 - RNA, 17 nt, Artificial Sequence
  Synthetic
accgggguguugcacag

SEQ ID NO: 50281 - RNA, 17 nt, Artificial Sequence
  Synthetic
cgcuccgcccgccccag

SEQ ID NO: 50282 - RNA, 17 nt, Artificial Sequence
  Synthetic
gugggcgugaccgccag

SEQ ID NO: 50283 - RNA, 17 nt, Artificial Sequence
  Synthetic
aaacucuggcagcgcag

SEQ ID NO: 50284 - RNA, 17 nt, Artificial Sequence
  Synthetic
ugcucaacgacaugcag

SEQ ID NO: 50285 - RNA, 17 nt, Artificial Sequence
  Synthetic
aucgucucuucggagag

SEQ ID NO: 50286 - RNA, 17 nt, Artificial Sequence
  Synthetic
auuacgcggggagcgag

SEQ ID NO: 50287 - RNA, 17 nt, Artificial Sequence
  Synthetic
cugcuaauuaccgcgag

SEQ ID NO: 50288 - RNA, 17 nt, Artificial Sequence
  Synthetic
cccuggggcgggcggag

SEQ ID NO: 50289 - RNA, 17 nt, Artificial Sequence
  Synthetic
ggaagcggaagcgggag

SEQ ID NO: 50290 - RNA, 17 nt, Artificial Sequence
  Synthetic
gguggcguaccugauag

SEQ ID NO: 50291 - RNA, 17 nt, Artificial Sequence
  Synthetic
ggcgggccugauggacg

SEQ ID NO: 50292 - RNA, 17 nt, Artificial Sequence
  Synthetic
ccucgcggauauauacg

SEQ ID NO: 50293 - RNA, 17 nt, Artificial Sequence
  Synthetic
ccgagggaguaauuacg

SEQ ID NO: 50294 - RNA, 17 nt, Artificial Sequence
  Synthetic
uaucagguacgccaccg

SEQ ID NO: 50295 - RNA, 17 nt, Artificial Sequence
  Synthetic
cucggaggaggagaccg

SEQ ID NO: 50296 - RNA, 17 nt, Artificial Sequence
  Synthetic
cauaacccggaaccccg

SEQ ID NO: 50297 - RNA, 17 nt, Artificial Sequence
  Synthetic
ccgacggcccgggcccg

SEQ ID NO: 50298 - RNA, 17 nt, Artificial Sequence
  Synthetic
cugcgggggugggcccg

SEQ ID NO: 50299 - RNA, 17 nt, Artificial Sequence
  Synthetic
cggguccuccgccgccg

SEQ ID NO: 50300 - RNA, 17 nt, Artificial Sequence
  Synthetic
gcgcggggcggucgccg

SEQ ID NO: 50301 - RNA, 17 nt, Artificial Sequence
  Synthetic
cggggcuccgccggccg

SEQ ID NO: 50302 - RNA, 17 nt, Artificial Sequence
  Synthetic
gcccuggcgcucggccg

SEQ ID NO: 50303 - RNA, 17 nt, Artificial Sequence
  Synthetic
ggccgggggccgggccg

SEQ ID NO: 50304 - RNA, 17 nt, Artificial Sequence
  Synthetic
ccgcgacuccaccuccg

SEQ ID NO: 50305 - RNA, 17 nt, Artificial Sequence
  Synthetic
cgccuccuccuccuccg

SEQ ID NO: 50306 - RNA, 17 nt, Artificial Sequence
  Synthetic
agaccuucggagcuccg

SEQ ID NO: 50307 - RNA, 17 nt, Artificial Sequence
  Synthetic
gccuccacgcggguccg

SEQ ID NO: 50308 - RNA, 17 nt, Artificial Sequence
  Synthetic
uaauuacgcggggagcg

SEQ ID NO: 50309 - RNA, 17 nt, Artificial Sequence
  Synthetic
ucgcggauauauacgcg

SEQ ID NO: 50310 - RNA, 17 nt, Artificial Sequence
  Synthetic
gagggaguaauuacgcg

SEQ ID NO: 50311 - RNA, 17 nt, Artificial Sequence
  Synthetic
cgacccccggacccgcg

SEQ ID NO: 50312 - RNA, 17 nt, Artificial Sequence
  Synthetic
cggaguccgggcccgcg

SEQ ID NO: 50313 - RNA, 17 nt, Artificial Sequence
  Synthetic
aaccgcgcgccgccgcg

SEQ ID NO: 50314 - RNA, 17 nt, Artificial Sequence
  Synthetic
ccgcguauauauccgcg

SEQ ID NO: 50315 - RNA, 17 nt, Artificial Sequence
  Synthetic
accgggaagccggcgcg

SEQ ID NO: 50316 - RNA, 17 nt, Artificial Sequence
  Synthetic
gcccgcgcggcggcgcg

SEQ ID NO: 50317 - RNA, 17 nt, Artificial Sequence
  Synthetic
gcggcggcggcggcgcg

SEQ ID NO: 50318 - RNA, 17 nt, Artificial Sequence
  Synthetic
gcuaauuaccaugcgcg

SEQ ID NO: 50319 - RNA, 17 nt, Artificial Sequence
  Synthetic
cuccgaaggucugcgcg

SEQ ID NO: 50320 - RNA, 17 nt, Artificial Sequence
  Synthetic
cuaggguugaaccggcg

SEQ ID NO: 50321 - RNA, 17 nt, Artificial Sequence
  Synthetic
auaccgggaagccggcg

SEQ ID NO: 50322 - RNA, 17 nt, Artificial Sequence
  Synthetic
gggcgggcggagcggcg

SEQ ID NO: 50323 - RNA, 17 nt, Artificial Sequence
  Synthetic
cugcgcgucggcgggcg

SEQ ID NO: 50324 - RNA, 17 nt, Artificial Sequence
  Synthetic
cuggcagcgcaggggcg

SEQ ID NO: 50325 - RNA, 17 nt, Artificial Sequence
  Synthetic
gggccgggccgggggcg

SEQ ID NO: 50326 - RNA, 17 nt, Artificial Sequence
  Synthetic
uugcuaauuaccaugcg

SEQ ID NO: 50327 - RNA, 17 nt, Artificial Sequence
  Synthetic
cgcgcagggauccugcg

SEQ ID NO: 50328 - RNA, 17 nt, Artificial Sequence
  Synthetic
gcggcgccgggcccucg

SEQ ID NO: 50329 - RNA, 17 nt, Artificial Sequence
  Synthetic
gcguaauuacucccucg

SEQ ID NO: 50330 - RNA, 17 nt, Artificial Sequence
  Synthetic
gccggcguucccgcucg

SEQ ID NO: 50331 - RNA, 17 nt, Artificial Sequence
  Synthetic
ccucggagguggagucg

SEQ ID NO: 50332 - RNA, 17 nt, Artificial Sequence
  Synthetic
ggacacggagauguucg

SEQ ID NO: 50333 - RNA, 17 nt, Artificial Sequence
  Synthetic
gcuccgcccgccccagg

SEQ ID NO: 50334 - RNA, 17 nt, Artificial Sequence
  Synthetic
ggaggaggagaccgagg

SEQ ID NO: 50335 - RNA, 17 nt, Artificial Sequence
  Synthetic
cgacuccaccuccgagg

SEQ ID NO: 50336 - RNA, 17 nt, Artificial Sequence
  Synthetic
cacggagauguucgagg

SEQ ID NO: 50337 - RNA, 17 nt, Artificial Sequence
  Synthetic
cgcggaggaggaggagg

SEQ ID NO: 50338 - RNA, 17 nt, Artificial Sequence
  Synthetic
cagcagcgacucggagg

SEQ ID NO: 50339 - RNA, 17 nt, Artificial Sequence
  Synthetic
gcugcccgccucggagg

SEQ ID NO: 50340 - RNA, 17 nt, Artificial Sequence
  Synthetic
gaagcggaagcgggagg

SEQ ID NO: 50341 - RNA, 17 nt, Artificial Sequence
  Synthetic
ugggcccgugggugagg

SEQ ID NO: 50342 - RNA, 17 nt, Artificial Sequence
  Synthetic
uagaaacuuuuaauagg

SEQ ID NO: 50343 - RNA, 17 nt, Artificial Sequence
  Synthetic
ccugugcaacaccccgg

SEQ ID NO: 50344 - RNA, 17 nt, Artificial Sequence
  Synthetic
agggcggccucggccgg

SEQ ID NO: 50345 - RNA, 17 nt, Artificial Sequence
  Synthetic
cccuggcgcucggccgg

SEQ ID NO: 50346 - RNA, 17 nt, Artificial Sequence
  Synthetic
gccgggggccgggccgg

SEQ ID NO: 50347 - RNA, 17 nt, Artificial Sequence
  Synthetic
ccuccacgcggguccgg

SEQ ID NO: 50348 - RNA, 17 nt, Artificial Sequence
  Synthetic
uggggcgggcggagcgg

SEQ ID NO: 50349 - RNA, 17 nt, Artificial Sequence
  Synthetic
acggcccgggcccgcgg

SEQ ID NO: 50350 - RNA, 17 nt, Artificial Sequence
  Synthetic
aguccgggcccgcgcgg

SEQ ID NO: 50351 - RNA, 17 nt, Artificial Sequence
  Synthetic
ggaggaggaggaggcgg

SEQ ID NO: 50352 - RNA, 17 nt, Artificial Sequence
  Synthetic
gcccgggcccgcggcgg

SEQ ID NO: 50353 - RNA, 17 nt, Artificial Sequence
  Synthetic
ggaggaggaggcggcgg

SEQ ID NO: 50354 - RNA, 17 nt, Artificial Sequence
  Synthetic
cgggcccgcggcggcgg

SEQ ID NO: 50355 - RNA, 17 nt, Artificial Sequence
  Synthetic
ggaggaggcggcggcgg

SEQ ID NO: 50356 - RNA, 17 nt, Artificial Sequence
  Synthetic
gcgcagggauccugcgg

SEQ ID NO: 50357 - RNA, 17 nt, Artificial Sequence
  Synthetic
cgccagcagcgacucgg

SEQ ID NO: 50358 - RNA, 17 nt, Artificial Sequence
  Synthetic
cgugcugcccgccucgg

SEQ ID NO: 50359 - RNA, 17 nt, Artificial Sequence
  Synthetic
ggaucccugcgcgucgg

SEQ ID NO: 50360 - RNA, 17 nt, Artificial Sequence
  Synthetic
gguugaaccggcgaggg

SEQ ID NO: 50361 - RNA, 17 nt, Artificial Sequence
  Synthetic
aagcggaagcgggaggg

SEQ ID NO: 50362 - RNA, 17 nt, Artificial Sequence
  Synthetic
gaggaagcggaagcggg

SEQ ID NO: 50363 - RNA, 17 nt, Artificial Sequence
  Synthetic
ccgcccccuggggcggg

SEQ ID NO: 50364 - RNA, 17 nt, Artificial Sequence
  Synthetic
gggcccgggccgucggg

SEQ ID NO: 50365 - RNA, 17 nt, Artificial Sequence
  Synthetic
cucuggcagcgcagggg

SEQ ID NO: 50366 - RNA, 17 nt, Artificial Sequence
  Synthetic
agcggaagcgggagggg

SEQ ID NO: 50367 - RNA, 17 nt, Artificial Sequence
  Synthetic
cggggcggucgccgggg

SEQ ID NO: 50368 - RNA, 17 nt, Artificial Sequence
  Synthetic
gggaagccggcgcgggg

SEQ ID NO: 50369 - RNA, 17 nt, Artificial Sequence
  Synthetic
cgggcggagcggcgggg

SEQ ID NO: 50370 - RNA, 17 nt, Artificial Sequence
  Synthetic
ccgcccgccccaggggg

SEQ ID NO: 50371 - RNA, 17 nt, Artificial Sequence
  Synthetic
gcggaagcgggaggggg

SEQ ID NO: 50372 - RNA, 17 nt, Artificial Sequence
  Synthetic
cagggauccugcggggg

SEQ ID NO: 50373 - RNA, 17 nt, Artificial Sequence
  Synthetic
ggcgccgcccccugggg

SEQ ID NO: 50374 - RNA, 17 nt, Artificial Sequence
  Synthetic
accauaagcgggaaugg

SEQ ID NO: 50375 - RNA, 17 nt, Artificial Sequence
  Synthetic
accaugcgcggggaugg

SEQ ID NO: 50376 - RNA, 17 nt, Artificial Sequence
  Synthetic
gcugaacgacccgcugg

SEQ ID NO: 50377 - RNA, 17 nt, Artificial Sequence
  Synthetic
cccccggacccgcgugg

SEQ ID NO: 50378 - RNA, 17 nt, Artificial Sequence
  Synthetic
gccggcgccgcccccug

SEQ ID NO: 50379 - RNA, 17 nt, Artificial Sequence
  Synthetic
gacgcgcagggauccug

SEQ ID NO: 50380 - RNA, 17 nt, Artificial Sequence
  Synthetic
gcgcgucggcgggcgug

SEQ ID NO: 50381 - RNA, 17 nt, Artificial Sequence
  Synthetic
gggugggcccgugggug

SEQ ID NO: 50382 - RNA, 17 nt, Artificial Sequence
  Synthetic
aauuagaaacuuuuaau

SEQ ID NO: 50383 - RNA, 17 nt, Artificial Sequence
  Synthetic
aauuagcaacuuuuaau

SEQ ID NO: 50384 - RNA, 17 nt, Artificial Sequence
  Synthetic
cucuccgaagagacgau

SEQ ID NO: 50385 - RNA, 17 nt, Artificial Sequence
  Synthetic
cgggggucguucacuau

SEQ ID NO: 50386 - RNA, 17 nt, Artificial Sequence
  Synthetic
gcucgccagcagcgacu

SEQ ID NO: 50387 - RNA, 17 nt, Artificial Sequence
  Synthetic
gucagagauucccaccu

SEQ ID NO: 50388 - RNA, 17 nt, Artificial Sequence
  Synthetic
ggccggcgccgcccccu

SEQ ID NO: 50389 - RNA, 17 nt, Artificial Sequence
  Synthetic
ccgcguaauuacucccu

SEQ ID NO: 50390 - RNA, 17 nt, Artificial Sequence
  Synthetic
guccgugcugcccgccu

SEQ ID NO: 50391 - RNA, 17 nt, Artificial Sequence
  Synthetic
accggcgagggcggccu

SEQ ID NO: 50392 - RNA, 17 nt, Artificial Sequence
  Synthetic
ggggcugcccuggcgcu

SEQ ID NO: 50393 - RNA, 17 nt, Artificial Sequence
  Synthetic
gggccgucgggcggucu

SEQ ID NO: 50394 - RNA, 17 nt, Artificial Sequence
  Synthetic
guggcguaccugauagu

SEQ ID NO: 50395 - RNA, 17 nt, Artificial Sequence
  Synthetic
ugcgggggugggcccgu

SEQ ID NO: 50396 - RNA, 17 nt, Artificial Sequence
  Synthetic
ccgcgggcccgggccgu

SEQ ID NO: 50397 - RNA, 17 nt, Artificial Sequence
  Synthetic
gcaggaucccugcgcgu

SEQ ID NO: 50398 - RNA, 17 nt, Artificial Sequence
  Synthetic
ugcgcgucggcgggcgu

SEQ ID NO: 50399 - RNA, 17 nt, Artificial Sequence
  Synthetic
gaggaggagaccgaggu

SEQ ID NO: 50400 - RNA, 17 nt, Artificial Sequence
  Synthetic
gcgcggcggcgcgcggu

SEQ ID NO: 50401 - RNA, 17 nt, Artificial Sequence
  Synthetic
agggauccugcgggggu

SEQ ID NO: 50402 - RNA, 17 nt, Artificial Sequence
  Synthetic
ggccucgcgcagaccuu

SEQ ID NO: 50403 - RNA, 17 nt, Artificial Sequence
  Synthetic
ggcucccaucgucucuu

SEQ ID NO: 50404 - RNA, 17 nt, Artificial Sequence
  Synthetic
ugguaauuaaaaacguu

SEQ ID NO: 50405 - RNA, 20 nt, Artificial Sequence
  Synthetic
aggggacacguguugcgcaa

SEQ ID NO: 50406 - RNA, 20 nt, Artificial Sequence
  Synthetic
uucaugcacgggaugcagaa

SEQ ID NO: 50407 - RNA, 20 nt, Artificial Sequence
  Synthetic
uuaauuaccauaagcgggaa

SEQ ID NO: 50408 - RNA, 20 nt, Artificial Sequence
  Synthetic
ugguaauuagcaacuuuuaa

SEQ ID NO: 50409 - RNA, 20 nt, Artificial Sequence
  Synthetic
cgguaauuagcagcuuuuaa

SEQ ID NO: 50410 - RNA, 20 nt, Artificial Sequence
  Synthetic
ggcgaucucguccgugcaca

SEQ ID NO: 50411 - RNA, 20 nt, Artificial Sequence
  Synthetic
cgccaccgggguguugcaca

SEQ ID NO: 50412 - RNA, 20 nt, Artificial Sequence
  Synthetic
cgaggcgggcagcacggaca

SEQ ID NO: 50413 - RNA, 20 nt, Artificial Sequence
  Synthetic
uuccgcuuccuccucaccca

SEQ ID NO: 50414 - RNA, 20 nt, Artificial Sequence
  Synthetic
ccgccgcuccgcccgcccca

SEQ ID NO: 50415 - RNA, 20 nt, Artificial Sequence
  Synthetic
cggcccccggccgagcgcca

SEQ ID NO: 50416 - RNA, 20 nt, Artificial Sequence
  Synthetic
caccuccgaggcgggcagca

SEQ ID NO: 50417 - RNA, 20 nt, Artificial Sequence
  Synthetic
gggaaaacucuggcagcgca

SEQ ID NO: 50418 - RNA, 20 nt, Artificial Sequence
  Synthetic
cccacgcccgccgacgcgca

SEQ ID NO: 50419 - RNA, 20 nt, Artificial Sequence
  Synthetic
ccggccgccauccccgcgca

SEQ ID NO: 50420 - RNA, 20 nt, Artificial Sequence
  Synthetic
augcagaaggggugcaggca

SEQ ID NO: 50421 - RNA, 20 nt, Artificial Sequence
  Synthetic
ggaauccaggucuucaugca

SEQ ID NO: 50422 - RNA, 20 nt, Artificial Sequence
  Synthetic
cgacgugugcgccgugugca

SEQ ID NO: 50423 - RNA, 20 nt, Artificial Sequence
  Synthetic
cuucaugcacgggaugcaga

SEQ ID NO: 50424 - RNA, 20 nt, Artificial Sequence
  Synthetic
gccgcucuccgaagagacga

SEQ ID NO: 50425 - RNA, 20 nt, Artificial Sequence
  Synthetic
uucaacccuagaccgcccga

SEQ ID NO: 50426 - RNA, 20 nt, Artificial Sequence
  Synthetic
gcggagccccggagcuccga

SEQ ID NO: 50427 - RNA, 20 nt, Artificial Sequence
  Synthetic
aguaauuacgcggggagcga

SEQ ID NO: 50428 - RNA, 20 nt, Artificial Sequence
  Synthetic
ccccgcguauauauccgcga

SEQ ID NO: 50429 - RNA, 20 nt, Artificial Sequence
  Synthetic
gucuaggguugaaccggcga

SEQ ID NO: 50430 - RNA, 20 nt, Artificial Sequence
  Synthetic
gguaauuaaaaacguucgga

SEQ ID NO: 50431 - RNA, 20 nt, Artificial Sequence
  Synthetic
aggaggaagcggaagcggga

SEQ ID NO: 50432 - RNA, 20 nt, Artificial Sequence
  Synthetic
ggggucguucacuaucggga

SEQ ID NO: 50433 - RNA, 20 nt, Artificial Sequence
  Synthetic
cuaauuaccaugcgcgggga

SEQ ID NO: 50434 - RNA, 20 nt, Artificial Sequence
  Synthetic
gauguucgaggcgggccuga

SEQ ID NO: 50435 - RNA, 20 nt, Artificial Sequence
  Synthetic
cggagguggagucgcgguga

SEQ ID NO: 50436 - RNA, 20 nt, Artificial Sequence
  Synthetic
ccgggccgucgggcggucua

SEQ ID NO: 50437 - RNA, 20 nt, Artificial Sequence
  Synthetic
cccgcgccggcuucccggua

SEQ ID NO: 50438 - RNA, 20 nt, Artificial Sequence
  Synthetic
cgggccgccauucccgcuua

SEQ ID NO: 50439 - RNA, 20 nt, Artificial Sequence
  Synthetic
cgggcggucuaggguugaac

SEQ ID NO: 50440 - RNA, 20 nt, Artificial Sequence
  Synthetic
gguaauuagcagcuuuuaac

SEQ ID NO: 50441 - RNA, 20 nt, Artificial Sequence
  Synthetic
uccgcuuccuccucacccac

SEQ ID NO: 50442 - RNA, 20 nt, Artificial Sequence
  Synthetic
cccacuaucagguacgccac

SEQ ID NO: 50443 - RNA, 20 nt, Artificial Sequence
  Synthetic
gaauccaggucuucaugcac

SEQ ID NO: 50444 - RNA, 20 nt, Artificial Sequence
  Synthetic
acgccaccgggguguugcac

SEQ ID NO: 50445 - RNA, 20 nt, Artificial Sequence
  Synthetic
aaaguuucuaauuaccauac

SEQ ID NO: 50446 - RNA, 20 nt, Artificial Sequence
  Synthetic
ccacuaucagguacgccacc

SEQ ID NO: 50447 - RNA, 20 nt, Artificial Sequence
  Synthetic
gcaucccgugcaugaagacc

SEQ ID NO: 50448 - RNA, 20 nt, Artificial Sequence
  Synthetic
aaguuucuaauuaccauacc

SEQ ID NO: 50449 - RNA, 20 nt, Artificial Sequence
  Synthetic
guguccccugugcaacaccc

SEQ ID NO: 50450 - RNA, 20 nt, Artificial Sequence
  Synthetic
ucccgauagugaacgacccc

SEQ ID NO: 50451 - RNA, 20 nt, Artificial Sequence
  Synthetic
gguuggccggcgccgccccc

SEQ ID NO: 50452 - RNA, 20 nt, Artificial Sequence
  Synthetic
caugucguugagcauccccc

SEQ ID NO: 50453 - RNA, 20 nt, Artificial Sequence
  Synthetic
gauggacgcggccacgcccc

SEQ ID NO: 50454 - RNA, 20 nt, Artificial Sequence
  Synthetic
cccgccgcuccgcccgcccc

SEQ ID NO: 50455 - RNA, 20 nt, Artificial Sequence
  Synthetic
cacgcccccggcccggcccc

SEQ ID NO: 50456 - RNA, 20 nt, Artificial Sequence
  Synthetic
ggccucggccggcggagccc

SEQ ID NO: 50457 - RNA, 20 nt, Artificial Sequence
  Synthetic
cgcgggcccggacuccgccc

SEQ ID NO: 50458 - RNA, 20 nt, Artificial Sequence
  Synthetic
ccuagaccgcccgacggccc

SEQ ID NO: 50459 - RNA, 20 nt, Artificial Sequence
  Synthetic
uccuccgccgccgcgggccc

SEQ ID NO: 50460 - RNA, 20 nt, Artificial Sequence
  Synthetic
cggcgggcguggggcugccc

SEQ ID NO: 50461 - RNA, 20 nt, Artificial Sequence
  Synthetic
ccggcccccggccgagcgcc

SEQ ID NO: 50462 - RNA, 20 nt, Artificial Sequence
  Synthetic
cggagcggcggggcggcgcc

SEQ ID NO: 50463 - RNA, 20 nt, Artificial Sequence
  Synthetic
gccggcgcggggcggucgcc

SEQ ID NO: 50464 - RNA, 20 nt, Artificial Sequence
  Synthetic
cccuagaccgcccgacggcc

SEQ ID NO: 50465 - RNA, 20 nt, Artificial Sequence
  Synthetic
acgcggccacgcccccggcc

SEQ ID NO: 50466 - RNA, 20 nt, Artificial Sequence
  Synthetic
caugcgcggggauggcggcc

SEQ ID NO: 50467 - RNA, 20 nt, Artificial Sequence
  Synthetic
ggcugcccuggcgcucggcc

SEQ ID NO: 50468 - RNA, 20 nt, Artificial Sequence
  Synthetic
cguauauauccgcgagggcc

SEQ ID NO: 50469 - RNA, 20 nt, Artificial Sequence
  Synthetic
gcucggccgggggccgggcc

SEQ ID NO: 50470 - RNA, 20 nt, Artificial Sequence
  Synthetic
guccuccgccgccgcgggcc

SEQ ID NO: 50471 - RNA, 20 nt, Artificial Sequence
  Synthetic
cgcgcgccgccgcgcgggcc

SEQ ID NO: 50472 - RNA, 20 nt, Artificial Sequence
  Synthetic
cuggcgcucggccgggggcc

SEQ ID NO: 50473 - RNA, 20 nt, Artificial Sequence
  Synthetic
cguguugcgcaacggaaucc

SEQ ID NO: 50474 - RNA, 20 nt, Artificial Sequence
  Synthetic
gcgcagaccuucggagcucc

SEQ ID NO: 50475 - RNA, 20 nt, Artificial Sequence
  Synthetic
cggucgccggggcggagucc

SEQ ID NO: 50476 - RNA, 20 nt, Artificial Sequence
  Synthetic
aaacuuuuaauaggcggucc

SEQ ID NO: 50477 - RNA, 20 nt, Artificial Sequence
  Synthetic
accgccccgcgccggcuucc

SEQ ID NO: 50478 - RNA, 20 nt, Artificial Sequence
  Synthetic
aauuacucccucgggguucc

SEQ ID NO: 50479 - RNA, 20 nt, Artificial Sequence
  Synthetic
ggugaggaggaagcggaagc

SEQ ID NO: 50480 - RNA, 20 nt, Artificial Sequence
  Synthetic
uaauuaccauaccgggaagc

SEQ ID NO: 50481 - RNA, 20 nt, Artificial Sequence
  Synthetic
cguuuuuaauuaccauaagc

SEQ ID NO: 50482 - RNA, 20 nt, Artificial Sequence
  Synthetic
uagugggcgugaccgccagc

SEQ ID NO: 50483 - RNA, 20 nt, Artificial Sequence
  Synthetic
agcugcuaauuaccgcgagc

SEQ ID NO: 50484 - RNA, 20 nt, Artificial Sequence
  Synthetic
auuaccgcgagcgggaacgc

SEQ ID NO: 50485 - RNA, 20 nt, Artificial Sequence
  Synthetic
gcccucgcggauauauacgc

SEQ ID NO: 50486 - RNA, 20 nt, Artificial Sequence
  Synthetic
ccccgagggaguaauuacgc

SEQ ID NO: 50487 - RNA, 20 nt, Artificial Sequence
  Synthetic
gauggugcugaacgacccgc

SEQ ID NO: 50488 - RNA, 20 nt, Artificial Sequence
  Synthetic
acccacgggcccacccccgc

SEQ ID NO: 50489 - RNA, 20 nt, Artificial Sequence
  Synthetic
cgcggguccuccgccgccgc

SEQ ID NO: 50490 - RNA, 20 nt, Artificial Sequence
  Synthetic
ucggagcuccggggcuccgc

SEQ ID NO: 50491 - RNA, 20 nt, Artificial Sequence
  Synthetic
agggaaaacucuggcagcgc

SEQ ID NO: 50492 - RNA, 20 nt, Artificial Sequence
  Synthetic
ccccacgcccgccgacgcgc

SEQ ID NO: 50493 - RNA, 20 nt, Artificial Sequence
  Synthetic
ccccggcgaccgccccgcgc

SEQ ID NO: 50494 - RNA, 20 nt, Artificial Sequence
  Synthetic
ccaaccgcgcgccgccgcgc

SEQ ID NO: 50495 - RNA, 20 nt, Artificial Sequence
  Synthetic
aggcggcggcggcggcgcgc

SEQ ID NO: 50496 - RNA, 20 nt, Artificial Sequence
  Synthetic
ccauaccgggaagccggcgc

SEQ ID NO: 50497 - RNA, 20 nt, Artificial Sequence
  Synthetic
gcggagcggcggggcggcgc

SEQ ID NO: 50498 - RNA, 20 nt, Artificial Sequence
  Synthetic
cccgccccagggggcggcgc

SEQ ID NO: 50499 - RNA, 20 nt, Artificial Sequence
  Synthetic
aguugcuaauuaccaugcgc

SEQ ID NO: 50500 - RNA, 20 nt, Artificial Sequence
  Synthetic
ccggccgaggccgcccucgc

SEQ ID NO: 50501 - RNA, 20 nt, Artificial Sequence
  Synthetic
agccggcgcggggcggucgc

SEQ ID NO: 50502 - RNA, 20 nt, Artificial Sequence
  Synthetic
gaugcagaaggggugcaggc

SEQ ID NO: 50503 - RNA, 20 nt, Artificial Sequence
  Synthetic
cgcgacuccaccuccgaggc

SEQ ID NO: 50504 - RNA, 20 nt, Artificial Sequence
  Synthetic
gacacggagauguucgaggc

SEQ ID NO: 50505 - RNA, 20 nt, Artificial Sequence
  Synthetic
ccuggggcgggcggagcggc

SEQ ID NO: 50506 - RNA, 20 nt, Artificial Sequence
  Synthetic
ccaugcgcggggauggcggc

SEQ ID NO: 50507 - RNA, 20 nt, Artificial Sequence
  Synthetic
ccggcgagggcggccucggc

SEQ ID NO: 50508 - RNA, 20 nt, Artificial Sequence
  Synthetic
gggcugcccuggcgcucggc

SEQ ID NO: 50509 - RNA, 20 nt, Artificial Sequence
  Synthetic
caggaucccugcgcgucggc

SEQ ID NO: 50510 - RNA, 20 nt, Artificial Sequence
  Synthetic
cgcucggccgggggccgggc

SEQ ID NO: 50511 - RNA, 20 nt, Artificial Sequence
  Synthetic
aacucuggcagcgcaggggc

SEQ ID NO: 50512 - RNA, 20 nt, Artificial Sequence
  Synthetic
ccuggcgcucggccgggggc

SEQ ID NO: 50513 - RNA, 20 nt, Artificial Sequence
  Synthetic
ccggcgccgcccccuggggc

SEQ ID NO: 50514 - RNA, 20 nt, Artificial Sequence
  Synthetic
auuagcaacuuuuaaugggc

SEQ ID NO: 50515 - RNA, 20 nt, Artificial Sequence
  Synthetic
cgcggcggcgcgcgguuggc

SEQ ID NO: 50516 - RNA, 20 nt, Artificial Sequence
  Synthetic
ccgacgcgcagggauccugc

SEQ ID NO: 50517 - RNA, 20 nt, Artificial Sequence
  Synthetic
cuccuccuccgagucgcugc

SEQ ID NO: 50518 - RNA, 20 nt, Artificial Sequence
  Synthetic
acgggaugcagaaggggugc

SEQ ID NO: 50519 - RNA, 20 nt, Artificial Sequence
  Synthetic
ggggcguggccgcguccauc

SEQ ID NO: 50520 - RNA, 20 nt, Artificial Sequence
  Synthetic
uggcggucacgcccacuauc

SEQ ID NO: 50521 - RNA, 20 nt, Artificial Sequence
  Synthetic
uccgggggucguucacuauc

SEQ ID NO: 50522 - RNA, 20 nt, Artificial Sequence
  Synthetic
ggugcaggcagggaaaacuc

SEQ ID NO: 50523 - RNA, 20 nt, Artificial Sequence
  Synthetic
ccccgcguaauuacucccuc

SEQ ID NO: 50524 - RNA, 20 nt, Artificial Sequence
  Synthetic
cgcgcagaccuucggagcuc

SEQ ID NO: 50525 - RNA, 20 nt, Artificial Sequence
  Synthetic
gcggucgccggggcggaguc

SEQ ID NO: 50526 - RNA, 20 nt, Artificial Sequence
  Synthetic
cgccgcgggcccgggccguc

SEQ ID NO: 50527 - RNA, 20 nt, Artificial Sequence
  Synthetic
uaauuacucccucgggguuc

SEQ ID NO: 50528 - RNA, 20 nt, Artificial Sequence
  Synthetic
ucaugcacgggaugcagaag

SEQ ID NO: 50529 - RNA, 20 nt, Artificial Sequence
  Synthetic
gcccgugggugaggaggaag

SEQ ID NO: 50530 - RNA, 20 nt, Artificial Sequence
  Synthetic
gggugaggaggaagcggaag

SEQ ID NO: 50531 - RNA, 20 nt, Artificial Sequence
  Synthetic
acguuuuuaauuaccauaag

SEQ ID NO: 50532 - RNA, 20 nt, Artificial Sequence
  Synthetic
gccaccgggguguugcacag

SEQ ID NO: 50533 - RNA, 20 nt, Artificial Sequence
  Synthetic
cgccgcuccgcccgccccag

SEQ ID NO: 50534 - RNA, 20 nt, Artificial Sequence
  Synthetic
auagugggcgugaccgccag

SEQ ID NO: 50535 - RNA, 20 nt, Artificial Sequence
  Synthetic
ggaaaacucuggcagcgcag

SEQ ID NO: 50536 - RNA, 20 nt, Artificial Sequence
  Synthetic
ggaugcucaacgacaugcag

SEQ ID NO: 50537 - RNA, 20 nt, Artificial Sequence
  Synthetic
cccaucgucucuucggagag

SEQ ID NO: 50538 - RNA, 20 nt, Artificial Sequence
  Synthetic
guaauuacgcggggagcgag

SEQ ID NO: 50539 - RNA, 20 nt, Artificial Sequence
  Synthetic
aagcugcuaauuaccgcgag

SEQ ID NO: 50540 - RNA, 20 nt, Artificial Sequence
  Synthetic
gcccccuggggcgggcggag

SEQ ID NO: 50541 - RNA, 20 nt, Artificial Sequence
  Synthetic
ggaggaagcggaagcgggag

SEQ ID NO: 50542 - RNA, 20 nt, Artificial Sequence
  Synthetic
cccgguggcguaccugauag

SEQ ID NO: 50543 - RNA, 20 nt, Artificial Sequence
  Synthetic
cgaggcgggccugauggacg

SEQ ID NO: 50544 - RNA, 20 nt, Artificial Sequence
  Synthetic
ggcccucgcggauauauacg

SEQ ID NO: 50545 - RNA, 20 nt, Artificial Sequence
  Synthetic
accccgagggaguaauuacg

SEQ ID NO: 50546 - RNA, 20 nt, Artificial Sequence
  Synthetic
cacuaucagguacgccaccg

SEQ ID NO: 50547 - RNA, 20 nt, Artificial Sequence
  Synthetic
cgacucggaggaggagaccg

SEQ ID NO: 50548 - RNA, 20 nt, Artificial Sequence
  Synthetic
cgcccgacggcccgggcccg

SEQ ID NO: 50549 - RNA, 20 nt, Artificial Sequence
  Synthetic
auccugcgggggugggcccg

SEQ ID NO: 50550 - RNA, 20 nt, Artificial Sequence
  Synthetic
gcgcggguccuccgccgccg

SEQ ID NO: 50551 - RNA, 20 nt, Artificial Sequence
  Synthetic
ccggcgcggggcggucgccg

SEQ ID NO: 50552 - RNA, 20 nt, Artificial Sequence
  Synthetic
cuccggggcuccgccggccg

SEQ ID NO: 50553 - RNA, 20 nt, Artificial Sequence
  Synthetic
gcugcccuggcgcucggccg

SEQ ID NO: 50554 - RNA, 20 nt, Artificial Sequence
  Synthetic
cucggccgggggccgggccg

SEQ ID NO: 50555 - RNA, 20 nt, Artificial Sequence
  Synthetic
ucaccgcgacuccaccuccg

SEQ ID NO: 50556 - RNA, 20 nt, Artificial Sequence
  Synthetic
cgccgccuccuccuccuccg

SEQ ID NO: 50557 - RNA, 20 nt, Artificial Sequence
  Synthetic
cgcagaccuucggagcuccg

SEQ ID NO: 50558 - RNA, 20 nt, Artificial Sequence
  Synthetic
gaguaauuacgcggggagcg

SEQ ID NO: 50559 - RNA, 20 nt, Artificial Sequence
  Synthetic
cccucgcggauauauacgcg

SEQ ID NO: 50560 - RNA, 20 nt, Artificial Sequence
  Synthetic
cccgagggaguaauuacgcg

SEQ ID NO: 50561 - RNA, 20 nt, Artificial Sequence
  Synthetic
gaacgacccccggacccgcg

SEQ ID NO: 50562 - RNA, 20 nt, Artificial Sequence
  Synthetic
gggcggaguccgggcccgcg

SEQ ID NO: 50563 - RNA, 20 nt, Artificial Sequence
  Synthetic
gccaaccgcgcgccgccgcg

SEQ ID NO: 50564 - RNA, 20 nt, Artificial Sequence
  Synthetic
gccccgcguauauauccgcg

SEQ ID NO: 50565 - RNA, 20 nt, Artificial Sequence
  Synthetic
cauaccgggaagccggcgcg

SEQ ID NO: 50566 - RNA, 20 nt, Artificial Sequence
  Synthetic
cgggcccgcgcggcggcgcg

SEQ ID NO: 50567 - RNA, 20 nt, Artificial Sequence
  Synthetic
gaggcggcggcggcggcgcg

SEQ ID NO: 50568 - RNA, 20 nt, Artificial Sequence
  Synthetic
guugcuaauuaccaugcgcg

SEQ ID NO: 50569 - RNA, 20 nt, Artificial Sequence
  Synthetic
gagcuccgaaggucugcgcg

SEQ ID NO: 50570 - RNA, 20 nt, Artificial Sequence
  Synthetic
ggucuaggguugaaccggcg

SEQ ID NO: 50571 - RNA, 20 nt, Artificial Sequence
  Synthetic
accauaccgggaagccggcg

SEQ ID NO: 50572 - RNA, 20 nt, Artificial Sequence
  Synthetic
cuggggcgggcggagcggcg

SEQ ID NO: 50573 - RNA, 20 nt, Artificial Sequence
  Synthetic
ucccugcgcgucggcgggcg

SEQ ID NO: 50574 - RNA, 20 nt, Artificial Sequence
  Synthetic
acucuggcagcgcaggggcg

SEQ ID NO: 50575 - RNA, 20 nt, Artificial Sequence
  Synthetic
cgggggccgggccgggggcg

SEQ ID NO: 50576 - RNA, 20 nt, Artificial Sequence
  Synthetic
aaguugcuaauuaccaugcg

SEQ ID NO: 50577 - RNA, 20 nt, Artificial Sequence
  Synthetic
cgacgcgcagggauccugcg

SEQ ID NO: 50578 - RNA, 20 nt, Artificial Sequence
  Synthetic
ggggcggcgccgggcccucg

SEQ ID NO: 50579 - RNA, 20 nt, Artificial Sequence
  Synthetic
cccgcguaauuacucccucg

SEQ ID NO: 50580 - RNA, 20 nt, Artificial Sequence
  Synthetic
ugggccggcguucccgcucg

SEQ ID NO: 50581 - RNA, 20 nt, Artificial Sequence
  Synthetic
ccgccucggagguggagucg

SEQ ID NO: 50582 - RNA, 20 nt, Artificial Sequence
  Synthetic
cacggacacggagauguucg

SEQ ID NO: 50583 - RNA, 20 nt, Artificial Sequence
  Synthetic
gccgcuccgcccgccccagg

SEQ ID NO: 50584 - RNA, 20 nt, Artificial Sequence
  Synthetic
cucggaggaggagaccgagg

SEQ ID NO: 50585 - RNA, 20 nt, Artificial Sequence
  Synthetic
ccgcgacuccaccuccgagg

SEQ ID NO: 50586 - RNA, 20 nt, Artificial Sequence
  Synthetic
ggacacggagauguucgagg

SEQ ID NO: 50587 - RNA, 20 nt, Artificial Sequence
  Synthetic
cgccagcagcgacucggagg

SEQ ID NO: 50588 - RNA, 20 nt, Artificial Sequence
  Synthetic
cgugcugcccgccucggagg

SEQ ID NO: 50589 - RNA, 20 nt, Artificial Sequence
  Synthetic
gaggaagcggaagcgggagg

SEQ ID NO: 50590 - RNA, 20 nt, Artificial Sequence
  Synthetic
gggugggcccgugggugagg

SEQ ID NO: 50591 - RNA, 20 nt, Artificial Sequence
  Synthetic
aauuagaaacuuuuaauagg

SEQ ID NO: 50592 - RNA, 20 nt, Artificial Sequence
  Synthetic
uccccugugcaacaccccgg

SEQ ID NO: 50593 - RNA, 20 nt, Artificial Sequence
  Synthetic
gcgagggcggccucggccgg

SEQ ID NO: 50594 - RNA, 20 nt, Artificial Sequence
  Synthetic
cugcccuggcgcucggccgg

SEQ ID NO: 50595 - RNA, 20 nt, Artificial Sequence
  Synthetic
ucggccgggggccgggccgg

SEQ ID NO: 50596 - RNA, 20 nt, Artificial Sequence
  Synthetic
cccuggggcgggcggagcgg

SEQ ID NO: 50597 - RNA, 20 nt, Artificial Sequence
  Synthetic
ccgacggcccgggcccgcgg

SEQ ID NO: 50598 - RNA, 20 nt, Artificial Sequence
  Synthetic
cggaguccgggcccgcgcgg

SEQ ID NO: 50599 - RNA, 20 nt, Artificial Sequence
  Synthetic
cgcggaggaggaggaggcgg

SEQ ID NO: 50600 - RNA, 20 nt, Artificial Sequence
  Synthetic
acggcccgggcccgcggcgg

SEQ ID NO: 50601 - RNA, 20 nt, Artificial Sequence
  Synthetic
ggaggaggaggaggcggcgg

SEQ ID NO: 50602 - RNA, 20 nt, Artificial Sequence
  Synthetic
gcccgggcccgcggcggcgg

SEQ ID NO: 50603 - RNA, 20 nt, Artificial Sequence
  Synthetic
ggaggaggaggcggcggcgg

SEQ ID NO: 50604 - RNA, 20 nt, Artificial Sequence
  Synthetic
gacgcgcagggauccugcgg

SEQ ID NO: 50605 - RNA, 20 nt, Artificial Sequence
  Synthetic
gcucgccagcagcgacucgg

SEQ ID NO: 50606 - RNA, 20 nt, Artificial Sequence
  Synthetic
guccgugcugcccgccucgg

SEQ ID NO: 50607 - RNA, 20 nt, Artificial Sequence
  Synthetic
gcaggaucccugcgcgucgg

SEQ ID NO: 50608 - RNA, 20 nt, Artificial Sequence
  Synthetic
uaggguugaaccggcgaggg

SEQ ID NO: 50609 - RNA, 20 nt, Artificial Sequence
  Synthetic
aggaagcggaagcgggaggg

SEQ ID NO: 50610 - RNA, 20 nt, Artificial Sequence
  Synthetic
gaggaggaagcggaagcggg

SEQ ID NO: 50611 - RNA, 20 nt, Artificial Sequence
  Synthetic
gcgccgcccccuggggcggg

SEQ ID NO: 50612 - RNA, 20 nt, Artificial Sequence
  Synthetic
cgcgggcccgggccgucggg

SEQ ID NO: 50613 - RNA, 20 nt, Artificial Sequence
  Synthetic
aaacucuggcagcgcagggg

SEQ ID NO: 50614 - RNA, 20 nt, Artificial Sequence
  Synthetic
ggaagcggaagcgggagggg

SEQ ID NO: 50615 - RNA, 20 nt, Artificial Sequence
  Synthetic
gcgcggggcggucgccgggg

SEQ ID NO: 50616 - RNA, 20 nt, Artificial Sequence
  Synthetic
accgggaagccggcgcgggg

SEQ ID NO: 50617 - RNA, 20 nt, Artificial Sequence
  Synthetic
gggcgggcggagcggcgggg

SEQ ID NO: 50618 - RNA, 20 nt, Artificial Sequence
  Synthetic
gcuccgcccgccccaggggg

SEQ ID NO: 50619 - RNA, 20 nt, Artificial Sequence
  Synthetic
gaagcggaagcgggaggggg

SEQ ID NO: 50620 - RNA, 20 nt, Artificial Sequence
  Synthetic
gcgcagggauccugcggggg

SEQ ID NO: 50621 - RNA, 20 nt, Artificial Sequence
  Synthetic
gccggcgccgcccccugggg

SEQ ID NO: 50622 - RNA, 20 nt, Artificial Sequence
  Synthetic
auuaccauaagcgggaaugg

SEQ ID NO: 50623 - RNA, 20 nt, Artificial Sequence
  Synthetic
auuaccaugcgcggggaugg

SEQ ID NO: 50624 - RNA, 20 nt, Artificial Sequence
  Synthetic
ggugcugaacgacccgcugg

SEQ ID NO: 50625 - RNA, 20 nt, Artificial Sequence
  Synthetic
cgacccccggacccgcgugg

SEQ ID NO: 50626 - RNA, 20 nt, Artificial Sequence
  Synthetic
uuggccggcgccgcccccug

SEQ ID NO: 50627 - RNA, 20 nt, Artificial Sequence
  Synthetic
gccgacgcgcagggauccug

SEQ ID NO: 50628 - RNA, 20 nt, Artificial Sequence
  Synthetic
ccugcgcgucggcgggcgug

SEQ ID NO: 50629 - RNA, 20 nt, Artificial Sequence
  Synthetic
cgggggugggcccgugggug

SEQ ID NO: 50630 - RNA, 20 nt, Artificial Sequence
  Synthetic
gguaauuagaaacuuuuaau

SEQ ID NO: 50631 - RNA, 20 nt, Artificial Sequence
  Synthetic
gguaauuagcaacuuuuaau

SEQ ID NO: 50632 - RNA, 20 nt, Artificial Sequence
  Synthetic
ccgcucuccgaagagacgau

SEQ ID NO: 50633 - RNA, 20 nt, Artificial Sequence
  Synthetic
guccgggggucguucacuau

SEQ ID NO: 50634 - RNA, 20 nt, Artificial Sequence
  Synthetic
guggcucgccagcagcgacu

SEQ ID NO: 50635 - RNA, 20 nt, Artificial Sequence
  Synthetic
gucgucagagauucccaccu

SEQ ID NO: 50636 - RNA, 20 nt, Artificial Sequence
  Synthetic
guuggccggcgccgcccccu

SEQ ID NO: 50637 - RNA, 20 nt, Artificial Sequence
  Synthetic
uccccgcguaauuacucccu

SEQ ID NO: 50638 - RNA, 20 nt, Artificial Sequence
  Synthetic
cguguccgugcugcccgccu

SEQ ID NO: 50639 - RNA, 20 nt, Artificial Sequence
  Synthetic
ugaaccggcgagggcggccu

SEQ ID NO: 50640 - RNA, 20 nt, Artificial Sequence
  Synthetic
cguggggcugcccuggcgcu

SEQ ID NO: 50641 - RNA, 20 nt, Artificial Sequence
  Synthetic
cccgggccgucgggcggucu

SEQ ID NO: 50642 - RNA, 20 nt, Artificial Sequence
  Synthetic
ccgguggcguaccugauagu

SEQ ID NO: 50643 - RNA, 20 nt, Artificial Sequence
  Synthetic
uccugcgggggugggcccgu

SEQ ID NO: 50644 - RNA, 20 nt, Artificial Sequence
  Synthetic
ccgccgcgggcccgggccgu

SEQ ID NO: 50645 - RNA, 20 nt, Artificial Sequence
  Synthetic
cccgcaggaucccugcgcgu

SEQ ID NO: 50646 - RNA, 20 nt, Artificial Sequence
  Synthetic
cccugcgcgucggcgggcgu

SEQ ID NO: 50647 - RNA, 20 nt, Artificial Sequence
  Synthetic
ucggaggaggagaccgaggu

SEQ ID NO: 50648 - RNA, 20 nt, Artificial Sequence
  Synthetic
cccgcgcggcggcgcgcggu

SEQ ID NO: 50649 - RNA, 20 nt, Artificial Sequence
  Synthetic
cgcagggauccugcgggggu

SEQ ID NO: 50650 - RNA, 20 nt, Artificial Sequence
  Synthetic
agcggccucgcgcagaccuu

SEQ ID NO: 50651 - RNA, 20 nt, Artificial Sequence
  Synthetic
cggggcucccaucgucucuu

SEQ ID NO: 50652 - RNA, 20 nt, Artificial Sequence
  Synthetic
uuaugguaauuaaaaacguu

SEQ ID NO: 50653 - RNA, 20 nt, Artificial Sequence
  Synthetic
gccccguccccggggaccaa

SEQ ID NO: 50654 - RNA, 21 nt, Artificial Sequence
  Synthetic
ggccccguccccggggaccaa

SEQ ID NO: 50655 - RNA, 23 nt, Artificial Sequence
  Synthetic
gcggccccguccccggggaccaa

SEQ ID NO: 50656 - RNA, 24 nt, Artificial Sequence
  Synthetic
ggcggccccguccccggggaccaa

SEQ ID NO: 50657 - RNA, 21 nt, Artificial Sequence
  Synthetic
gccccggcgggggcggaggga

SEQ ID NO: 50658 - RNA, 23 nt, Artificial Sequence
  Synthetic
gcgccccggcgggggcggaggga

SEQ ID NO: 50659 - RNA, 18 nt, Artificial Sequence
  Synthetic
gggcggcgcacggcccac

SEQ ID NO: 50660 - RNA, 19 nt, Artificial Sequence
  Synthetic
ggggcggcgcacggcccac

SEQ ID NO: 50661 - RNA, 20 nt, Artificial Sequence
  Synthetic
gggggcggcgcacggcccac

SEQ ID NO: 50662 - RNA, 21 nt, Artificial Sequence
  Synthetic
ggggggcggcgcacggcccac

SEQ ID NO: 50663 - RNA, 24 nt, Artificial Sequence
  Synthetic
gucggggggcggcgcacggcccac

SEQ ID NO: 50664 - RNA, 22 nt, Artificial Sequence
  Synthetic
gaaaagggggggccugagaccc

SEQ ID NO: 50665 - RNA, 23 nt, Artificial Sequence
  Synthetic
ggaaaagggggggccugagaccc

SEQ ID NO: 50666 - RNA, 24 nt, Artificial Sequence
  Synthetic
gggaaaagggggggccugagaccc

SEQ ID NO: 50667 - RNA, 24 nt, Artificial Sequence
  Synthetic
gucccccgaccgcuuaagcgggcc

SEQ ID NO: 50668 - RNA, 19 nt, Artificial Sequence
  Synthetic
gucgcccucucaccgugcc

SEQ ID NO: 50669 - RNA, 20 nt, Artificial Sequence
  Synthetic
ggucgcccucucaccgugcc

SEQ ID NO: 50670 - RNA, 21 nt, Artificial Sequence
  Synthetic
gggucgcccucucaccgugcc

SEQ ID NO: 50671 - RNA, 22 nt, Artificial Sequence
  Synthetic
ggggucgcccucucaccgugcc

SEQ ID NO: 50672 - RNA, 23 nt, Artificial Sequence
  Synthetic
gggggucgcccucucaccgugcc

SEQ ID NO: 50673 - RNA, 21 nt, Artificial Sequence
  Synthetic
gcccgggagcucgugccgggc

SEQ ID NO: 50674 - RNA, 21 nt, Artificial Sequence
  Synthetic
gccgcggcggccgcucggggc

SEQ ID NO: 50675 - RNA, 19 nt, Artificial Sequence
  Synthetic
gcuccgucgcucgcagugc

SEQ ID NO: 50676 - RNA, 22 nt, Artificial Sequence
  Synthetic
gccgcuccgucgcucgcagugc

SEQ ID NO: 50677 - RNA, 21 nt, Artificial Sequence
  Synthetic
gcgaccacccccaacccgcag

SEQ ID NO: 50678 - RNA, 21 nt, Artificial Sequence
  Synthetic
gcugcuugacaaagcaacggg

SEQ ID NO: 50679 - RNA, 22 nt, Artificial Sequence
  Synthetic
ggcugcuugacaaagcaacggg

SEQ ID NO: 50680 - RNA, 23 nt, Artificial Sequence
  Synthetic
gggcugcuugacaaagcaacggg

SEQ ID NO: 50681 - RNA, 22 nt, Artificial Sequence
  Synthetic
gcggcccgcggucucucucuug

SEQ ID NO: 50682 - RNA, 23 nt, Artificial Sequence
  Synthetic
ggcggcccgcggucucucucuug

SEQ ID NO: 50683 - RNA, 19 nt, Artificial Sequence
  Synthetic
gccccccgccgacgcagau

SEQ ID NO: 50684 - RNA, 22 nt, Artificial Sequence
  Synthetic
gccgccccccgccgacgcagau

SEQ ID NO: 50685 - RNA, 24 nt, Artificial Sequence
  Synthetic
gcgccgccccccgccgacgcagau

SEQ ID NO: 50686 - RNA, 24 nt, Artificial Sequence
  Synthetic
guaaccaaagguggucugcguccu

SEQ ID NO: 50687 - RNA, 23 nt, Artificial Sequence
  Synthetic
gccggguuuuagucucugucucu

SEQ ID NO: 50688 - RNA, 18 nt, Artificial Sequence
  Synthetic
gggggcggcgcaugcuaa

SEQ ID NO: 50689 - RNA, 19 nt, Artificial Sequence
  Synthetic
ggggggcggcgcaugcuaa

SEQ ID NO: 50690 - RNA, 21 nt, Artificial Sequence
  Synthetic
gcggggggcggcgcaugcuaa

SEQ ID NO: 50691 - RNA, 22 nt, Artificial Sequence
  Synthetic
ggcggggggcggcgcaugcuaa

SEQ ID NO: 50692 - RNA, 23 nt, Artificial Sequence
  Synthetic
guaaaugccgccccuuuggggga

SEQ ID NO: 50693 - RNA, 18 nt, Artificial Sequence
  Synthetic
gggcuuccuaguaugcua

SEQ ID NO: 50694 - RNA, 20 nt, Artificial Sequence
  Synthetic
gcacggugagagggcgaccc

SEQ ID NO: 50695 - RNA, 21 nt, Artificial Sequence
  Synthetic
ggcacggugagagggcgaccc

SEQ ID NO: 50696 - RNA, 19 nt, Artificial Sequence
  Synthetic
gacacgggggacacggcgc

SEQ ID NO: 50697 - RNA, 20 nt, Artificial Sequence
  Synthetic
ggacacgggggacacggcgc

SEQ ID NO: 50698 - RNA, 21 nt, Artificial Sequence
  Synthetic
gggacacgggggacacggcgc

SEQ ID NO: 50699 - RNA, 23 nt, Artificial Sequence
  Synthetic
gagggacacgggggacacggcgc

SEQ ID NO: 50700 - RNA, 24 nt, Artificial Sequence
  Synthetic
ggagggacacgggggacacggcgc

SEQ ID NO: 50701 - RNA, 19 nt, Artificial Sequence
  Synthetic
gagaccgcgggccgccguc

SEQ ID NO: 50702 - RNA, 21 nt, Artificial Sequence
  Synthetic
gagagaccgcgggccgccguc

SEQ ID NO: 50703 - RNA, 23 nt, Artificial Sequence
  Synthetic
gagagagaccgcgggccgccguc

SEQ ID NO: 50704 - RNA, 22 nt, Artificial Sequence
  Synthetic
gcgggggacagggggggagacg

SEQ ID NO: 50705 - RNA, 24 nt, Artificial Sequence
  Synthetic
gagcgggggacagggggggagacg

SEQ ID NO: 50706 - RNA, 18 nt, Artificial Sequence
  Synthetic
gcagagccucgcgcgccg

SEQ ID NO: 50707 - RNA, 24 nt, Artificial Sequence
  Synthetic
gaacacgcagagccucgcgcgccg

SEQ ID NO: 50708 - RNA, 19 nt, Artificial Sequence
  Synthetic
gagccucgcgcgccgccgg

SEQ ID NO: 50709 - RNA, 22 nt, Artificial Sequence
  Synthetic
gcagagccucgcgcgccgccgg

SEQ ID NO: 50710 - RNA, 18 nt, Artificial Sequence
  Synthetic
ggggccgccccgagaggg

SEQ ID NO: 50711 - RNA, 21 nt, Artificial Sequence
  Synthetic
gacggggccgccccgagaggg

SEQ ID NO: 50712 - RNA, 22 nt, Artificial Sequence
  Synthetic
ggacggggccgccccgagaggg

SEQ ID NO: 50713 - RNA, 23 nt, Artificial Sequence
  Synthetic
gggacggggccgccccgagaggg

SEQ ID NO: 50714 - RNA, 24 nt, Artificial Sequence
  Synthetic
ggggacggggccgccccgagaggg

SEQ ID NO: 50715 - RNA, 21 nt, Artificial Sequence
  Synthetic
gccggggcgcgcggcuauugg

SEQ ID NO: 50716 - RNA, 19 nt, Artificial Sequence
  Synthetic
guaaaugccgccccuuugg

SEQ ID NO: 50717 - RNA, 24 nt, Artificial Sequence
  Synthetic
gaaucguaaaugccgccccuuugg

SEQ ID NO: 50718 - RNA, 18 nt, Artificial Sequence
  Synthetic
gcaugcuaaugggguucu

SEQ ID NO: 50719 - RNA, 20 nt, Artificial Sequence
  Synthetic
gcgcaugcuaaugggguucu

SEQ ID NO: 50720 - RNA, 21 nt, Artificial Sequence
  Synthetic
ggcgcaugcuaaugggguucu

SEQ ID NO: 50721 - RNA, 23 nt, Artificial Sequence
  Synthetic
gcggcgcaugcuaaugggguucu

SEQ ID NO: 50722 - RNA, 24 nt, Artificial Sequence
  Synthetic
ggcggcgcaugcuaaugggguucu

SEQ ID NO: 50723 - RNA, 22 nt, Artificial Sequence
  Synthetic
gacagggggggagacgaggggu

SEQ ID NO: 50724 - RNA, 23 nt, Artificial Sequence
  Synthetic
ggacagggggggagacgaggggu

SEQ ID NO: 50725 - RNA, 24 nt, Artificial Sequence
  Synthetic
gggacagggggggagacgaggggu

SEQ ID NO: 50726 - RNA, 18 nt, Artificial Sequence
  Synthetic
cccguccccggggaccaa

SEQ ID NO: 50727 - RNA, 19 nt, Artificial Sequence
  Synthetic
ccccguccccggggaccaa

SEQ ID NO: 50728 - RNA, 22 nt, Artificial Sequence
  Synthetic
cggccccguccccggggaccaa

SEQ ID NO: 50729 - RNA, 21 nt, Artificial Sequence
  Synthetic
uuguucggaagggggggagaa

SEQ ID NO: 50730 - RNA, 22 nt, Artificial Sequence
  Synthetic
uuuguucggaagggggggagaa

SEQ ID NO: 50731 - RNA, 23 nt, Artificial Sequence
  Synthetic
uuuuguucggaagggggggagaa

SEQ ID NO: 50732 - RNA, 24 nt, Artificial Sequence
  Synthetic
uuuuuguucggaagggggggagaa

SEQ ID NO: 50733 - RNA, 21 nt, Artificial Sequence
  Synthetic
ccugccucccucgccccccca

SEQ ID NO: 50734 - RNA, 22 nt, Artificial Sequence
  Synthetic
cccugccucccucgccccccca

SEQ ID NO: 50735 - RNA, 23 nt, Artificial Sequence
  Synthetic
ucccugccucccucgccccccca

SEQ ID NO: 50736 - RNA, 24 nt, Artificial Sequence
  Synthetic
cucccugccucccucgccccccca

SEQ ID NO: 50737 - RNA, 22 nt, Artificial Sequence
  Synthetic
cgccccggcgggggcggaggga

SEQ ID NO: 50738 - RNA, 24 nt, Artificial Sequence
  Synthetic
cgcgccccggcgggggcggaggga

SEQ ID NO: 50739 - RNA, 22 nt, Artificial Sequence
  Synthetic
cggggggcggcgcacggcccac

SEQ ID NO: 50740 - RNA, 23 nt, Artificial Sequence
  Synthetic
ucggggggcggcgcacggcccac

SEQ ID NO: 50741 - RNA, 21 nt, Artificial Sequence
  Synthetic
aaaagggggggccugagaccc

SEQ ID NO: 50742 - RNA, 21 nt, Artificial Sequence
  Synthetic
cggcgccccgccggcgcggcc

SEQ ID NO: 50743 - RNA, 22 nt, Artificial Sequence
  Synthetic
ccggcgccccgccggcgcggcc

SEQ ID NO: 50744 - RNA, 23 nt, Artificial Sequence
  Synthetic
cccggcgccccgccggcgcggcc

SEQ ID NO: 50745 - RNA, 24 nt, Artificial Sequence
  Synthetic
ccccggcgccccgccggcgcggcc

SEQ ID NO: 50746 - RNA, 18 nt, Artificial Sequence
  Synthetic
cgaccgcuuaagcgggcc

SEQ ID NO: 50747 - RNA, 19 nt, Artificial Sequence
  Synthetic
ccgaccgcuuaagcgggcc

SEQ ID NO: 50748 - RNA, 20 nt, Artificial Sequence
  Synthetic
cccgaccgcuuaagcgggcc

SEQ ID NO: 50749 - RNA, 21 nt, Artificial Sequence
  Synthetic
ccccgaccgcuuaagcgggcc

SEQ ID NO: 50750 - RNA, 22 nt, Artificial Sequence
  Synthetic
cccccgaccgcuuaagcgggcc

SEQ ID NO: 50751 - RNA, 23 nt, Artificial Sequence
  Synthetic
ucccccgaccgcuuaagcgggcc

SEQ ID NO: 50752 - RNA, 18 nt, Artificial Sequence
  Synthetic
ucgcccucucaccgugcc

SEQ ID NO: 50753 - RNA, 24 nt, Artificial Sequence
  Synthetic
cgggggucgcccucucaccgugcc

SEQ ID NO: 50754 - RNA, 18 nt, Artificial Sequence
  Synthetic
cgggagcucgugccgggc

SEQ ID NO: 50755 - RNA, 19 nt, Artificial Sequence
  Synthetic
ccgggagcucgugccgggc

SEQ ID NO: 50756 - RNA, 20 nt, Artificial Sequence
  Synthetic
cccgggagcucgugccgggc

SEQ ID NO: 50757 - RNA, 22 nt, Artificial Sequence
  Synthetic
cgcccgggagcucgugccgggc

SEQ ID NO: 50758 - RNA, 23 nt, Artificial Sequence
  Synthetic
ccgcccgggagcucgugccgggc

SEQ ID NO: 50759 - RNA, 24 nt, Artificial Sequence
  Synthetic
uccgcccgggagcucgugccgggc

SEQ ID NO: 50760 - RNA, 22 nt, Artificial Sequence
  Synthetic
ugccgcggcggccgcucggggc

SEQ ID NO: 50761 - RNA, 23 nt, Artificial Sequence
  Synthetic
cugccgcggcggccgcucggggc

SEQ ID NO: 50762 - RNA, 24 nt, Artificial Sequence
  Synthetic
ucugccgcggcggccgcucggggc

SEQ ID NO: 50763 - RNA, 18 nt, Artificial Sequence
  Synthetic
cuccgucgcucgcagugc

SEQ ID NO: 50764 - RNA, 20 nt, Artificial Sequence
  Synthetic
cgcuccgucgcucgcagugc

SEQ ID NO: 50765 - RNA, 21 nt, Artificial Sequence
  Synthetic
ccgcuccgucgcucgcagugc

SEQ ID NO: 50766 - RNA, 23 nt, Artificial Sequence
  Synthetic
cgccgcuccgucgcucgcagugc

SEQ ID NO: 50767 - RNA, 24 nt, Artificial Sequence
  Synthetic
ccgccgcuccgucgcucgcagugc

SEQ ID NO: 50768 - RNA, 22 nt, Artificial Sequence
  Synthetic
cgcgaccacccccaacccgcag

SEQ ID NO: 50769 - RNA, 23 nt, Artificial Sequence
  Synthetic
ccgcgaccacccccaacccgcag

SEQ ID NO: 50770 - RNA, 24 nt, Artificial Sequence
  Synthetic
cccgcgaccacccccaacccgcag

SEQ ID NO: 50771 - RNA, 24 nt, Artificial Sequence
  Synthetic
cgggcugcuugacaaagcaacggg

SEQ ID NO: 50772 - RNA, 21 nt, Artificial Sequence
  Synthetic
cggcccgcggucucucucuug

SEQ ID NO: 50773 - RNA, 24 nt, Artificial Sequence
  Synthetic
cggcggcccgcggucucucucuug

SEQ ID NO: 50774 - RNA, 18 nt, Artificial Sequence
  Synthetic
ccccccgccgacgcagau

SEQ ID NO: 50775 - RNA, 20 nt, Artificial Sequence
  Synthetic
cgccccccgccgacgcagau

SEQ ID NO: 50776 - RNA, 21 nt, Artificial Sequence
  Synthetic
ccgccccccgccgacgcagau

SEQ ID NO: 50777 - RNA, 23 nt, Artificial Sequence
  Synthetic
cgccgccccccgccgacgcagau

SEQ ID NO: 50778 - RNA, 18 nt, Artificial Sequence
  Synthetic
aaagguggucugcguccu

SEQ ID NO: 50779 - RNA, 19 nt, Artificial Sequence
  Synthetic
caaagguggucugcguccu

SEQ ID NO: 50780 - RNA, 20 nt, Artificial Sequence
  Synthetic
ccaaagguggucugcguccu

SEQ ID NO: 50781 - RNA, 21 nt, Artificial Sequence
  Synthetic
accaaagguggucugcguccu

SEQ ID NO: 50782 - RNA, 22 nt, Artificial Sequence
  Synthetic
aaccaaagguggucugcguccu

SEQ ID NO: 50783 - RNA, 23 nt, Artificial Sequence
  Synthetic
uaaccaaagguggucugcguccu

SEQ ID NO: 50784 - RNA, 21 nt, Artificial Sequence
  Synthetic
cggguuuuagucucugucucu

SEQ ID NO: 50785 - RNA, 22 nt, Artificial Sequence
  Synthetic
ccggguuuuagucucugucucu

SEQ ID NO: 50786 - RNA, 24 nt, Artificial Sequence
  Synthetic
ugccggguuuuagucucugucucu

SEQ ID NO: 50787 - RNA, 21 nt, Artificial Sequence
  Synthetic
cgucgcucgcagugccggggu

SEQ ID NO: 50788 - RNA, 22 nt, Artificial Sequence
  Synthetic
ccgucgcucgcagugccggggu

SEQ ID NO: 50789 - RNA, 23 nt, Artificial Sequence
  Synthetic
uccgucgcucgcagugccggggu

SEQ ID NO: 50790 - RNA, 24 nt, Artificial Sequence
  Synthetic
cuccgucgcucgcagugccggggu

SEQ ID NO: 50791 - RNA, 20 nt, Artificial Sequence
  Synthetic
cggggggcggcgcaugcuaa

SEQ ID NO: 50792 - RNA, 23 nt, Artificial Sequence
  Synthetic
cggcggggggcggcgcaugcuaa

SEQ ID NO: 50793 - RNA, 24 nt, Artificial Sequence
  Synthetic
ucggcggggggcggcgcaugcuaa

SEQ ID NO: 50794 - RNA, 21 nt, Artificial Sequence
  Synthetic
aaaugccgccccuuuggggga

SEQ ID NO: 50795 - RNA, 22 nt, Artificial Sequence
  Synthetic
uaaaugccgccccuuuggggga

SEQ ID NO: 50796 - RNA, 24 nt, Artificial Sequence
  Synthetic
cguaaaugccgccccuuuggggga

SEQ ID NO: 50797 - RNA, 19 nt, Artificial Sequence
  Synthetic
ugggcuuccuaguaugcua

SEQ ID NO: 50798 - RNA, 20 nt, Artificial Sequence
  Synthetic
cugggcuuccuaguaugcua

SEQ ID NO: 50799 - RNA, 21 nt, Artificial Sequence
  Synthetic
ccugggcuuccuaguaugcua

SEQ ID NO: 50800 - RNA, 22 nt, Artificial Sequence
  Synthetic
cccugggcuuccuaguaugcua

SEQ ID NO: 50801 - RNA, 23 nt, Artificial Sequence
  Synthetic
ccccugggcuuccuaguaugcua

SEQ ID NO: 50802 - RNA, 24 nt, Artificial Sequence
  Synthetic
uccccugggcuuccuaguaugcua

SEQ ID NO: 50803 - RNA, 18 nt, Artificial Sequence
  Synthetic
acggugagagggcgaccc

SEQ ID NO: 50804 - RNA, 19 nt, Artificial Sequence
  Synthetic
cacggugagagggcgaccc

SEQ ID NO: 50805 - RNA, 22 nt, Artificial Sequence
  Synthetic
cggcacggugagagggcgaccc

SEQ ID NO: 50806 - RNA, 23 nt, Artificial Sequence
  Synthetic
ccggcacggugagagggcgaccc

SEQ ID NO: 50807 - RNA, 24 nt, Artificial Sequence
  Synthetic
cccggcacggugagagggcgaccc

SEQ ID NO: 50808 - RNA, 18 nt, Artificial Sequence
  Synthetic
acacgggggacacggcgc

SEQ ID NO: 50809 - RNA, 22 nt, Artificial Sequence
  Synthetic
agggacacgggggacacggcgc

SEQ ID NO: 50810 - RNA, 21 nt, Artificial Sequence
  Synthetic
aaaaagcagcgggcggggggc

SEQ ID NO: 50811 - RNA, 22 nt, Artificial Sequence
  Synthetic
caaaaagcagcgggcggggggc

SEQ ID NO: 50812 - RNA, 23 nt, Artificial Sequence
  Synthetic
acaaaaagcagcgggcggggggc

SEQ ID NO: 50813 - RNA, 24 nt, Artificial Sequence
  Synthetic
aacaaaaagcagcgggcggggggc

SEQ ID NO: 50814 - RNA, 18 nt, Artificial Sequence
  Synthetic
agaccgcgggccgccguc

SEQ ID NO: 50815 - RNA, 20 nt, Artificial Sequence
  Synthetic
agagaccgcgggccgccguc

SEQ ID NO: 50816 - RNA, 22 nt, Artificial Sequence
  Synthetic
agagagaccgcgggccgccguc

SEQ ID NO: 50817 - RNA, 24 nt, Artificial Sequence
  Synthetic
agagagagaccgcgggccgccguc

SEQ ID NO: 50818 - RNA, 21 nt, Artificial Sequence
  Synthetic
cgggggacagggggggagacg

SEQ ID NO: 50819 - RNA, 23 nt, Artificial Sequence
  Synthetic
agcgggggacagggggggagacg

SEQ ID NO: 50820 - RNA, 19 nt, Artificial Sequence
  Synthetic
cgcagagccucgcgcgccg

SEQ ID NO: 50821 - RNA, 20 nt, Artificial Sequence
  Synthetic
acgcagagccucgcgcgccg

SEQ ID NO: 50822 - RNA, 21 nt, Artificial Sequence
  Synthetic
cacgcagagccucgcgcgccg

SEQ ID NO: 50823 - RNA, 22 nt, Artificial Sequence
  Synthetic
acacgcagagccucgcgcgccg

SEQ ID NO: 50824 - RNA, 23 nt, Artificial Sequence
  Synthetic
aacacgcagagccucgcgcgccg

SEQ ID NO: 50825 - RNA, 21 nt, Artificial Sequence
  Synthetic
cuuugggggaguggauaggcg

SEQ ID NO: 50826 - RNA, 22 nt, Artificial Sequence
  Synthetic
ccuuugggggaguggauaggcg

SEQ ID NO: 50827 - RNA, 23 nt, Artificial Sequence
  Synthetic
cccuuugggggaguggauaggcg

SEQ ID NO: 50828 - RNA, 24 nt, Artificial Sequence
  Synthetic
ccccuuugggggaguggauaggcg

SEQ ID NO: 50829 - RNA, 18 nt, Artificial Sequence
  Synthetic
agccucgcgcgccgccgg

SEQ ID NO: 50830 - RNA, 20 nt, Artificial Sequence
  Synthetic
agagccucgcgcgccgccgg

SEQ ID NO: 50831 - RNA, 21 nt, Artificial Sequence
  Synthetic
cagagccucgcgcgccgccgg

SEQ ID NO: 50832 - RNA, 23 nt, Artificial Sequence
  Synthetic
cgcagagccucgcgcgccgccgg

SEQ ID NO: 50833 - RNA, 24 nt, Artificial Sequence
  Synthetic
acgcagagccucgcgcgccgccgg

SEQ ID NO: 50834 - RNA, 19 nt, Artificial Sequence
  Synthetic
cggggccgccccgagaggg

SEQ ID NO: 50835 - RNA, 20 nt, Artificial Sequence
  Synthetic
acggggccgccccgagaggg

SEQ ID NO: 50836 - RNA, 22 nt, Artificial Sequence
  Synthetic
cgccggggcgcgcggcuauugg

SEQ ID NO: 50837 - RNA, 23 nt, Artificial Sequence
  Synthetic
ccgccggggcgcgcggcuauugg

SEQ ID NO: 50838 - RNA, 24 nt, Artificial Sequence
  Synthetic
cccgccggggcgcgcggcuauugg

SEQ ID NO: 50839 - RNA, 18 nt, Artificial Sequence
  Synthetic
uaaaugccgccccuuugg

SEQ ID NO: 50840 - RNA, 20 nt, Artificial Sequence
  Synthetic
cguaaaugccgccccuuugg

SEQ ID NO: 50841 - RNA, 21 nt, Artificial Sequence
  Synthetic
ucguaaaugccgccccuuugg

SEQ ID NO: 50842 - RNA, 22 nt, Artificial Sequence
  Synthetic
aucguaaaugccgccccuuugg

SEQ ID NO: 50843 - RNA, 23 nt, Artificial Sequence
  Synthetic
aaucguaaaugccgccccuuugg

SEQ ID NO: 50844 - RNA, 18 nt, Artificial Sequence
  Synthetic
uccccggaccacccggcu

SEQ ID NO: 50845 - RNA, 19 nt, Artificial Sequence
  Synthetic
uuccccggaccacccggcu

SEQ ID NO: 50846 - RNA, 20 nt, Artificial Sequence
  Synthetic
uuuccccggaccacccggcu

SEQ ID NO: 50847 - RNA, 21 nt, Artificial Sequence
  Synthetic
uuuuccccggaccacccggcu

SEQ ID NO: 50848 - RNA, 22 nt, Artificial Sequence
  Synthetic
cuuuuccccggaccacccggcu

SEQ ID NO: 50849 - RNA, 23 nt, Artificial Sequence
  Synthetic
ccuuuuccccggaccacccggcu

SEQ ID NO: 50850 - RNA, 24 nt, Artificial Sequence
  Synthetic
cccuuuuccccggaccacccggcu

SEQ ID NO: 50851 - RNA, 19 nt, Artificial Sequence
  Synthetic
cgcaugcuaaugggguucu

SEQ ID NO: 50852 - RNA, 22 nt, Artificial Sequence
  Synthetic
cggcgcaugcuaaugggguucu

SEQ ID NO: 50853 - RNA, 21 nt, Artificial Sequence
  Synthetic
acagggggggagacgaggggu

SEQ ID NO: 50854 - RNA, 21 nt, Artificial Sequence
  Synthetic
cggaccacccggcugcggguu

SEQ ID NO: 50855 - RNA, 22 nt, Artificial Sequence
  Synthetic
ccggaccacccggcugcggguu

SEQ ID NO: 50856 - RNA, 23 nt, Artificial Sequence
  Synthetic
cccggaccacccggcugcggguu

SEQ ID NO: 50857 - RNA, 24 nt, Artificial Sequence
  Synthetic
ccccggaccacccggcugcggguu

SEQ ID NO: 50858 - RNA, 18 nt, Artificial Sequence
  Synthetic
uucggaagggggggagaa

SEQ ID NO: 50859 - RNA, 19 nt, Artificial Sequence
  Synthetic
guucggaagggggggagaa

SEQ ID NO: 50860 - RNA, 20 nt, Artificial Sequence
  Synthetic
uguucggaagggggggagaa

SEQ ID NO: 50861 - RNA, 18 nt, Artificial Sequence
  Synthetic
gccucccucgccccccca

SEQ ID NO: 50862 - RNA, 19 nt, Artificial Sequence
  Synthetic
ugccucccucgccccccca

SEQ ID NO: 50863 - RNA, 20 nt, Artificial Sequence
  Synthetic
cugccucccucgccccccca

SEQ ID NO: 50864 - RNA, 18 nt, Artificial Sequence
  Synthetic
ccggcgggggcggaggga

SEQ ID NO: 50865 - RNA, 19 nt, Artificial Sequence
  Synthetic
cccggcgggggcggaggga

SEQ ID NO: 50866 - RNA, 20 nt, Artificial Sequence
  Synthetic
ccccggcgggggcggaggga

SEQ ID NO: 50867 - RNA, 18 nt, Artificial Sequence
  Synthetic
agggggggccugagaccc

SEQ ID NO: 50868 - RNA, 19 nt, Artificial Sequence
  Synthetic
aagggggggccugagaccc

SEQ ID NO: 50869 - RNA, 20 nt, Artificial Sequence
  Synthetic
aaagggggggccugagaccc

SEQ ID NO: 50870 - RNA, 18 nt, Artificial Sequence
  Synthetic
cgccccgccggcgcggcc

SEQ ID NO: 50871 - RNA, 19 nt, Artificial Sequence
  Synthetic
gcgccccgccggcgcggcc

SEQ ID NO: 50872 - RNA, 20 nt, Artificial Sequence
  Synthetic
ggcgccccgccggcgcggcc

SEQ ID NO: 50873 - RNA, 18 nt, Artificial Sequence
  Synthetic
gcggcggccgcucggggc

SEQ ID NO: 50874 - RNA, 19 nt, Artificial Sequence
  Synthetic
cgcggcggccgcucggggc

SEQ ID NO: 50875 - RNA, 20 nt, Artificial Sequence
  Synthetic
ccgcggcggccgcucggggc

SEQ ID NO: 50876 - RNA, 18 nt, Artificial Sequence
  Synthetic
accacccccaacccgcag

SEQ ID NO: 50877 - RNA, 19 nt, Artificial Sequence
  Synthetic
gaccacccccaacccgcag

SEQ ID NO: 50878 - RNA, 20 nt, Artificial Sequence
  Synthetic
cgaccacccccaacccgcag

SEQ ID NO: 50879 - RNA, 18 nt, Artificial Sequence
  Synthetic
gcuugacaaagcaacggg

SEQ ID NO: 50880 - RNA, 19 nt, Artificial Sequence
  Synthetic
ugcuugacaaagcaacggg

SEQ ID NO: 50881 - RNA, 20 nt, Artificial Sequence
  Synthetic
cugcuugacaaagcaacggg

SEQ ID NO: 50882 - RNA, 18 nt, Artificial Sequence
  Synthetic
cccgcggucucucucuug

SEQ ID NO: 50883 - RNA, 19 nt, Artificial Sequence
  Synthetic
gcccgcggucucucucuug

SEQ ID NO: 50884 - RNA, 20 nt, Artificial Sequence
  Synthetic
ggcccgcggucucucucuug

SEQ ID NO: 50885 - RNA, 18 nt, Artificial Sequence
  Synthetic
guuuuagucucugucucu

SEQ ID NO: 50886 - RNA, 19 nt, Artificial Sequence
  Synthetic
gguuuuagucucugucucu

SEQ ID NO: 50887 - RNA, 20 nt, Artificial Sequence
  Synthetic
ggguuuuagucucugucucu

SEQ ID NO: 50888 - RNA, 18 nt, Artificial Sequence
  Synthetic
cgcucgcagugccggggu

SEQ ID NO: 50889 - RNA, 19 nt, Artificial Sequence
  Synthetic
ucgcucgcagugccggggu

SEQ ID NO: 50890 - RNA, 20 nt, Artificial Sequence
  Synthetic
gucgcucgcagugccggggu

SEQ ID NO: 50891 - RNA, 18 nt, Artificial Sequence
  Synthetic
ugccgccccuuuggggga

SEQ ID NO: 50892 - RNA, 19 nt, Artificial Sequence
  Synthetic
augccgccccuuuggggga

SEQ ID NO: 50893 - RNA, 20 nt, Artificial Sequence
  Synthetic
aaugccgccccuuuggggga

SEQ ID NO: 50894 - RNA, 18 nt, Artificial Sequence
  Synthetic
aagcagcgggcggggggc

SEQ ID NO: 50895 - RNA, 19 nt, Artificial Sequence
  Synthetic
aaagcagcgggcggggggc

SEQ ID NO: 50896 - RNA, 20 nt, Artificial Sequence
  Synthetic
aaaagcagcgggcggggggc

SEQ ID NO: 50897 - RNA, 18 nt, Artificial Sequence
  Synthetic
gggacagggggggagacg

SEQ ID NO: 50898 - RNA, 19 nt, Artificial Sequence
  Synthetic
ggggacagggggggagacg

SEQ ID NO: 50899 - RNA, 20 nt, Artificial Sequence
  Synthetic
gggggacagggggggagacg

SEQ ID NO: 50900 - RNA, 18 nt, Artificial Sequence
  Synthetic
ugggggaguggauaggcg

SEQ ID NO: 50901 - RNA, 19 nt, Artificial Sequence
  Synthetic
uugggggaguggauaggcg

SEQ ID NO: 50902 - RNA, 20 nt, Artificial Sequence
  Synthetic
uuugggggaguggauaggcg

SEQ ID NO: 50903 - RNA, 18 nt, Artificial Sequence
  Synthetic
ggggcgcgcggcuauugg

SEQ ID NO: 50904 - RNA, 19 nt, Artificial Sequence
  Synthetic
cggggcgcgcggcuauugg

SEQ ID NO: 50905 - RNA, 20 nt, Artificial Sequence
  Synthetic
ccggggcgcgcggcuauugg

SEQ ID NO: 50906 - RNA, 18 nt, Artificial Sequence
  Synthetic
gggggggagacgaggggu

SEQ ID NO: 50907 - RNA, 19 nt, Artificial Sequence
  Synthetic
agggggggagacgaggggu

SEQ ID NO: 50908 - RNA, 20 nt, Artificial Sequence
  Synthetic
cagggggggagacgaggggu

SEQ ID NO: 50909 - RNA, 18 nt, Artificial Sequence
  Synthetic
accacccggcugcggguu

SEQ ID NO: 50910 - RNA, 19 nt, Artificial Sequence
  Synthetic
gaccacccggcugcggguu

SEQ ID NO: 50911 - RNA, 20 nt, Artificial Sequence
  Synthetic
ggaccacccggcugcggguu

SEQ ID NO: 50912 - RNA, 18 nt, Artificial Sequence
  Synthetic
cgggugguccggggaaaa

SEQ ID NO: 50913 - RNA, 19 nt, Artificial Sequence
  Synthetic
ccgggugguccggggaaaa

SEQ ID NO: 50914 - RNA, 20 nt, Artificial Sequence
  Synthetic
gccgggugguccggggaaaa

SEQ ID NO: 50915 - RNA, 21 nt, Artificial Sequence
  Synthetic
agccgggugguccggggaaaa

SEQ ID NO: 50916 - RNA, 22 nt, Artificial Sequence
  Synthetic
cagccgggugguccggggaaaa

SEQ ID NO: 50917 - RNA, 23 nt, Artificial Sequence
  Synthetic
gcagccgggugguccggggaaaa

SEQ ID NO: 50918 - RNA, 24 nt, Artificial Sequence
  Synthetic
cgcagccgggugguccggggaaaa

SEQ ID NO: 50919 - RNA, 18 nt, Artificial Sequence
  Synthetic
ccgggugguccggggaaa

SEQ ID NO: 50920 - RNA, 19 nt, Artificial Sequence
  Synthetic
gccgggugguccggggaaa

SEQ ID NO: 50921 - RNA, 20 nt, Artificial Sequence
  Synthetic
agccgggugguccggggaaa

SEQ ID NO: 50922 - RNA, 21 nt, Artificial Sequence
  Synthetic
cagccgggugguccggggaaa

SEQ ID NO: 50923 - RNA, 22 nt, Artificial Sequence
  Synthetic
gcagccgggugguccggggaaa

SEQ ID NO: 50924 - RNA, 23 nt, Artificial Sequence
  Synthetic
cgcagccgggugguccggggaaa

SEQ ID NO: 50925 - RNA, 24 nt, Artificial Sequence
  Synthetic
ccgcagccgggugguccggggaaa

SEQ ID NO: 50926 - RNA, 18 nt, Artificial Sequence
  Synthetic
ggaagcccaggggaccaa

SEQ ID NO: 50927 - RNA, 19 nt, Artificial Sequence
  Synthetic
aggaagcccaggggaccaa

SEQ ID NO: 50928 - RNA, 20 nt, Artificial Sequence
  Synthetic
uaggaagcccaggggaccaa

SEQ ID NO: 50929 - RNA, 21 nt, Artificial Sequence
  Synthetic
cuaggaagcccaggggaccaa

SEQ ID NO: 50930 - RNA, 22 nt, Artificial Sequence
  Synthetic
acuaggaagcccaggggaccaa

SEQ ID NO: 50931 - RNA, 23 nt, Artificial Sequence
  Synthetic
uacuaggaagcccaggggaccaa

SEQ ID NO: 50932 - RNA, 24 nt, Artificial Sequence
  Synthetic
auacuaggaagcccaggggaccaa

SEQ ID NO: 50933 - RNA, 18 nt, Artificial Sequence
  Synthetic
gccuauccacucccccaa

SEQ ID NO: 50934 - RNA, 19 nt, Artificial Sequence
  Synthetic
cgccuauccacucccccaa

SEQ ID NO: 50935 - RNA, 20 nt, Artificial Sequence
  Synthetic
gcgccuauccacucccccaa

SEQ ID NO: 50936 - RNA, 21 nt, Artificial Sequence
  Synthetic
ggcgccuauccacucccccaa

SEQ ID NO: 50937 - RNA, 22 nt, Artificial Sequence
  Synthetic
cggcgccuauccacucccccaa

SEQ ID NO: 50938 - RNA, 23 nt, Artificial Sequence
  Synthetic
ccggcgccuauccacucccccaa

SEQ ID NO: 50939 - RNA, 24 nt, Artificial Sequence
  Synthetic
cccggcgccuauccacucccccaa

SEQ ID NO: 50940 - RNA, 18 nt, Artificial Sequence
  Synthetic
ggcugcuugacaaagcaa

SEQ ID NO: 50941 - RNA, 19 nt, Artificial Sequence
  Synthetic
gggcugcuugacaaagcaa

SEQ ID NO: 50942 - RNA, 20 nt, Artificial Sequence
  Synthetic
cgggcugcuugacaaagcaa

SEQ ID NO: 50943 - RNA, 21 nt, Artificial Sequence
  Synthetic
gcgggcugcuugacaaagcaa

SEQ ID NO: 50944 - RNA, 22 nt, Artificial Sequence
  Synthetic
ggcgggcugcuugacaaagcaa

SEQ ID NO: 50945 - RNA, 23 nt, Artificial Sequence
  Synthetic
cggcgggcugcuugacaaagcaa

SEQ ID NO: 50946 - RNA, 24 nt, Artificial Sequence
  Synthetic
gcggcgggcugcuugacaaagcaa

SEQ ID NO: 50947 - RNA, 18 nt, Artificial Sequence
  Synthetic
gcugcuuuuuguucggaa

SEQ ID NO: 50948 - RNA, 19 nt, Artificial Sequence
  Synthetic
cgcugcuuuuuguucggaa

SEQ ID NO: 50949 - RNA, 20 nt, Artificial Sequence
  Synthetic
ccgcugcuuuuuguucggaa

SEQ ID NO: 50950 - RNA, 21 nt, Artificial Sequence
  Synthetic
cccgcugcuuuuuguucggaa

SEQ ID NO: 50951 - RNA, 22 nt, Artificial Sequence
  Synthetic
gcccgcugcuuuuuguucggaa

SEQ ID NO: 50952 - RNA, 23 nt, Artificial Sequence
  Synthetic
cgcccgcugcuuuuuguucggaa

SEQ ID NO: 50953 - RNA, 24 nt, Artificial Sequence
  Synthetic
ccgcccgcugcuuuuuguucggaa

SEQ ID NO: 50954 - RNA, 18 nt, Artificial Sequence
  Synthetic
gccgggugguccggggaa

SEQ ID NO: 50955 - RNA, 19 nt, Artificial Sequence
  Synthetic
agccgggugguccggggaa

SEQ ID NO: 50956 - RNA, 20 nt, Artificial Sequence
  Synthetic
cagccgggugguccggggaa

SEQ ID NO: 50957 - RNA, 21 nt, Artificial Sequence
  Synthetic
gcagccgggugguccggggaa

SEQ ID NO: 50958 - RNA, 22 nt, Artificial Sequence
  Synthetic
cgcagccgggugguccggggaa

SEQ ID NO: 50959 - RNA, 23 nt, Artificial Sequence
  Synthetic
ccgcagccgggugguccggggaa

SEQ ID NO: 50960 - RNA, 24 nt, Artificial Sequence
  Synthetic
cccgcagccgggugguccggggaa

SEQ ID NO: 50961 - RNA, 18 nt, Artificial Sequence
  Synthetic
ggucccccgaccgcuuaa

SEQ ID NO: 50962 - RNA, 19 nt, Artificial Sequence
  Synthetic
gggucccccgaccgcuuaa

SEQ ID NO: 50963 - RNA, 20 nt, Artificial Sequence
  Synthetic
ggggucccccgaccgcuuaa

SEQ ID NO: 50964 - RNA, 21 nt, Artificial Sequence
  Synthetic
gggggucccccgaccgcuuaa

SEQ ID NO: 50965 - RNA, 22 nt, Artificial Sequence
  Synthetic
cgggggucccccgaccgcuuaa

SEQ ID NO: 50966 - RNA, 23 nt, Artificial Sequence
  Synthetic
acgggggucccccgaccgcuuaa

SEQ ID NO: 50967 - RNA, 24 nt, Artificial Sequence
  Synthetic
cacgggggucccccgaccgcuuaa

SEQ ID NO: 50968 - RNA, 18 nt, Artificial Sequence
  Synthetic
ugcggcccgaccgucaca

SEQ ID NO: 50969 - RNA, 19 nt, Artificial Sequence
  Synthetic
augcggcccgaccgucaca

SEQ ID NO: 50970 - RNA, 20 nt, Artificial Sequence
  Synthetic
aaugcggcccgaccgucaca

SEQ ID NO: 50971 - RNA, 21 nt, Artificial Sequence
  Synthetic
gaaugcggcccgaccgucaca

SEQ ID NO: 50972 - RNA, 22 nt, Artificial Sequence
  Synthetic
cgaaugcggcccgaccgucaca

SEQ ID NO: 50973 - RNA, 23 nt, Artificial Sequence
  Synthetic
gcgaaugcggcccgaccgucaca

SEQ ID NO: 50974 - RNA, 24 nt, Artificial Sequence
  Synthetic
ugcgaaugcggcccgaccgucaca

SEQ ID NO: 50975 - RNA, 18 nt, Artificial Sequence
  Synthetic
cgccuauccacuccccca

SEQ ID NO: 50976 - RNA, 19 nt, Artificial Sequence
  Synthetic
gcgccuauccacuccccca

SEQ ID NO: 50977 - RNA, 20 nt, Artificial Sequence
  Synthetic
ggcgccuauccacuccccca

SEQ ID NO: 50978 - RNA, 21 nt, Artificial Sequence
  Synthetic
cggcgccuauccacuccccca

SEQ ID NO: 50979 - RNA, 22 nt, Artificial Sequence
  Synthetic
ccggcgccuauccacuccccca

SEQ ID NO: 50980 - RNA, 23 nt, Artificial Sequence
  Synthetic
cccggcgccuauccacuccccca

SEQ ID NO: 50981 - RNA, 24 nt, Artificial Sequence
  Synthetic
acccggcgccuauccacuccccca

SEQ ID NO: 50982 - RNA, 18 nt, Artificial Sequence
  Synthetic
agcauacuaggaagccca

SEQ ID NO: 50983 - RNA, 19 nt, Artificial Sequence
  Synthetic
uagcauacuaggaagccca

SEQ ID NO: 50984 - RNA, 20 nt, Artificial Sequence
  Synthetic
uuagcauacuaggaagccca

SEQ ID NO: 50985 - RNA, 21 nt, Artificial Sequence
  Synthetic
auuagcauacuaggaagccca

SEQ ID NO: 50986 - RNA, 22 nt, Artificial Sequence
  Synthetic
cauuagcauacuaggaagccca

SEQ ID NO: 50987 - RNA, 23 nt, Artificial Sequence
  Synthetic
ucauuagcauacuaggaagccca

SEQ ID NO: 50988 - RNA, 24 nt, Artificial Sequence
  Synthetic
uucauuagcauacuaggaagccca

SEQ ID NO: 50989 - RNA, 18 nt, Artificial Sequence
  Synthetic
ggggcggcgcacggccca

SEQ ID NO: 50990 - RNA, 19 nt, Artificial Sequence
  Synthetic
gggggcggcgcacggccca

SEQ ID NO: 50991 - RNA, 20 nt, Artificial Sequence
  Synthetic
ggggggcggcgcacggccca

SEQ ID NO: 50992 - RNA, 21 nt, Artificial Sequence
  Synthetic
cggggggcggcgcacggccca

SEQ ID NO: 50993 - RNA, 22 nt, Artificial Sequence
  Synthetic
ucggggggcggcgcacggccca

SEQ ID NO: 50994 - RNA, 23 nt, Artificial Sequence
  Synthetic
gucggggggcggcgcacggccca

SEQ ID NO: 50995 - RNA, 24 nt, Artificial Sequence
  Synthetic
ggucggggggcggcgcacggccca

SEQ ID NO: 50996 - RNA, 18 nt, Artificial Sequence
  Synthetic
gggcugcuugacaaagca

SEQ ID NO: 50997 - RNA, 19 nt, Artificial Sequence
  Synthetic
cgggcugcuugacaaagca

SEQ ID NO: 50998 - RNA, 20 nt, Artificial Sequence
  Synthetic
gcgggcugcuugacaaagca

SEQ ID NO: 50999 - RNA, 21 nt, Artificial Sequence
  Synthetic
ggcgggcugcuugacaaagca

SEQ ID NO: 51000 - RNA, 22 nt, Artificial Sequence
  Synthetic
cggcgggcugcuugacaaagca

SEQ ID NO: 51001 - RNA, 23 nt, Artificial Sequence
  Synthetic
gcggcgggcugcuugacaaagca

SEQ ID NO: 51002 - RNA, 24 nt, Artificial Sequence
  Synthetic
ggcggcgggcugcuugacaaagca

SEQ ID NO: 51003 - RNA, 18 nt, Artificial Sequence
  Synthetic
gccccccgccgacgcaga

SEQ ID NO: 51004 - RNA, 19 nt, Artificial Sequence
  Synthetic
cgccccccgccgacgcaga

SEQ ID NO: 51005 - RNA, 20 nt, Artificial Sequence
  Synthetic
ccgccccccgccgacgcaga

SEQ ID NO: 51006 - RNA, 21 nt, Artificial Sequence
  Synthetic
gccgccccccgccgacgcaga

SEQ ID NO: 51007 - RNA, 22 nt, Artificial Sequence
  Synthetic
cgccgccccccgccgacgcaga

SEQ ID NO: 51008 - RNA, 23 nt, Artificial Sequence
  Synthetic
gcgccgccccccgccgacgcaga

SEQ ID NO: 51009 - RNA, 24 nt, Artificial Sequence
  Synthetic
ugcgccgccccccgccgacgcaga

SEQ ID NO: 51010 - RNA, 18 nt, Artificial Sequence
  Synthetic
guucggaagggggggaga

SEQ ID NO: 51011 - RNA, 19 nt, Artificial Sequence
  Synthetic
uguucggaagggggggaga

SEQ ID NO: 51012 - RNA, 20 nt, Artificial Sequence
  Synthetic
uuguucggaagggggggaga

SEQ ID NO: 51013 - RNA, 21 nt, Artificial Sequence
  Synthetic
uuuguucggaagggggggaga

SEQ ID NO: 51014 - RNA, 22 nt, Artificial Sequence
  Synthetic
uuuuguucggaagggggggaga

SEQ ID NO: 51015 - RNA, 23 nt, Artificial Sequence
  Synthetic
uuuuuguucggaagggggggaga

SEQ ID NO: 51016 - RNA, 24 nt, Artificial Sequence
  Synthetic
cuuuuuguucggaagggggggaga

SEQ ID NO: 51017 - RNA, 18 nt, Artificial Sequence
  Synthetic
cgccccggcgggggcgga

SEQ ID NO: 51018 - RNA, 19 nt, Artificial Sequence
  Synthetic
gcgccccggcgggggcgga

SEQ ID NO: 51019 - RNA, 20 nt, Artificial Sequence
  Synthetic
cgcgccccggcgggggcgga

SEQ ID NO: 51020 - RNA, 21 nt, Artificial Sequence
  Synthetic
gcgcgccccggcgggggcgga

SEQ ID NO: 51021 - RNA, 22 nt, Artificial Sequence
  Synthetic
cgcgcgccccggcgggggcgga

SEQ ID NO: 51022 - RNA, 23 nt, Artificial Sequence
  Synthetic
ccgcgcgccccggcgggggcgga

SEQ ID NO: 51023 - RNA, 24 nt, Artificial Sequence
  Synthetic
gccgcgcgccccggcgggggcgga

SEQ ID NO: 51024 - RNA, 18 nt, Artificial Sequence
  Synthetic
cgcugcuuuuuguucgga

SEQ ID NO: 51025 - RNA, 19 nt, Artificial Sequence
  Synthetic
ccgcugcuuuuuguucgga

SEQ ID NO: 51026 - RNA, 20 nt, Artificial Sequence
  Synthetic
cccgcugcuuuuuguucgga

SEQ ID NO: 51027 - RNA, 21 nt, Artificial Sequence
  Synthetic
gcccgcugcuuuuuguucgga

SEQ ID NO: 51028 - RNA, 22 nt, Artificial Sequence
  Synthetic
cgcccgcugcuuuuuguucgga

SEQ ID NO: 51029 - RNA, 23 nt, Artificial Sequence
  Synthetic
ccgcccgcugcuuuuuguucgga

SEQ ID NO: 51030 - RNA, 24 nt, Artificial Sequence
  Synthetic
cccgcccgcugcuuuuuguucgga

SEQ ID NO: 51031 - RNA, 18 nt, Artificial Sequence
  Synthetic
agcaacgggggggauuua

SEQ ID NO: 51032 - RNA, 19 nt, Artificial Sequence
  Synthetic
aagcaacgggggggauuua

SEQ ID NO: 51033 - RNA, 20 nt, Artificial Sequence
  Synthetic
aaagcaacgggggggauuua

SEQ ID NO: 51034 - RNA, 21 nt, Artificial Sequence
  Synthetic
caaagcaacgggggggauuua

SEQ ID NO: 51035 - RNA, 22 nt, Artificial Sequence
  Synthetic
acaaagcaacgggggggauuua

SEQ ID NO: 51036 - RNA, 23 nt, Artificial Sequence
  Synthetic
gacaaagcaacgggggggauuua

SEQ ID NO: 51037 - RNA, 24 nt, Artificial Sequence
  Synthetic
ugacaaagcaacgggggggauuua

SEQ ID NO: 51038 - RNA, 18 nt, Artificial Sequence
  Synthetic
gcugcuugacaaagcaac

SEQ ID NO: 51039 - RNA, 19 nt, Artificial Sequence
  Synthetic
ggcugcuugacaaagcaac

SEQ ID NO: 51040 - RNA, 20 nt, Artificial Sequence
  Synthetic
gggcugcuugacaaagcaac

SEQ ID NO: 51041 - RNA, 21 nt, Artificial Sequence
  Synthetic
cgggcugcuugacaaagcaac

SEQ ID NO: 51042 - RNA, 22 nt, Artificial Sequence
  Synthetic
gcgggcugcuugacaaagcaac

SEQ ID NO: 51043 - RNA, 23 nt, Artificial Sequence
  Synthetic
ggcgggcugcuugacaaagcaac

SEQ ID NO: 51044 - RNA, 24 nt, Artificial Sequence
  Synthetic
cggcgggcugcuugacaaagcaac

SEQ ID NO: 51045 - RNA, 18 nt, Artificial Sequence
  Synthetic
augcggcccgaccgucac

SEQ ID NO: 51046 - RNA, 19 nt, Artificial Sequence
  Synthetic
aaugcggcccgaccgucac

SEQ ID NO: 51047 - RNA, 20 nt, Artificial Sequence
  Synthetic
gaaugcggcccgaccgucac

SEQ ID NO: 51048 - RNA, 21 nt, Artificial Sequence
  Synthetic
cgaaugcggcccgaccgucac

SEQ ID NO: 51049 - RNA, 22 nt, Artificial Sequence
  Synthetic
gcgaaugcggcccgaccgucac

SEQ ID NO: 51050 - RNA, 23 nt, Artificial Sequence
  Synthetic
ugcgaaugcggcccgaccgucac

SEQ ID NO: 51051 - RNA, 24 nt, Artificial Sequence
  Synthetic
gugcgaaugcggcccgaccgucac

SEQ ID NO: 51052 - RNA, 18 nt, Artificial Sequence
  Synthetic
aaagggggggccugagac

SEQ ID NO: 51053 - RNA, 19 nt, Artificial Sequence
  Synthetic
aaaagggggggccugagac

SEQ ID NO: 51054 - RNA, 20 nt, Artificial Sequence
  Synthetic
gaaaagggggggccugagac

SEQ ID NO: 51055 - RNA, 21 nt, Artificial Sequence
  Synthetic
ggaaaagggggggccugagac

SEQ ID NO: 51056 - RNA, 22 nt, Artificial Sequence
  Synthetic
gggaaaagggggggccugagac

SEQ ID NO: 51057 - RNA, 23 nt, Artificial Sequence
  Synthetic
ggggaaaagggggggccugagac

SEQ ID NO: 51058 - RNA, 24 nt, Artificial Sequence
  Synthetic
cggggaaaagggggggccugagac

SEQ ID NO: 51059 - RNA, 18 nt, Artificial Sequence
  Synthetic
agaaauucauuagcauac

SEQ ID NO: 51060 - RNA, 19 nt, Artificial Sequence
  Synthetic
gagaaauucauuagcauac

SEQ ID NO: 51061 - RNA, 20 nt, Artificial Sequence
  Synthetic
ggagaaauucauuagcauac

SEQ ID NO: 51062 - RNA, 21 nt, Artificial Sequence
  Synthetic
gggagaaauucauuagcauac

SEQ ID NO: 51063 - RNA, 22 nt, Artificial Sequence
  Synthetic
ggggagaaauucauuagcauac

SEQ ID NO: 51064 - RNA, 23 nt, Artificial Sequence
  Synthetic
cggggagaaauucauuagcauac

SEQ ID NO: 51065 - RNA, 24 nt, Artificial Sequence
  Synthetic
ccggggagaaauucauuagcauac

SEQ ID NO: 51066 - RNA, 18 nt, Artificial Sequence
  Synthetic
aagggggggccugagacc

SEQ ID NO: 51067 - RNA, 19 nt, Artificial Sequence
  Synthetic
aaagggggggccugagacc

SEQ ID NO: 51068 - RNA, 20 nt, Artificial Sequence
  Synthetic
aaaagggggggccugagacc

SEQ ID NO: 51069 - RNA, 21 nt, Artificial Sequence
  Synthetic
gaaaagggggggccugagacc

SEQ ID NO: 51070 - RNA, 22 nt, Artificial Sequence
  Synthetic
ggaaaagggggggccugagacc

SEQ ID NO: 51071 - RNA, 23 nt, Artificial Sequence
  Synthetic
gggaaaagggggggccugagacc

SEQ ID NO: 51072 - RNA, 24 nt, Artificial Sequence
  Synthetic
ggggaaaagggggggccugagacc

SEQ ID NO: 51073 - RNA, 18 nt, Artificial Sequence
  Synthetic
cugccucccucgcccccc

SEQ ID NO: 51074 - RNA, 19 nt, Artificial Sequence
  Synthetic
ccugccucccucgcccccc

SEQ ID NO: 51075 - RNA, 20 nt, Artificial Sequence
  Synthetic
cccugccucccucgcccccc

SEQ ID NO: 51076 - RNA, 21 nt, Artificial Sequence
  Synthetic
ucccugccucccucgcccccc

SEQ ID NO: 51077 - RNA, 22 nt, Artificial Sequence
  Synthetic
cucccugccucccucgcccccc

SEQ ID NO: 51078 - RNA, 23 nt, Artificial Sequence
  Synthetic
ccucccugccucccucgcccccc

SEQ ID NO: 51079 - RNA, 24 nt, Artificial Sequence
  Synthetic
uccucccugccucccucgcccccc

SEQ ID NO: 51080 - RNA, 18 nt, Artificial Sequence
  Synthetic
ugaguggugcccgccccc

SEQ ID NO: 51081 - RNA, 19 nt, Artificial Sequence
  Synthetic
cugaguggugcccgccccc

SEQ ID NO: 51082 - RNA, 20 nt, Artificial Sequence
  Synthetic
ccugaguggugcccgccccc

SEQ ID NO: 51083 - RNA, 21 nt, Artificial Sequence
  Synthetic
cccugaguggugcccgccccc

SEQ ID NO: 51084 - RNA, 22 nt, Artificial Sequence
  Synthetic
gcccugaguggugcccgccccc

SEQ ID NO: 51085 - RNA, 23 nt, Artificial Sequence
  Synthetic
ggcccugaguggugcccgccccc

SEQ ID NO: 51086 - RNA, 24 nt, Artificial Sequence
  Synthetic
cggcccugaguggugcccgccccc

SEQ ID NO: 51087 - RNA, 18 nt, Artificial Sequence
  Synthetic
cugaguggugcccgcccc

SEQ ID NO: 51088 - RNA, 19 nt, Artificial Sequence
  Synthetic
ccugaguggugcccgcccc

SEQ ID NO: 51089 - RNA, 20 nt, Artificial Sequence
  Synthetic
cccugaguggugcccgcccc

SEQ ID NO: 51090 - RNA, 21 nt, Artificial Sequence
  Synthetic
gcccugaguggugcccgcccc

SEQ ID NO: 51091 - RNA, 22 nt, Artificial Sequence
  Synthetic
ggcccugaguggugcccgcccc

SEQ ID NO: 51092 - RNA, 23 nt, Artificial Sequence
  Synthetic
cggcccugaguggugcccgcccc

SEQ ID NO: 51093 - RNA, 24 nt, Artificial Sequence
  Synthetic
gcggcccugaguggugcccgcccc

SEQ ID NO: 51094 - RNA, 18 nt, Artificial Sequence
  Synthetic
cggggcggccccgucccc

SEQ ID NO: 51095 - RNA, 19 nt, Artificial Sequence
  Synthetic
ucggggcggccccgucccc

SEQ ID NO: 51096 - RNA, 20 nt, Artificial Sequence
  Synthetic
cucggggcggccccgucccc

SEQ ID NO: 51097 - RNA, 21 nt, Artificial Sequence
  Synthetic
ucucggggcggccccgucccc

SEQ ID NO: 51098 - RNA, 22 nt, Artificial Sequence
  Synthetic
cucucggggcggccccgucccc

SEQ ID NO: 51099 - RNA, 23 nt, Artificial Sequence
  Synthetic
ccucucggggcggccccgucccc

SEQ ID NO: 51100 - RNA, 24 nt, Artificial Sequence
  Synthetic
cccucucggggcggccccgucccc

SEQ ID NO: 51101 - RNA, 18 nt, Artificial Sequence
  Synthetic
uagcauacuaggaagccc

SEQ ID NO: 51102 - RNA, 19 nt, Artificial Sequence
  Synthetic
uuagcauacuaggaagccc

SEQ ID NO: 51103 - RNA, 20 nt, Artificial Sequence
  Synthetic
auuagcauacuaggaagccc

SEQ ID NO: 51104 - RNA, 21 nt, Artificial Sequence
  Synthetic
cauuagcauacuaggaagccc

SEQ ID NO: 51105 - RNA, 22 nt, Artificial Sequence
  Synthetic
ucauuagcauacuaggaagccc

SEQ ID NO: 51106 - RNA, 23 nt, Artificial Sequence
  Synthetic
uucauuagcauacuaggaagccc

SEQ ID NO: 51107 - RNA, 24 nt, Artificial Sequence
  Synthetic
auucauuagcauacuaggaagccc

SEQ ID NO: 51108 - RNA, 18 nt, Artificial Sequence
  Synthetic
cgucaagcguccccgccc

SEQ ID NO: 51109 - RNA, 19 nt, Artificial Sequence
  Synthetic
ccgucaagcguccccgccc

SEQ ID NO: 51110 - RNA, 20 nt, Artificial Sequence
  Synthetic
cccgucaagcguccccgccc

SEQ ID NO: 51111 - RNA, 21 nt, Artificial Sequence
  Synthetic
ccccgucaagcguccccgccc

SEQ ID NO: 51112 - RNA, 22 nt, Artificial Sequence
  Synthetic
gccccgucaagcguccccgccc

SEQ ID NO: 51113 - RNA, 23 nt, Artificial Sequence
  Synthetic
ggccccgucaagcguccccgccc

SEQ ID NO: 51114 - RNA, 24 nt, Artificial Sequence
  Synthetic
cggccccgucaagcguccccgccc

SEQ ID NO: 51115 - RNA, 18 nt, Artificial Sequence
  Synthetic
ccugaguggugcccgccc

SEQ ID NO: 51116 - RNA, 19 nt, Artificial Sequence
  Synthetic
cccugaguggugcccgccc

SEQ ID NO: 51117 - RNA, 20 nt, Artificial Sequence
  Synthetic
gcccugaguggugcccgccc

SEQ ID NO: 51118 - RNA, 21 nt, Artificial Sequence
  Synthetic
ggcccugaguggugcccgccc

SEQ ID NO: 51119 - RNA, 22 nt, Artificial Sequence
  Synthetic
cggcccugaguggugcccgccc

SEQ ID NO: 51120 - RNA, 23 nt, Artificial Sequence
  Synthetic
gcggcccugaguggugcccgccc

SEQ ID NO: 51121 - RNA, 24 nt, Artificial Sequence
  Synthetic
cgcggcccugaguggugcccgccc

SEQ ID NO: 51122 - RNA, 18 nt, Artificial Sequence
  Synthetic
cggggccgggguccgccc

SEQ ID NO: 51123 - RNA, 19 nt, Artificial Sequence
  Synthetic
ucggggccgggguccgccc

SEQ ID NO: 51124 - RNA, 20 nt, Artificial Sequence
  Synthetic
cucggggccgggguccgccc

SEQ ID NO: 51125 - RNA, 21 nt, Artificial Sequence
  Synthetic
gcucggggccgggguccgccc

SEQ ID NO: 51126 - RNA, 22 nt, Artificial Sequence
  Synthetic
cgcucggggccgggguccgccc

SEQ ID NO: 51127 - RNA, 23 nt, Artificial Sequence
  Synthetic
ccgcucggggccgggguccgccc

SEQ ID NO: 51128 - RNA, 24 nt, Artificial Sequence
  Synthetic
gccgcucggggccgggguccgccc

SEQ ID NO: 51129 - RNA, 18 nt, Artificial Sequence
  Synthetic
gggggcggcgcacggccc

SEQ ID NO: 51130 - RNA, 19 nt, Artificial Sequence
  Synthetic
ggggggcggcgcacggccc

SEQ ID NO: 51131 - RNA, 20 nt, Artificial Sequence
  Synthetic
cggggggcggcgcacggccc

SEQ ID NO: 51132 - RNA, 21 nt, Artificial Sequence
  Synthetic
ucggggggcggcgcacggccc

SEQ ID NO: 51133 - RNA, 22 nt, Artificial Sequence
  Synthetic
gucggggggcggcgcacggccc

SEQ ID NO: 51134 - RNA, 23 nt, Artificial Sequence
  Synthetic
ggucggggggcggcgcacggccc

SEQ ID NO: 51135 - RNA, 24 nt, Artificial Sequence
  Synthetic
gggucggggggcggcgcacggccc

SEQ ID NO: 51136 - RNA, 18 nt, Artificial Sequence
  Synthetic
ucggggcggccccguccc

SEQ ID NO: 51137 - RNA, 19 nt, Artificial Sequence
  Synthetic
cucggggcggccccguccc

SEQ ID NO: 51138 - RNA, 20 nt, Artificial Sequence
  Synthetic
ucucggggcggccccguccc

SEQ ID NO: 51139 - RNA, 21 nt, Artificial Sequence
  Synthetic
cucucggggcggccccguccc

SEQ ID NO: 51140 - RNA, 22 nt, Artificial Sequence
  Synthetic
ccucucggggcggccccguccc

SEQ ID NO: 51141 - RNA, 23 nt, Artificial Sequence
  Synthetic
cccucucggggcggccccguccc

SEQ ID NO: 51142 - RNA, 24 nt, Artificial Sequence
  Synthetic
ccccucucggggcggccccguccc

SEQ ID NO: 51143 - RNA, 18 nt, Artificial Sequence
  Synthetic
uuagcauacuaggaagcc

SEQ ID NO: 51144 - RNA, 19 nt, Artificial Sequence
  Synthetic
auuagcauacuaggaagcc

SEQ ID NO: 51145 - RNA, 20 nt, Artificial Sequence
  Synthetic
cauuagcauacuaggaagcc

SEQ ID NO: 51146 - RNA, 21 nt, Artificial Sequence
  Synthetic
ucauuagcauacuaggaagcc

SEQ ID NO: 51147 - RNA, 22 nt, Artificial Sequence
  Synthetic
uucauuagcauacuaggaagcc

SEQ ID NO: 51148 - RNA, 23 nt, Artificial Sequence
  Synthetic
auucauuagcauacuaggaagcc

SEQ ID NO: 51149 - RNA, 24 nt, Artificial Sequence
  Synthetic
aauucauuagcauacuaggaagcc

SEQ ID NO: 51150 - RNA, 18 nt, Artificial Sequence
  Synthetic
ucggggccgggguccgcc

SEQ ID NO: 51151 - RNA, 19 nt, Artificial Sequence
  Synthetic
cucggggccgggguccgcc

SEQ ID NO: 51152 - RNA, 20 nt, Artificial Sequence
  Synthetic
gcucggggccgggguccgcc

SEQ ID NO: 51153 - RNA, 21 nt, Artificial Sequence
  Synthetic
cgcucggggccgggguccgcc

SEQ ID NO: 51154 - RNA, 22 nt, Artificial Sequence
  Synthetic
ccgcucggggccgggguccgcc

SEQ ID NO: 51155 - RNA, 23 nt, Artificial Sequence
  Synthetic
gccgcucggggccgggguccgcc

SEQ ID NO: 51156 - RNA, 24 nt, Artificial Sequence
  Synthetic
ggccgcucggggccgggguccgcc

SEQ ID NO: 51157 - RNA, 18 nt, Artificial Sequence
  Synthetic
ggcucugcguguucugcc

SEQ ID NO: 51158 - RNA, 19 nt, Artificial Sequence
  Synthetic
aggcucugcguguucugcc

SEQ ID NO: 51159 - RNA, 20 nt, Artificial Sequence
  Synthetic
gaggcucugcguguucugcc

SEQ ID NO: 51160 - RNA, 21 nt, Artificial Sequence
  Synthetic
cgaggcucugcguguucugcc

SEQ ID NO: 51161 - RNA, 22 nt, Artificial Sequence
  Synthetic
gcgaggcucugcguguucugcc

SEQ ID NO: 51162 - RNA, 23 nt, Artificial Sequence
  Synthetic
cgcgaggcucugcguguucugcc

SEQ ID NO: 51163 - RNA, 24 nt, Artificial Sequence
  Synthetic
gcgcgaggcucugcguguucugcc

SEQ ID NO: 51164 - RNA, 18 nt, Artificial Sequence
  Synthetic
accaaccggguguacucc

SEQ ID NO: 51165 - RNA, 19 nt, Artificial Sequence
  Synthetic
gaccaaccggguguacucc

SEQ ID NO: 51166 - RNA, 20 nt, Artificial Sequence
  Synthetic
ggaccaaccggguguacucc

SEQ ID NO: 51167 - RNA, 21 nt, Artificial Sequence
  Synthetic
gggaccaaccggguguacucc

SEQ ID NO: 51168 - RNA, 22 nt, Artificial Sequence
  Synthetic
ggggaccaaccggguguacucc

SEQ ID NO: 51169 - RNA, 23 nt, Artificial Sequence
  Synthetic
cggggaccaaccggguguacucc

SEQ ID NO: 51170 - RNA, 24 nt, Artificial Sequence
  Synthetic
ccggggaccaaccggguguacucc

SEQ ID NO: 51171 - RNA, 18 nt, Artificial Sequence
  Synthetic
cucggggcggccccgucc

SEQ ID NO: 51172 - RNA, 19 nt, Artificial Sequence
  Synthetic
ucucggggcggccccgucc

SEQ ID NO: 51173 - RNA, 20 nt, Artificial Sequence
  Synthetic
cucucggggcggccccgucc

SEQ ID NO: 51174 - RNA, 21 nt, Artificial Sequence
  Synthetic
ccucucggggcggccccgucc

SEQ ID NO: 51175 - RNA, 22 nt, Artificial Sequence
  Synthetic
cccucucggggcggccccgucc

SEQ ID NO: 51176 - RNA, 23 nt, Artificial Sequence
  Synthetic
ccccucucggggcggccccgucc

SEQ ID NO: 51177 - RNA, 24 nt, Artificial Sequence
  Synthetic
cccccucucggggcggccccgucc

SEQ ID NO: 51178 - RNA, 18 nt, Artificial Sequence
  Synthetic
cccgcagccggguggucc

SEQ ID NO: 51179 - RNA, 19 nt, Artificial Sequence
  Synthetic
acccgcagccggguggucc

SEQ ID NO: 51180 - RNA, 20 nt, Artificial Sequence
  Synthetic
aacccgcagccggguggucc

SEQ ID NO: 51181 - RNA, 21 nt, Artificial Sequence
  Synthetic
caacccgcagccggguggucc

SEQ ID NO: 51182 - RNA, 22 nt, Artificial Sequence
  Synthetic
ccaacccgcagccggguggucc

SEQ ID NO: 51183 - RNA, 23 nt, Artificial Sequence
  Synthetic
cccaacccgcagccggguggucc

SEQ ID NO: 51184 - RNA, 24 nt, Artificial Sequence
  Synthetic
ccccaacccgcagccggguggucc

SEQ ID NO: 51185 - RNA, 18 nt, Artificial Sequence
  Synthetic
gucugccgcggcggccgc

SEQ ID NO: 51186 - RNA, 19 nt, Artificial Sequence
  Synthetic
ggucugccgcggcggccgc

SEQ ID NO: 51187 - RNA, 20 nt, Artificial Sequence
  Synthetic
gggucugccgcggcggccgc

SEQ ID NO: 51188 - RNA, 21 nt, Artificial Sequence
  Synthetic
ggggucugccgcggcggccgc

SEQ ID NO: 51189 - RNA, 22 nt, Artificial Sequence
  Synthetic
gggggucugccgcggcggccgc

SEQ ID NO: 51190 - RNA, 23 nt, Artificial Sequence
  Synthetic
cgggggucugccgcggcggccgc

SEQ ID NO: 51191 - RNA, 24 nt, Artificial Sequence
  Synthetic
ccgggggucugccgcggcggccgc

SEQ ID NO: 51192 - RNA, 18 nt, Artificial Sequence
  Synthetic
cucggggccgggguccgc

SEQ ID NO: 51193 - RNA, 19 nt, Artificial Sequence
  Synthetic
gcucggggccgggguccgc

SEQ ID NO: 51194 - RNA, 20 nt, Artificial Sequence
  Synthetic
cgcucggggccgggguccgc

SEQ ID NO: 51195 - RNA, 21 nt, Artificial Sequence
  Synthetic
ccgcucggggccgggguccgc

SEQ ID NO: 51196 - RNA, 22 nt, Artificial Sequence
  Synthetic
gccgcucggggccgggguccgc

SEQ ID NO: 51197 - RNA, 23 nt, Artificial Sequence
  Synthetic
ggccgcucggggccgggguccgc

SEQ ID NO: 51198 - RNA, 24 nt, Artificial Sequence
  Synthetic
cggccgcucggggccgggguccgc

SEQ ID NO: 51199 - RNA, 18 nt, Artificial Sequence
  Synthetic
ccacccacccggcggcgc

SEQ ID NO: 51200 - RNA, 19 nt, Artificial Sequence
  Synthetic
cccacccacccggcggcgc

SEQ ID NO: 51201 - RNA, 20 nt, Artificial Sequence
  Synthetic
gcccacccacccggcggcgc

SEQ ID NO: 51202 - RNA, 21 nt, Artificial Sequence
  Synthetic
agcccacccacccggcggcgc

SEQ ID NO: 51203 - RNA, 22 nt, Artificial Sequence
  Synthetic
cagcccacccacccggcggcgc

SEQ ID NO: 51204 - RNA, 23 nt, Artificial Sequence
  Synthetic
ucagcccacccacccggcggcgc

SEQ ID NO: 51205 - RNA, 24 nt, Artificial Sequence
  Synthetic
aucagcccacccacccggcggcgc

SEQ ID NO: 51206 - RNA, 18 nt, Artificial Sequence
  Synthetic
auagccgcgcgccccggc

SEQ ID NO: 51207 - RNA, 19 nt, Artificial Sequence
  Synthetic
aauagccgcgcgccccggc

SEQ ID NO: 51208 - RNA, 20 nt, Artificial Sequence
  Synthetic
caauagccgcgcgccccggc

SEQ ID NO: 51209 - RNA, 21 nt, Artificial Sequence
  Synthetic
ccaauagccgcgcgccccggc

SEQ ID NO: 51210 - RNA, 22 nt, Artificial Sequence
  Synthetic
cccaauagccgcgcgccccggc

SEQ ID NO: 51211 - RNA, 23 nt, Artificial Sequence
  Synthetic
ccccaauagccgcgcgccccggc

SEQ ID NO: 51212 - RNA, 24 nt, Artificial Sequence
  Synthetic
cccccaauagccgcgcgccccggc

SEQ ID NO: 51213 - RNA, 18 nt, Artificial Sequence
  Synthetic
gggggggauuuagagggc

SEQ ID NO: 51214 - RNA, 19 nt, Artificial Sequence
  Synthetic
cgggggggauuuagagggc

SEQ ID NO: 51215 - RNA, 20 nt, Artificial Sequence
  Synthetic
acgggggggauuuagagggc

SEQ ID NO: 51216 - RNA, 21 nt, Artificial Sequence
  Synthetic
aacgggggggauuuagagggc

SEQ ID NO: 51217 - RNA, 22 nt, Artificial Sequence
  Synthetic
caacgggggggauuuagagggc

SEQ ID NO: 51218 - RNA, 23 nt, Artificial Sequence
  Synthetic
gcaacgggggggauuuagagggc

SEQ ID NO: 51219 - RNA, 24 nt, Artificial Sequence
  Synthetic
agcaacgggggggauuuagagggc

SEQ ID NO: 51220 - RNA, 18 nt, Artificial Sequence
  Synthetic
ccgaccgcuuaagcgggc

SEQ ID NO: 51221 - RNA, 19 nt, Artificial Sequence
  Synthetic
cccgaccgcuuaagcgggc

SEQ ID NO: 51222 - RNA, 20 nt, Artificial Sequence
  Synthetic
ccccgaccgcuuaagcgggc

SEQ ID NO: 51223 - RNA, 21 nt, Artificial Sequence
  Synthetic
cccccgaccgcuuaagcgggc

SEQ ID NO: 51224 - RNA, 22 nt, Artificial Sequence
  Synthetic
ucccccgaccgcuuaagcgggc

SEQ ID NO: 51225 - RNA, 23 nt, Artificial Sequence
  Synthetic
gucccccgaccgcuuaagcgggc

SEQ ID NO: 51226 - RNA, 24 nt, Artificial Sequence
  Synthetic
ggucccccgaccgcuuaagcgggc

SEQ ID NO: 51227 - RNA, 18 nt, Artificial Sequence
  Synthetic
auuuagagggcgcggggc

SEQ ID NO: 51228 - RNA, 19 nt, Artificial Sequence
  Synthetic
gauuuagagggcgcggggc

SEQ ID NO: 51229 - RNA, 20 nt, Artificial Sequence
  Synthetic
ggauuuagagggcgcggggc

SEQ ID NO: 51230 - RNA, 21 nt, Artificial Sequence
  Synthetic
gggauuuagagggcgcggggc

SEQ ID NO: 51231 - RNA, 22 nt, Artificial Sequence
  Synthetic
ggggauuuagagggcgcggggc

SEQ ID NO: 51232 - RNA, 23 nt, Artificial Sequence
  Synthetic
gggggauuuagagggcgcggggc

SEQ ID NO: 51233 - RNA, 24 nt, Artificial Sequence
  Synthetic
ggggggauuuagagggcgcggggc

SEQ ID NO: 51234 - RNA, 18 nt, Artificial Sequence
  Synthetic
ccggggaaaagggggggc

SEQ ID NO: 51235 - RNA, 19 nt, Artificial Sequence
  Synthetic
uccggggaaaagggggggc

SEQ ID NO: 51236 - RNA, 20 nt, Artificial Sequence
  Synthetic
guccggggaaaagggggggc

SEQ ID NO: 51237 - RNA, 21 nt, Artificial Sequence
  Synthetic
gguccggggaaaagggggggc

SEQ ID NO: 51238 - RNA, 22 nt, Artificial Sequence
  Synthetic
ugguccggggaaaagggggggc

SEQ ID NO: 51239 - RNA, 23 nt, Artificial Sequence
  Synthetic
gugguccggggaaaagggggggc

SEQ ID NO: 51240 - RNA, 24 nt, Artificial Sequence
  Synthetic
ggugguccggggaaaagggggggc

SEQ ID NO: 51241 - RNA, 18 nt, Artificial Sequence
  Synthetic
gucgcccucucaccgugc

SEQ ID NO: 51242 - RNA, 19 nt, Artificial Sequence
  Synthetic
ggucgcccucucaccgugc

SEQ ID NO: 51243 - RNA, 20 nt, Artificial Sequence
  Synthetic
gggucgcccucucaccgugc

SEQ ID NO: 51244 - RNA, 21 nt, Artificial Sequence
  Synthetic
ggggucgcccucucaccgugc

SEQ ID NO: 51245 - RNA, 22 nt, Artificial Sequence
  Synthetic
gggggucgcccucucaccgugc

SEQ ID NO: 51246 - RNA, 23 nt, Artificial Sequence
  Synthetic
cgggggucgcccucucaccgugc

SEQ ID NO: 51247 - RNA, 24 nt, Artificial Sequence
  Synthetic
ccgggggucgcccucucaccgugc

SEQ ID NO: 51248 - RNA, 18 nt, Artificial Sequence
  Synthetic
ggagggaaucccccccuc

SEQ ID NO: 51249 - RNA, 19 nt, Artificial Sequence
  Synthetic
gggagggaaucccccccuc

SEQ ID NO: 51250 - RNA, 20 nt, Artificial Sequence
  Synthetic
agggagggaaucccccccuc

SEQ ID NO: 51251 - RNA, 21 nt, Artificial Sequence
  Synthetic
gagggagggaaucccccccuc

SEQ ID NO: 51252 - RNA, 22 nt, Artificial Sequence
  Synthetic
ggagggagggaaucccccccuc

SEQ ID NO: 51253 - RNA, 23 nt, Artificial Sequence
  Synthetic
cggagggagggaaucccccccuc

SEQ ID NO: 51254 - RNA, 24 nt, Artificial Sequence
  Synthetic
gcggagggagggaaucccccccuc

SEQ ID NO: 51255 - RNA, 18 nt, Artificial Sequence
  Synthetic
ccccccugucccccgcuc

SEQ ID NO: 51256 - RNA, 19 nt, Artificial Sequence
  Synthetic
cccccccugucccccgcuc

SEQ ID NO: 51257 - RNA, 20 nt, Artificial Sequence
  Synthetic
ucccccccugucccccgcuc

SEQ ID NO: 51258 - RNA, 21 nt, Artificial Sequence
  Synthetic
cucccccccugucccccgcuc

SEQ ID NO: 51259 - RNA, 22 nt, Artificial Sequence
  Synthetic
ucucccccccugucccccgcuc

SEQ ID NO: 51260 - RNA, 23 nt, Artificial Sequence
  Synthetic
gucucccccccugucccccgcuc

SEQ ID NO: 51261 - RNA, 24 nt, Artificial Sequence
  Synthetic
cgucucccccccugucccccgcuc

SEQ ID NO: 51262 - RNA, 18 nt, Artificial Sequence
  Synthetic
ucgcccccccagaggguc

SEQ ID NO: 51263 - RNA, 19 nt, Artificial Sequence
  Synthetic
cucgcccccccagaggguc

SEQ ID NO: 51264 - RNA, 20 nt, Artificial Sequence
  Synthetic
ccucgcccccccagaggguc

SEQ ID NO: 51265 - RNA, 21 nt, Artificial Sequence
  Synthetic
cccucgcccccccagaggguc

SEQ ID NO: 51266 - RNA, 22 nt, Artificial Sequence
  Synthetic
ucccucgcccccccagaggguc

SEQ ID NO: 51267 - RNA, 23 nt, Artificial Sequence
  Synthetic
cucccucgcccccccagaggguc

SEQ ID NO: 51268 - RNA, 24 nt, Artificial Sequence
  Synthetic
ccucccucgcccccccagaggguc

SEQ ID NO: 51269 - RNA, 18 nt, Artificial Sequence
  Synthetic
acccgcagccgggugguc

SEQ ID NO: 51270 - RNA, 19 nt, Artificial Sequence
  Synthetic
aacccgcagccgggugguc

SEQ ID NO: 51271 - RNA, 20 nt, Artificial Sequence
  Synthetic
caacccgcagccgggugguc

SEQ ID NO: 51272 - RNA, 21 nt, Artificial Sequence
  Synthetic
ccaacccgcagccgggugguc

SEQ ID NO: 51273 - RNA, 22 nt, Artificial Sequence
  Synthetic
cccaacccgcagccgggugguc

SEQ ID NO: 51274 - RNA, 23 nt, Artificial Sequence
  Synthetic
ccccaacccgcagccgggugguc

SEQ ID NO: 51275 - RNA, 24 nt, Artificial Sequence
  Synthetic
cccccaacccgcagccgggugguc

SEQ ID NO: 51276 - RNA, 18 nt, Artificial Sequence
  Synthetic
gggugguccggggaaaag

SEQ ID NO: 51277 - RNA, 19 nt, Artificial Sequence
  Synthetic
cgggugguccggggaaaag

SEQ ID NO: 51278 - RNA, 20 nt, Artificial Sequence
  Synthetic
ccgggugguccggggaaaag

SEQ ID NO: 51279 - RNA, 21 nt, Artificial Sequence
  Synthetic
gccgggugguccggggaaaag

SEQ ID NO: 51280 - RNA, 22 nt, Artificial Sequence
  Synthetic
agccgggugguccggggaaaag

SEQ ID NO: 51281 - RNA, 23 nt, Artificial Sequence
  Synthetic
cagccgggugguccggggaaaag

SEQ ID NO: 51282 - RNA, 24 nt, Artificial Sequence
  Synthetic
gcagccgggugguccggggaaaag

SEQ ID NO: 51283 - RNA, 18 nt, Artificial Sequence
  Synthetic
cugcuuuuuguucggaag

SEQ ID NO: 51284 - RNA, 19 nt, Artificial Sequence
  Synthetic
gcugcuuuuuguucggaag

SEQ ID NO: 51285 - RNA, 20 nt, Artificial Sequence
  Synthetic
cgcugcuuuuuguucggaag

SEQ ID NO: 51286 - RNA, 21 nt, Artificial Sequence
  Synthetic
ccgcugcuuuuuguucggaag

SEQ ID NO: 51287 - RNA, 22 nt, Artificial Sequence
  Synthetic
cccgcugcuuuuuguucggaag

SEQ ID NO: 51288 - RNA, 23 nt, Artificial Sequence
  Synthetic
gcccgcugcuuuuuguucggaag

SEQ ID NO: 51289 - RNA, 24 nt, Artificial Sequence
  Synthetic
cgcccgcugcuuuuuguucggaag

SEQ ID NO: 51290 - RNA, 18 nt, Artificial Sequence
  Synthetic
cgccccccgccgacgcag

SEQ ID NO: 51291 - RNA, 19 nt, Artificial Sequence
  Synthetic
ccgccccccgccgacgcag

SEQ ID NO: 51292 - RNA, 20 nt, Artificial Sequence
  Synthetic
gccgccccccgccgacgcag

SEQ ID NO: 51293 - RNA, 21 nt, Artificial Sequence
  Synthetic
cgccgccccccgccgacgcag

SEQ ID NO: 51294 - RNA, 22 nt, Artificial Sequence
  Synthetic
gcgccgccccccgccgacgcag

SEQ ID NO: 51295 - RNA, 23 nt, Artificial Sequence
  Synthetic
ugcgccgccccccgccgacgcag

SEQ ID NO: 51296 - RNA, 24 nt, Artificial Sequence
  Synthetic
augcgccgccccccgccgacgcag

SEQ ID NO: 51297 - RNA, 18 nt, Artificial Sequence
  Synthetic
gagggcgcggggcgugag

SEQ ID NO: 51298 - RNA, 19 nt, Artificial Sequence
  Synthetic
agagggcgcggggcgugag

SEQ ID NO: 51299 - RNA, 20 nt, Artificial Sequence
  Synthetic
uagagggcgcggggcgugag

SEQ ID NO: 51300 - RNA, 21 nt, Artificial Sequence
  Synthetic
uuagagggcgcggggcgugag

SEQ ID NO: 51301 - RNA, 22 nt, Artificial Sequence
  Synthetic
uuuagagggcgcggggcgugag

SEQ ID NO: 51302 - RNA, 23 nt, Artificial Sequence
  Synthetic
auuuagagggcgcggggcgugag

SEQ ID NO: 51303 - RNA, 24 nt, Artificial Sequence
  Synthetic
gauuuagagggcgcggggcgugag

SEQ ID NO: 51304 - RNA, 18 nt, Artificial Sequence
  Synthetic
cugcuugacaaagcaacg

SEQ ID NO: 51305 - RNA, 19 nt, Artificial Sequence
  Synthetic
gcugcuugacaaagcaacg

SEQ ID NO: 51306 - RNA, 20 nt, Artificial Sequence
  Synthetic
ggcugcuugacaaagcaacg

SEQ ID NO: 51307 - RNA, 21 nt, Artificial Sequence
  Synthetic
gggcugcuugacaaagcaacg

SEQ ID NO: 51308 - RNA, 22 nt, Artificial Sequence
  Synthetic
cgggcugcuugacaaagcaacg

SEQ ID NO: 51309 - RNA, 23 nt, Artificial Sequence
  Synthetic
gcgggcugcuugacaaagcaacg

SEQ ID NO: 51310 - RNA, 24 nt, Artificial Sequence
  Synthetic
ggcgggcugcuugacaaagcaacg

SEQ ID NO: 51311 - RNA, 18 nt, Artificial Sequence
  Synthetic
gaguggugcccgcccccg

SEQ ID NO: 51312 - RNA, 19 nt, Artificial Sequence
  Synthetic
ugaguggugcccgcccccg

SEQ ID NO: 51313 - RNA, 20 nt, Artificial Sequence
  Synthetic
cugaguggugcccgcccccg

SEQ ID NO: 51314 - RNA, 21 nt, Artificial Sequence
  Synthetic
ccugaguggugcccgcccccg

SEQ ID NO: 51315 - RNA, 22 nt, Artificial Sequence
  Synthetic
cccugaguggugcccgcccccg

SEQ ID NO: 51316 - RNA, 23 nt, Artificial Sequence
  Synthetic
gcccugaguggugcccgcccccg

SEQ ID NO: 51317 - RNA, 24 nt, Artificial Sequence
  Synthetic
ggcccugaguggugcccgcccccg

SEQ ID NO: 51318 - RNA, 18 nt, Artificial Sequence
  Synthetic
caauagccgcgcgccccg

SEQ ID NO: 51319 - RNA, 19 nt, Artificial Sequence
  Synthetic
ccaauagccgcgcgccccg

SEQ ID NO: 51320 - RNA, 20 nt, Artificial Sequence
  Synthetic
cccaauagccgcgcgccccg

SEQ ID NO: 51321 - RNA, 21 nt, Artificial Sequence
  Synthetic
ccccaauagccgcgcgccccg

SEQ ID NO: 51322 - RNA, 22 nt, Artificial Sequence
  Synthetic
cccccaauagccgcgcgccccg

SEQ ID NO: 51323 - RNA, 23 nt, Artificial Sequence
  Synthetic
ucccccaauagccgcgcgccccg

SEQ ID NO: 51324 - RNA, 24 nt, Artificial Sequence
  Synthetic
uucccccaauagccgcgcgccccg

SEQ ID NO: 51325 - RNA, 18 nt, Artificial Sequence
  Synthetic
ccgggucuccuccucccg

SEQ ID NO: 51326 - RNA, 19 nt, Artificial Sequence
  Synthetic
uccgggucuccuccucccg

SEQ ID NO: 51327 - RNA, 20 nt, Artificial Sequence
  Synthetic
cuccgggucuccuccucccg

SEQ ID NO: 51328 - RNA, 21 nt, Artificial Sequence
  Synthetic
ucuccgggucuccuccucccg

SEQ ID NO: 51329 - RNA, 22 nt, Artificial Sequence
  Synthetic
cucuccgggucuccuccucccg

SEQ ID NO: 51330 - RNA, 23 nt, Artificial Sequence
  Synthetic
ucucuccgggucuccuccucccg

SEQ ID NO: 51331 - RNA, 24 nt, Artificial Sequence
  Synthetic
gucucuccgggucuccuccucccg

SEQ ID NO: 51332 - RNA, 18 nt, Artificial Sequence
  Synthetic
ccgcagccgggugguccg

SEQ ID NO: 51333 - RNA, 19 nt, Artificial Sequence
  Synthetic
cccgcagccgggugguccg

SEQ ID NO: 51334 - RNA, 20 nt, Artificial Sequence
  Synthetic
acccgcagccgggugguccg

SEQ ID NO: 51335 - RNA, 21 nt, Artificial Sequence
  Synthetic
aacccgcagccgggugguccg

SEQ ID NO: 51336 - RNA, 22 nt, Artificial Sequence
  Synthetic
caacccgcagccgggugguccg

SEQ ID NO: 51337 - RNA, 23 nt, Artificial Sequence
  Synthetic
ccaacccgcagccgggugguccg

SEQ ID NO: 51338 - RNA, 24 nt, Artificial Sequence
  Synthetic
cccaacccgcagccgggugguccg

SEQ ID NO: 51339 - RNA, 18 nt, Artificial Sequence
  Synthetic
ggggggauuuagagggcg

SEQ ID NO: 51340 - RNA, 19 nt, Artificial Sequence
  Synthetic
gggggggauuuagagggcg

SEQ ID NO: 51341 - RNA, 20 nt, Artificial Sequence
  Synthetic
cgggggggauuuagagggcg

SEQ ID NO: 51342 - RNA, 21 nt, Artificial Sequence
  Synthetic
acgggggggauuuagagggcg

SEQ ID NO: 51343 - RNA, 22 nt, Artificial Sequence
  Synthetic
aacgggggggauuuagagggcg

SEQ ID NO: 51344 - RNA, 23 nt, Artificial Sequence
  Synthetic
caacgggggggauuuagagggcg

SEQ ID NO: 51345 - RNA, 24 nt, Artificial Sequence
  Synthetic
gcaacgggggggauuuagagggcg

SEQ ID NO: 51346 - RNA, 18 nt, Artificial Sequence
  Synthetic
cgcgccccggcgggggcg

SEQ ID NO: 51347 - RNA, 19 nt, Artificial Sequence
  Synthetic
gcgcgccccggcgggggcg

SEQ ID NO: 51348 - RNA, 20 nt, Artificial Sequence
  Synthetic
cgcgcgccccggcgggggcg

SEQ ID NO: 51349 - RNA, 21 nt, Artificial Sequence
  Synthetic
ccgcgcgccccggcgggggcg

SEQ ID NO: 51350 - RNA, 22 nt, Artificial Sequence
  Synthetic
gccgcgcgccccggcgggggcg

SEQ ID NO: 51351 - RNA, 23 nt, Artificial Sequence
  Synthetic
agccgcgcgccccggcgggggcg

SEQ ID NO: 51352 - RNA, 24 nt, Artificial Sequence
  Synthetic
uagccgcgcgccccggcgggggcg

SEQ ID NO: 51353 - RNA, 18 nt, Artificial Sequence
  Synthetic
cgcccccccagagggucg

SEQ ID NO: 51354 - RNA, 19 nt, Artificial Sequence
  Synthetic
ucgcccccccagagggucg

SEQ ID NO: 51355 - RNA, 20 nt, Artificial Sequence
  Synthetic
cucgcccccccagagggucg

SEQ ID NO: 51356 - RNA, 21 nt, Artificial Sequence
  Synthetic
ccucgcccccccagagggucg

SEQ ID NO: 51357 - RNA, 22 nt, Artificial Sequence
  Synthetic
cccucgcccccccagagggucg

SEQ ID NO: 51358 - RNA, 23 nt, Artificial Sequence
  Synthetic
ucccucgcccccccagagggucg

SEQ ID NO: 51359 - RNA, 24 nt, Artificial Sequence
  Synthetic
cucccucgcccccccagagggucg

SEQ ID NO: 51360 - RNA, 18 nt, Artificial Sequence
  Synthetic
ggugguccggggaaaagg

SEQ ID NO: 51361 - RNA, 19 nt, Artificial Sequence
  Synthetic
gggugguccggggaaaagg

SEQ ID NO: 51362 - RNA, 20 nt, Artificial Sequence
  Synthetic
cgggugguccggggaaaagg

SEQ ID NO: 51363 - RNA, 21 nt, Artificial Sequence
  Synthetic
ccgggugguccggggaaaagg

SEQ ID NO: 51364 - RNA, 22 nt, Artificial Sequence
  Synthetic
gccgggugguccggggaaaagg

SEQ ID NO: 51365 - RNA, 23 nt, Artificial Sequence
  Synthetic
agccgggugguccggggaaaagg

SEQ ID NO: 51366 - RNA, 24 nt, Artificial Sequence
  Synthetic
cagccgggugguccggggaaaagg

SEQ ID NO: 51367 - RNA, 18 nt, Artificial Sequence
  Synthetic
ugcuuuuuguucggaagg

SEQ ID NO: 51368 - RNA, 19 nt, Artificial Sequence
  Synthetic
cugcuuuuuguucggaagg

SEQ ID NO: 51369 - RNA, 20 nt, Artificial Sequence
  Synthetic
gcugcuuuuuguucggaagg

SEQ ID NO: 51370 - RNA, 21 nt, Artificial Sequence
  Synthetic
cgcugcuuuuuguucggaagg

SEQ ID NO: 51371 - RNA, 22 nt, Artificial Sequence
  Synthetic
ccgcugcuuuuuguucggaagg

SEQ ID NO: 51372 - RNA, 23 nt, Artificial Sequence
  Synthetic
cccgcugcuuuuuguucggaagg

SEQ ID NO: 51373 - RNA, 24 nt, Artificial Sequence
  Synthetic
gcccgcugcuuuuuguucggaagg

SEQ ID NO: 51374 - RNA, 18 nt, Artificial Sequence
  Synthetic
ccccggcgggggcggagg

SEQ ID NO: 51375 - RNA, 19 nt, Artificial Sequence
  Synthetic
gccccggcgggggcggagg

SEQ ID NO: 51376 - RNA, 20 nt, Artificial Sequence
  Synthetic
cgccccggcgggggcggagg

SEQ ID NO: 51377 - RNA, 21 nt, Artificial Sequence
  Synthetic
gcgccccggcgggggcggagg

SEQ ID NO: 51378 - RNA, 22 nt, Artificial Sequence
  Synthetic
cgcgccccggcgggggcggagg

SEQ ID NO: 51379 - RNA, 23 nt, Artificial Sequence
  Synthetic
gcgcgccccggcgggggcggagg

SEQ ID NO: 51380 - RNA, 24 nt, Artificial Sequence
  Synthetic
cgcgcgccccggcgggggcggagg

SEQ ID NO: 51381 - RNA, 18 nt, Artificial Sequence
  Synthetic
agggcgcggggcgugagg

SEQ ID NO: 51382 - RNA, 19 nt, Artificial Sequence
  Synthetic
gagggcgcggggcgugagg

SEQ ID NO: 51383 - RNA, 20 nt, Artificial Sequence
  Synthetic
agagggcgcggggcgugagg

SEQ ID NO: 51384 - RNA, 21 nt, Artificial Sequence
  Synthetic
uagagggcgcggggcgugagg

SEQ ID NO: 51385 - RNA, 22 nt, Artificial Sequence
  Synthetic
uuagagggcgcggggcgugagg

SEQ ID NO: 51386 - RNA, 23 nt, Artificial Sequence
  Synthetic
uuuagagggcgcggggcgugagg

SEQ ID NO: 51387 - RNA, 24 nt, Artificial Sequence
  Synthetic
auuuagagggcgcggggcgugagg

SEQ ID NO: 51388 - RNA, 18 nt, Artificial Sequence
  Synthetic
ugcuugacaaagcaacgg

SEQ ID NO: 51389 - RNA, 19 nt, Artificial Sequence
  Synthetic
cugcuugacaaagcaacgg

SEQ ID NO: 51390 - RNA, 20 nt, Artificial Sequence
  Synthetic
gcugcuugacaaagcaacgg

SEQ ID NO: 51391 - RNA, 21 nt, Artificial Sequence
  Synthetic
ggcugcuugacaaagcaacgg

SEQ ID NO: 51392 - RNA, 22 nt, Artificial Sequence
  Synthetic
gggcugcuugacaaagcaacgg

SEQ ID NO: 51393 - RNA, 23 nt, Artificial Sequence
  Synthetic
cgggcugcuugacaaagcaacgg

SEQ ID NO: 51394 - RNA, 24 nt, Artificial Sequence
  Synthetic
gcgggcugcuugacaaagcaacgg

SEQ ID NO: 51395 - RNA, 18 nt, Artificial Sequence
  Synthetic
aauagccgcgcgccccgg

SEQ ID NO: 51396 - RNA, 19 nt, Artificial Sequence
  Synthetic
caauagccgcgcgccccgg

SEQ ID NO: 51397 - RNA, 20 nt, Artificial Sequence
  Synthetic
ccaauagccgcgcgccccgg

SEQ ID NO: 51398 - RNA, 21 nt, Artificial Sequence
  Synthetic
cccaauagccgcgcgccccgg

SEQ ID NO: 51399 - RNA, 22 nt, Artificial Sequence
  Synthetic
ccccaauagccgcgcgccccgg

SEQ ID NO: 51400 - RNA, 23 nt, Artificial Sequence
  Synthetic
cccccaauagccgcgcgccccgg

SEQ ID NO: 51401 - RNA, 24 nt, Artificial Sequence
  Synthetic
ucccccaauagccgcgcgccccgg

SEQ ID NO: 51402 - RNA, 18 nt, Artificial Sequence
  Synthetic
gcgccccggcgggggcgg

SEQ ID NO: 51403 - RNA, 19 nt, Artificial Sequence
  Synthetic
cgcgccccggcgggggcgg

SEQ ID NO: 51404 - RNA, 20 nt, Artificial Sequence
  Synthetic
gcgcgccccggcgggggcgg

SEQ ID NO: 51405 - RNA, 21 nt, Artificial Sequence
  Synthetic
cgcgcgccccggcgggggcgg

SEQ ID NO: 51406 - RNA, 22 nt, Artificial Sequence
  Synthetic
ccgcgcgccccggcgggggcgg

SEQ ID NO: 51407 - RNA, 23 nt, Artificial Sequence
  Synthetic
gccgcgcgccccggcgggggcgg

SEQ ID NO: 51408 - RNA, 24 nt, Artificial Sequence
  Synthetic
agccgcgcgccccggcgggggcgg

SEQ ID NO: 51409 - RNA, 18 nt, Artificial Sequence
  Synthetic
ccgcugcuuuuuguucgg

SEQ ID NO: 51410 - RNA, 19 nt, Artificial Sequence
  Synthetic
cccgcugcuuuuuguucgg

SEQ ID NO: 51411 - RNA, 20 nt, Artificial Sequence
  Synthetic
gcccgcugcuuuuuguucgg

SEQ ID NO: 51412 - RNA, 21 nt, Artificial Sequence
  Synthetic
cgcccgcugcuuuuuguucgg

SEQ ID NO: 51413 - RNA, 22 nt, Artificial Sequence
  Synthetic
ccgcccgcugcuuuuuguucgg

SEQ ID NO: 51414 - RNA, 23 nt, Artificial Sequence
  Synthetic
cccgcccgcugcuuuuuguucgg

SEQ ID NO: 51415 - RNA, 24 nt, Artificial Sequence
  Synthetic
ccccgcccgcugcuuuuuguucgg

SEQ ID NO: 51416 - RNA, 18 nt, Artificial Sequence
  Synthetic
gcuuuuuguucggaaggg

SEQ ID NO: 51417 - RNA, 19 nt, Artificial Sequence
  Synthetic
ugcuuuuuguucggaaggg

SEQ ID NO: 51418 - RNA, 20 nt, Artificial Sequence
  Synthetic
cugcuuuuuguucggaaggg

SEQ ID NO: 51419 - RNA, 21 nt, Artificial Sequence
  Synthetic
gcugcuuuuuguucggaaggg

SEQ ID NO: 51420 - RNA, 22 nt, Artificial Sequence
  Synthetic
cgcugcuuuuuguucggaaggg

SEQ ID NO: 51421 - RNA, 23 nt, Artificial Sequence
  Synthetic
ccgcugcuuuuuguucggaaggg

SEQ ID NO: 51422 - RNA, 24 nt, Artificial Sequence
  Synthetic
cccgcugcuuuuuguucggaaggg

SEQ ID NO: 51423 - RNA, 18 nt, Artificial Sequence
  Synthetic
ccucgcccccccagaggg

SEQ ID NO: 51424 - RNA, 19 nt, Artificial Sequence
  Synthetic
cccucgcccccccagaggg

SEQ ID NO: 51425 - RNA, 20 nt, Artificial Sequence
  Synthetic
ucccucgcccccccagaggg

SEQ ID NO: 51426 - RNA, 21 nt, Artificial Sequence
  Synthetic
cucccucgcccccccagaggg

SEQ ID NO: 51427 - RNA, 22 nt, Artificial Sequence
  Synthetic
ccucccucgcccccccagaggg

SEQ ID NO: 51428 - RNA, 23 nt, Artificial Sequence
  Synthetic
gccucccucgcccccccagaggg

SEQ ID NO: 51429 - RNA, 24 nt, Artificial Sequence
  Synthetic
ugccucccucgcccccccagaggg

SEQ ID NO: 51430 - RNA, 18 nt, Artificial Sequence
  Synthetic
cccggcgggggcggaggg

SEQ ID NO: 51431 - RNA, 19 nt, Artificial Sequence
  Synthetic
ccccggcgggggcggaggg

SEQ ID NO: 51432 - RNA, 20 nt, Artificial Sequence
  Synthetic
gccccggcgggggcggaggg

SEQ ID NO: 51433 - RNA, 21 nt, Artificial Sequence
  Synthetic
cgccccggcgggggcggaggg

SEQ ID NO: 51434 - RNA, 22 nt, Artificial Sequence
  Synthetic
gcgccccggcgggggcggaggg

SEQ ID NO: 51435 - RNA, 23 nt, Artificial Sequence
  Synthetic
cgcgccccggcgggggcggaggg

SEQ ID NO: 51436 - RNA, 24 nt, Artificial Sequence
  Synthetic
gcgcgccccggcgggggcggaggg

SEQ ID NO: 51437 - RNA, 18 nt, Artificial Sequence
  Synthetic
guggugcccgcccccggg

SEQ ID NO: 51438 - RNA, 19 nt, Artificial Sequence
  Synthetic
aguggugcccgcccccggg

SEQ ID NO: 51439 - RNA, 20 nt, Artificial Sequence
  Synthetic
gaguggugcccgcccccggg

SEQ ID NO: 51440 - RNA, 21 nt, Artificial Sequence
  Synthetic
ugaguggugcccgcccccggg

SEQ ID NO: 51441 - RNA, 22 nt, Artificial Sequence
  Synthetic
cugaguggugcccgcccccggg

SEQ ID NO: 51442 - RNA, 23 nt, Artificial Sequence
  Synthetic
ccugaguggugcccgcccccggg

SEQ ID NO: 51443 - RNA, 24 nt, Artificial Sequence
  Synthetic
cccugaguggugcccgcccccggg

SEQ ID NO: 51444 - RNA, 18 nt, Artificial Sequence
  Synthetic
ccgggagcucgugccggg

SEQ ID NO: 51445 - RNA, 19 nt, Artificial Sequence
  Synthetic
cccgggagcucgugccggg

SEQ ID NO: 51446 - RNA, 20 nt, Artificial Sequence
  Synthetic
gcccgggagcucgugccggg

SEQ ID NO: 51447 - RNA, 21 nt, Artificial Sequence
  Synthetic
cgcccgggagcucgugccggg

SEQ ID NO: 51448 - RNA, 22 nt, Artificial Sequence
  Synthetic
ccgcccgggagcucgugccggg

SEQ ID NO: 51449 - RNA, 23 nt, Artificial Sequence
  Synthetic
uccgcccgggagcucgugccggg

SEQ ID NO: 51450 - RNA, 24 nt, Artificial Sequence
  Synthetic
guccgcccgggagcucgugccggg

SEQ ID NO: 51451 - RNA, 18 nt, Artificial Sequence
  Synthetic
cccgaccgcuuaagcggg

SEQ ID NO: 51452 - RNA, 19 nt, Artificial Sequence
  Synthetic
ccccgaccgcuuaagcggg

SEQ ID NO: 51453 - RNA, 20 nt, Artificial Sequence
  Synthetic
cccccgaccgcuuaagcggg

SEQ ID NO: 51454 - RNA, 21 nt, Artificial Sequence
  Synthetic
ucccccgaccgcuuaagcggg

SEQ ID NO: 51455 - RNA, 22 nt, Artificial Sequence
  Synthetic
gucccccgaccgcuuaagcggg

SEQ ID NO: 51456 - RNA, 23 nt, Artificial Sequence
  Synthetic
ggucccccgaccgcuuaagcggg

SEQ ID NO: 51457 - RNA, 24 nt, Artificial Sequence
  Synthetic
gggucccccgaccgcuuaagcggg

SEQ ID NO: 51458 - RNA, 18 nt, Artificial Sequence
  Synthetic
cuuuuuguucggaagggg

SEQ ID NO: 51459 - RNA, 19 nt, Artificial Sequence
  Synthetic
gcuuuuuguucggaagggg

SEQ ID NO: 51460 - RNA, 20 nt, Artificial Sequence
  Synthetic
ugcuuuuuguucggaagggg

SEQ ID NO: 51461 - RNA, 21 nt, Artificial Sequence
  Synthetic
cugcuuuuuguucggaagggg

SEQ ID NO: 51462 - RNA, 22 nt, Artificial Sequence
  Synthetic
gcugcuuuuuguucggaagggg

SEQ ID NO: 51463 - RNA, 23 nt, Artificial Sequence
  Synthetic
cgcugcuuuuuguucggaagggg

SEQ ID NO: 51464 - RNA, 24 nt, Artificial Sequence
  Synthetic
ccgcugcuuuuuguucggaagggg

SEQ ID NO: 51465 - RNA, 18 nt, Artificial Sequence
  Synthetic
ccgcgcgccccggcgggg

SEQ ID NO: 51466 - RNA, 19 nt, Artificial Sequence
  Synthetic
gccgcgcgccccggcgggg

SEQ ID NO: 51467 - RNA, 20 nt, Artificial Sequence
  Synthetic
agccgcgcgccccggcgggg

SEQ ID NO: 51468 - RNA, 21 nt, Artificial Sequence
  Synthetic
uagccgcgcgccccggcgggg

SEQ ID NO: 51469 - RNA, 22 nt, Artificial Sequence
  Synthetic
auagccgcgcgccccggcgggg

SEQ ID NO: 51470 - RNA, 23 nt, Artificial Sequence
  Synthetic
aauagccgcgcgccccggcgggg

SEQ ID NO: 51471 - RNA, 24 nt, Artificial Sequence
  Synthetic
caauagccgcgcgccccggcgggg

SEQ ID NO: 51472 - RNA, 18 nt, Artificial Sequence
  Synthetic
cgcggcggccgcucgggg

SEQ ID NO: 51473 - RNA, 19 nt, Artificial Sequence
  Synthetic
ccgcggcggccgcucgggg

SEQ ID NO: 51474 - RNA, 20 nt, Artificial Sequence
  Synthetic
gccgcggcggccgcucgggg

SEQ ID NO: 51475 - RNA, 21 nt, Artificial Sequence
  Synthetic
ugccgcggcggccgcucgggg

SEQ ID NO: 51476 - RNA, 22 nt, Artificial Sequence
  Synthetic
cugccgcggcggccgcucgggg

SEQ ID NO: 51477 - RNA, 23 nt, Artificial Sequence
  Synthetic
ucugccgcggcggccgcucgggg

SEQ ID NO: 51478 - RNA, 24 nt, Artificial Sequence
  Synthetic
gucugccgcggcggccgcucgggg

SEQ ID NO: 51479 - RNA, 18 nt, Artificial Sequence
  Synthetic
cgcgcgccccggcggggg

SEQ ID NO: 51480 - RNA, 19 nt, Artificial Sequence
  Synthetic
ccgcgcgccccggcggggg

SEQ ID NO: 51481 - RNA, 20 nt, Artificial Sequence
  Synthetic
gccgcgcgccccggcggggg

SEQ ID NO: 51482 - RNA, 21 nt, Artificial Sequence
  Synthetic
agccgcgcgccccggcggggg

SEQ ID NO: 51483 - RNA, 22 nt, Artificial Sequence
  Synthetic
uagccgcgcgccccggcggggg

SEQ ID NO: 51484 - RNA, 23 nt, Artificial Sequence
  Synthetic
auagccgcgcgccccggcggggg

SEQ ID NO: 51485 - RNA, 24 nt, Artificial Sequence
  Synthetic
aauagccgcgcgccccggcggggg

SEQ ID NO: 51486 - RNA, 18 nt, Artificial Sequence
  Synthetic
uuuuguucggaagggggg

SEQ ID NO: 51487 - RNA, 19 nt, Artificial Sequence
  Synthetic
uuuuuguucggaagggggg

SEQ ID NO: 51488 - RNA, 20 nt, Artificial Sequence
  Synthetic
cuuuuuguucggaagggggg

SEQ ID NO: 51489 - RNA, 21 nt, Artificial Sequence
  Synthetic
gcuuuuuguucggaagggggg

SEQ ID NO: 51490 - RNA, 22 nt, Artificial Sequence
  Synthetic
ugcuuuuuguucggaagggggg

SEQ ID NO: 51491 - RNA, 23 nt, Artificial Sequence
  Synthetic
cugcuuuuuguucggaagggggg

SEQ ID NO: 51492 - RNA, 24 nt, Artificial Sequence
  Synthetic
gcugcuuuuuguucggaagggggg

SEQ ID NO: 51493 - RNA, 18 nt, Artificial Sequence
  Synthetic
gcuccgucgcucgcagug

SEQ ID NO: 51494 - RNA, 19 nt, Artificial Sequence
  Synthetic
cgcuccgucgcucgcagug

SEQ ID NO: 51495 - RNA, 20 nt, Artificial Sequence
  Synthetic
ccgcuccgucgcucgcagug

SEQ ID NO: 51496 - RNA, 21 nt, Artificial Sequence
  Synthetic
gccgcuccgucgcucgcagug

SEQ ID NO: 51497 - RNA, 22 nt, Artificial Sequence
  Synthetic
cgccgcuccgucgcucgcagug

SEQ ID NO: 51498 - RNA, 23 nt, Artificial Sequence
  Synthetic
ccgccgcuccgucgcucgcagug

SEQ ID NO: 51499 - RNA, 24 nt, Artificial Sequence
  Synthetic
gccgccgcuccgucgcucgcagug

SEQ ID NO: 51500 - RNA, 18 nt, Artificial Sequence
  Synthetic
ggucgcccucucaccgug

SEQ ID NO: 51501 - RNA, 19 nt, Artificial Sequence
  Synthetic
gggucgcccucucaccgug

SEQ ID NO: 51502 - RNA, 20 nt, Artificial Sequence
  Synthetic
ggggucgcccucucaccgug

SEQ ID NO: 51503 - RNA, 21 nt, Artificial Sequence
  Synthetic
gggggucgcccucucaccgug

SEQ ID NO: 51504 - RNA, 22 nt, Artificial Sequence
  Synthetic
cgggggucgcccucucaccgug

SEQ ID NO: 51505 - RNA, 23 nt, Artificial Sequence
  Synthetic
ccgggggucgcccucucaccgug

SEQ ID NO: 51506 - RNA, 24 nt, Artificial Sequence
  Synthetic
cccgggggucgcccucucaccgug

SEQ ID NO: 51507 - RNA, 18 nt, Artificial Sequence
  Synthetic
uccgcccgggagcucgug

SEQ ID NO: 51508 - RNA, 19 nt, Artificial Sequence
  Synthetic
guccgcccgggagcucgug

SEQ ID NO: 51509 - RNA, 20 nt, Artificial Sequence
  Synthetic
gguccgcccgggagcucgug

SEQ ID NO: 51510 - RNA, 21 nt, Artificial Sequence
  Synthetic
ggguccgcccgggagcucgug

SEQ ID NO: 51511 - RNA, 22 nt, Artificial Sequence
  Synthetic
gggguccgcccgggagcucgug

SEQ ID NO: 51512 - RNA, 23 nt, Artificial Sequence
  Synthetic
cgggguccgcccgggagcucgug

SEQ ID NO: 51513 - RNA, 24 nt, Artificial Sequence
  Synthetic
ccgggguccgcccgggagcucgug

SEQ ID NO: 51514 - RNA, 18 nt, Artificial Sequence
  Synthetic
gaagcccaggggaccaau

SEQ ID NO: 51515 - RNA, 19 nt, Artificial Sequence
  Synthetic
ggaagcccaggggaccaau

SEQ ID NO: 51516 - RNA, 20 nt, Artificial Sequence
  Synthetic
aggaagcccaggggaccaau

SEQ ID NO: 51517 - RNA, 21 nt, Artificial Sequence
  Synthetic
uaggaagcccaggggaccaau

SEQ ID NO: 51518 - RNA, 22 nt, Artificial Sequence
  Synthetic
cuaggaagcccaggggaccaau

SEQ ID NO: 51519 - RNA, 23 nt, Artificial Sequence
  Synthetic
acuaggaagcccaggggaccaau

SEQ ID NO: 51520 - RNA, 24 nt, Artificial Sequence
  Synthetic
uacuaggaagcccaggggaccaau

SEQ ID NO: 51521 - RNA, 18 nt, Artificial Sequence
  Synthetic
gaaauucauuagcauacu

SEQ ID NO: 51522 - RNA, 19 nt, Artificial Sequence
  Synthetic
agaaauucauuagcauacu

SEQ ID NO: 51523 - RNA, 20 nt, Artificial Sequence
  Synthetic
gagaaauucauuagcauacu

SEQ ID NO: 51524 - RNA, 21 nt, Artificial Sequence
  Synthetic
ggagaaauucauuagcauacu

SEQ ID NO: 51525 - RNA, 22 nt, Artificial Sequence
  Synthetic
gggagaaauucauuagcauacu

SEQ ID NO: 51526 - RNA, 23 nt, Artificial Sequence
  Synthetic
ggggagaaauucauuagcauacu

SEQ ID NO: 51527 - RNA, 24 nt, Artificial Sequence
  Synthetic
cggggagaaauucauuagcauacu

SEQ ID NO: 51528 - RNA, 18 nt, Artificial Sequence
  Synthetic
ucugccgcggcggccgcu

SEQ ID NO: 51529 - RNA, 19 nt, Artificial Sequence
  Synthetic
gucugccgcggcggccgcu

SEQ ID NO: 51530 - RNA, 20 nt, Artificial Sequence
  Synthetic
ggucugccgcggcggccgcu

SEQ ID NO: 51531 - RNA, 21 nt, Artificial Sequence
  Synthetic
gggucugccgcggcggccgcu

SEQ ID NO: 51532 - RNA, 22 nt, Artificial Sequence
  Synthetic
ggggucugccgcggcggccgcu

SEQ ID NO: 51533 - RNA, 23 nt, Artificial Sequence
  Synthetic
gggggucugccgcggcggccgcu

SEQ ID NO: 51534 - RNA, 24 nt, Artificial Sequence
  Synthetic
cgggggucugccgcggcggccgcu

SEQ ID NO: 51535 - RNA, 18 nt, Artificial Sequence
  Synthetic
gagggaaucccccccucu

SEQ ID NO: 51536 - RNA, 19 nt, Artificial Sequence
  Synthetic
ggagggaaucccccccucu

SEQ ID NO: 51537 - RNA, 20 nt, Artificial Sequence
  Synthetic
gggagggaaucccccccucu

SEQ ID NO: 51538 - RNA, 21 nt, Artificial Sequence
  Synthetic
agggagggaaucccccccucu

SEQ ID NO: 51539 - RNA, 22 nt, Artificial Sequence
  Synthetic
gagggagggaaucccccccucu

SEQ ID NO: 51540 - RNA, 23 nt, Artificial Sequence
  Synthetic
ggagggagggaaucccccccucu

SEQ ID NO: 51541 - RNA, 24 nt, Artificial Sequence
  Synthetic
cggagggagggaaucccccccucu

SEQ ID NO: 51542 - RNA, 18 nt, Artificial Sequence
  Synthetic
cucgcccccccagagggu

SEQ ID NO: 51543 - RNA, 19 nt, Artificial Sequence
  Synthetic
ccucgcccccccagagggu

SEQ ID NO: 51544 - RNA, 20 nt, Artificial Sequence
  Synthetic
cccucgcccccccagagggu

SEQ ID NO: 51545 - RNA, 21 nt, Artificial Sequence
  Synthetic
ucccucgcccccccagagggu

SEQ ID NO: 51546 - RNA, 22 nt, Artificial Sequence
  Synthetic
cucccucgcccccccagagggu

SEQ ID NO: 51547 - RNA, 23 nt, Artificial Sequence
  Synthetic
ccucccucgcccccccagagggu

SEQ ID NO: 51548 - RNA, 24 nt, Artificial Sequence
  Synthetic
gccucccucgcccccccagagggu

SEQ ID NO: 51549 - RNA, 18 nt, Artificial Sequence
  Synthetic
aacccgcagccggguggu

SEQ ID NO: 51550 - RNA, 19 nt, Artificial Sequence
  Synthetic
caacccgcagccggguggu

SEQ ID NO: 51551 - RNA, 20 nt, Artificial Sequence
  Synthetic
ccaacccgcagccggguggu

SEQ ID NO: 51552 - RNA, 21 nt, Artificial Sequence
  Synthetic
cccaacccgcagccggguggu

SEQ ID NO: 51553 - RNA, 22 nt, Artificial Sequence
  Synthetic
ccccaacccgcagccggguggu

SEQ ID NO: 51554 - RNA, 23 nt, Artificial Sequence
  Synthetic
cccccaacccgcagccggguggu

SEQ ID NO: 51555 - RNA, 24 nt, Artificial Sequence
  Synthetic
acccccaacccgcagccggguggu

SEQ ID NO: 51556 - RNA, 18 nt, Artificial Sequence
  Synthetic
ccgcccgcugcuuuuugu

SEQ ID NO: 51557 - RNA, 19 nt, Artificial Sequence
  Synthetic
cccgcccgcugcuuuuugu

SEQ ID NO: 51558 - RNA, 20 nt, Artificial Sequence
  Synthetic
ccccgcccgcugcuuuuugu

SEQ ID NO: 51559 - RNA, 21 nt, Artificial Sequence
  Synthetic
cccccgcccgcugcuuuuugu

SEQ ID NO: 51560 - RNA, 22 nt, Artificial Sequence
  Synthetic
ccccccgcccgcugcuuuuugu

SEQ ID NO: 51561 - RNA, 23 nt, Artificial Sequence
  Synthetic
gccccccgcccgcugcuuuuugu

SEQ ID NO: 51562 - RNA, 24 nt, Artificial Sequence
  Synthetic
ggccccccgcccgcugcuuuuugu

SEQ ID NO: 51563 - RNA, 18 nt, Artificial Sequence
  Synthetic
aaagcaacgggggggauu

SEQ ID NO: 51564 - RNA, 19 nt, Artificial Sequence
  Synthetic
caaagcaacgggggggauu

SEQ ID NO: 51565 - RNA, 20 nt, Artificial Sequence
  Synthetic
acaaagcaacgggggggauu

SEQ ID NO: 51566 - RNA, 21 nt, Artificial Sequence
  Synthetic
gacaaagcaacgggggggauu

SEQ ID NO: 51567 - RNA, 22 nt, Artificial Sequence
  Synthetic
ugacaaagcaacgggggggauu

SEQ ID NO: 51568 - RNA, 23 nt, Artificial Sequence
  Synthetic
uugacaaagcaacgggggggauu

SEQ ID NO: 51569 - RNA, 24 nt, Artificial Sequence
  Synthetic
cuugacaaagcaacgggggggauu

SEQ ID NO: 51570 - RNA, 18 nt, Artificial Sequence
  Synthetic
cgcccgcugcuuuuuguu

SEQ ID NO: 51571 - RNA, 19 nt, Artificial Sequence
  Synthetic
ccgcccgcugcuuuuuguu

SEQ ID NO: 51572 - RNA, 20 nt, Artificial Sequence
  Synthetic
cccgcccgcugcuuuuuguu

SEQ ID NO: 51573 - RNA, 21 nt, Artificial Sequence
  Synthetic
ccccgcccgcugcuuuuuguu

SEQ ID NO: 51574 - RNA, 22 nt, Artificial Sequence
  Synthetic
cccccgcccgcugcuuuuuguu

SEQ ID NO: 51575 - RNA, 23 nt, Artificial Sequence
  Synthetic
ccccccgcccgcugcuuuuuguu

SEQ ID NO: 51576 - RNA, 24 nt, Artificial Sequence
  Synthetic
gccccccgcccgcugcuuuuuguu

SEQ ID NO: 51577 - RNA, 18 nt, Artificial Sequence
  Synthetic
gagacuaaaacccggcaa

SEQ ID NO: 51578 - RNA, 19 nt, Artificial Sequence
  Synthetic
agagacuaaaacccggcaa

SEQ ID NO: 51579 - RNA, 20 nt, Artificial Sequence
  Synthetic
cagagacuaaaacccggcaa

SEQ ID NO: 51580 - RNA, 21 nt, Artificial Sequence
  Synthetic
acagagacuaaaacccggcaa

SEQ ID NO: 51581 - RNA, 22 nt, Artificial Sequence
  Synthetic
gacagagacuaaaacccggcaa

SEQ ID NO: 51582 - RNA, 23 nt, Artificial Sequence
  Synthetic
agacagagacuaaaacccggcaa

SEQ ID NO: 51583 - RNA, 24 nt, Artificial Sequence
  Synthetic
gagacagagacuaaaacccggcaa

SEQ ID NO: 51584 - RNA, 18 nt, Artificial Sequence
  Synthetic
cggggugagggagggaca

SEQ ID NO: 51585 - RNA, 19 nt, Artificial Sequence
  Synthetic
ccggggugagggagggaca

SEQ ID NO: 51586 - RNA, 20 nt, Artificial Sequence
  Synthetic
gccggggugagggagggaca

SEQ ID NO: 51587 - RNA, 21 nt, Artificial Sequence
  Synthetic
ggccggggugagggagggaca

SEQ ID NO: 51588 - RNA, 22 nt, Artificial Sequence
  Synthetic
gggccggggugagggagggaca

SEQ ID NO: 51589 - RNA, 23 nt, Artificial Sequence
  Synthetic
ggggccggggugagggagggaca

SEQ ID NO: 51590 - RNA, 24 nt, Artificial Sequence
  Synthetic
gggggccggggugagggagggaca

SEQ ID NO: 51591 - RNA, 18 nt, Artificial Sequence
  Synthetic
gcccgagagcgggggaca

SEQ ID NO: 51592 - RNA, 19 nt, Artificial Sequence
  Synthetic
agcccgagagcgggggaca

SEQ ID NO: 51593 - RNA, 20 nt, Artificial Sequence
  Synthetic
gagcccgagagcgggggaca

SEQ ID NO: 51594 - RNA, 21 nt, Artificial Sequence
  Synthetic
ggagcccgagagcgggggaca

SEQ ID NO: 51595 - RNA, 22 nt, Artificial Sequence
  Synthetic
aggagcccgagagcgggggaca

SEQ ID NO: 51596 - RNA, 23 nt, Artificial Sequence
  Synthetic
gaggagcccgagagcgggggaca

SEQ ID NO: 51597 - RNA, 24 nt, Artificial Sequence
  Synthetic
ggaggagcccgagagcgggggaca

SEQ ID NO: 51598 - RNA, 18 nt, Artificial Sequence
  Synthetic
acgaggggucggaaucca

SEQ ID NO: 51599 - RNA, 19 nt, Artificial Sequence
  Synthetic
gacgaggggucggaaucca

SEQ ID NO: 51600 - RNA, 20 nt, Artificial Sequence
  Synthetic
agacgaggggucggaaucca

SEQ ID NO: 51601 - RNA, 21 nt, Artificial Sequence
  Synthetic
gagacgaggggucggaaucca

SEQ ID NO: 51602 - RNA, 22 nt, Artificial Sequence
  Synthetic
ggagacgaggggucggaaucca

SEQ ID NO: 51603 - RNA, 23 nt, Artificial Sequence
  Synthetic
gggagacgaggggucggaaucca

SEQ ID NO: 51604 - RNA, 24 nt, Artificial Sequence
  Synthetic
ggggagacgaggggucggaaucca

SEQ ID NO: 51605 - RNA, 18 nt, Artificial Sequence
  Synthetic
ccuuccgaacaaaaagca

SEQ ID NO: 51606 - RNA, 19 nt, Artificial Sequence
  Synthetic
cccuuccgaacaaaaagca

SEQ ID NO: 51607 - RNA, 20 nt, Artificial Sequence
  Synthetic
ccccuuccgaacaaaaagca

SEQ ID NO: 51608 - RNA, 21 nt, Artificial Sequence
  Synthetic
cccccuuccgaacaaaaagca

SEQ ID NO: 51609 - RNA, 22 nt, Artificial Sequence
  Synthetic
ccccccuuccgaacaaaaagca

SEQ ID NO: 51610 - RNA, 23 nt, Artificial Sequence
  Synthetic
cccccccuuccgaacaaaaagca

SEQ ID NO: 51611 - RNA, 24 nt, Artificial Sequence
  Synthetic
ucccccccuuccgaacaaaaagca

SEQ ID NO: 51612 - RNA, 18 nt, Artificial Sequence
  Synthetic
gggggggcgagggaggca

SEQ ID NO: 51613 - RNA, 19 nt, Artificial Sequence
  Synthetic
ugggggggcgagggaggca

SEQ ID NO: 51614 - RNA, 20 nt, Artificial Sequence
  Synthetic
cugggggggcgagggaggca

SEQ ID NO: 51615 - RNA, 21 nt, Artificial Sequence
  Synthetic
ucugggggggcgagggaggca

SEQ ID NO: 51616 - RNA, 22 nt, Artificial Sequence
  Synthetic
cucugggggggcgagggaggca

SEQ ID NO: 51617 - RNA, 23 nt, Artificial Sequence
  Synthetic
ccucugggggggcgagggaggca

SEQ ID NO: 51618 - RNA, 24 nt, Artificial Sequence
  Synthetic
cccucugggggggcgagggaggca

SEQ ID NO: 51619 - RNA, 18 nt, Artificial Sequence
  Synthetic
gacuaaaacccggcaaga

SEQ ID NO: 51620 - RNA, 19 nt, Artificial Sequence
  Synthetic
agacuaaaacccggcaaga

SEQ ID NO: 51621 - RNA, 20 nt, Artificial Sequence
  Synthetic
gagacuaaaacccggcaaga

SEQ ID NO: 51622 - RNA, 21 nt, Artificial Sequence
  Synthetic
agagacuaaaacccggcaaga

SEQ ID NO: 51623 - RNA, 22 nt, Artificial Sequence
  Synthetic
cagagacuaaaacccggcaaga

SEQ ID NO: 51624 - RNA, 23 nt, Artificial Sequence
  Synthetic
acagagacuaaaacccggcaaga

SEQ ID NO: 51625 - RNA, 24 nt, Artificial Sequence
  Synthetic
gacagagacuaaaacccggcaaga

SEQ ID NO: 51626 - RNA, 18 nt, Artificial Sequence
  Synthetic
ggaggagacccggagaga

SEQ ID NO: 51627 - RNA, 19 nt, Artificial Sequence
  Synthetic
aggaggagacccggagaga

SEQ ID NO: 51628 - RNA, 20 nt, Artificial Sequence
  Synthetic
gaggaggagacccggagaga

SEQ ID NO: 51629 - RNA, 21 nt, Artificial Sequence
  Synthetic
ggaggaggagacccggagaga

SEQ ID NO: 51630 - RNA, 22 nt, Artificial Sequence
  Synthetic
gggaggaggagacccggagaga

SEQ ID NO: 51631 - RNA, 23 nt, Artificial Sequence
  Synthetic
cgggaggaggagacccggagaga

SEQ ID NO: 51632 - RNA, 24 nt, Artificial Sequence
  Synthetic
gcgggaggaggagacccggagaga

SEQ ID NO: 51633 - RNA, 18 nt, Artificial Sequence
  Synthetic
gacggggccgccccgaga

SEQ ID NO: 51634 - RNA, 19 nt, Artificial Sequence
  Synthetic
ggacggggccgccccgaga

SEQ ID NO: 51635 - RNA, 20 nt, Artificial Sequence
  Synthetic
gggacggggccgccccgaga

SEQ ID NO: 51636 - RNA, 21 nt, Artificial Sequence
  Synthetic
ggggacggggccgccccgaga

SEQ ID NO: 51637 - RNA, 22 nt, Artificial Sequence
  Synthetic
cggggacggggccgccccgaga

SEQ ID NO: 51638 - RNA, 23 nt, Artificial Sequence
  Synthetic
ccggggacggggccgccccgaga

SEQ ID NO: 51639 - RNA, 24 nt, Artificial Sequence
  Synthetic
cccggggacggggccgccccgaga

SEQ ID NO: 51640 - RNA, 18 nt, Artificial Sequence
  Synthetic
gcagggaggagcccgaga

SEQ ID NO: 51641 - RNA, 19 nt, Artificial Sequence
  Synthetic
ggcagggaggagcccgaga

SEQ ID NO: 51642 - RNA, 20 nt, Artificial Sequence
  Synthetic
aggcagggaggagcccgaga

SEQ ID NO: 51643 - RNA, 21 nt, Artificial Sequence
  Synthetic
gaggcagggaggagcccgaga

SEQ ID NO: 51644 - RNA, 22 nt, Artificial Sequence
  Synthetic
ggaggcagggaggagcccgaga

SEQ ID NO: 51645 - RNA, 23 nt, Artificial Sequence
  Synthetic
gggaggcagggaggagcccgaga

SEQ ID NO: 51646 - RNA, 24 nt, Artificial Sequence
  Synthetic
agggaggcagggaggagcccgaga

SEQ ID NO: 51647 - RNA, 18 nt, Artificial Sequence
  Synthetic
gggacggggccgccccga

SEQ ID NO: 51648 - RNA, 19 nt, Artificial Sequence
  Synthetic
ggggacggggccgccccga

SEQ ID NO: 51649 - RNA, 20 nt, Artificial Sequence
  Synthetic
cggggacggggccgccccga

SEQ ID NO: 51650 - RNA, 21 nt, Artificial Sequence
  Synthetic
ccggggacggggccgccccga

SEQ ID NO: 51651 - RNA, 22 nt, Artificial Sequence
  Synthetic
cccggggacggggccgccccga

SEQ ID NO: 51652 - RNA, 23 nt, Artificial Sequence
  Synthetic
ccccggggacggggccgccccga

SEQ ID NO: 51653 - RNA, 24 nt, Artificial Sequence
  Synthetic
uccccggggacggggccgccccga

SEQ ID NO: 51654 - RNA, 18 nt, Artificial Sequence
  Synthetic
ccccggcacugcgagcga

SEQ ID NO: 51655 - RNA, 19 nt, Artificial Sequence
  Synthetic
accccggcacugcgagcga

SEQ ID NO: 51656 - RNA, 20 nt, Artificial Sequence
  Synthetic
caccccggcacugcgagcga

SEQ ID NO: 51657 - RNA, 21 nt, Artificial Sequence
  Synthetic
gcaccccggcacugcgagcga

SEQ ID NO: 51658 - RNA, 22 nt, Artificial Sequence
  Synthetic
cgcaccccggcacugcgagcga

SEQ ID NO: 51659 - RNA, 23 nt, Artificial Sequence
  Synthetic
ucgcaccccggcacugcgagcga

SEQ ID NO: 51660 - RNA, 24 nt, Artificial Sequence
  Synthetic
uucgcaccccggcacugcgagcga

SEQ ID NO: 51661 - RNA, 18 nt, Artificial Sequence
  Synthetic
gacccucugggggggcga

SEQ ID NO: 51662 - RNA, 19 nt, Artificial Sequence
  Synthetic
cgacccucugggggggcga

SEQ ID NO: 51663 - RNA, 20 nt, Artificial Sequence
  Synthetic
ccgacccucugggggggcga

SEQ ID NO: 51664 - RNA, 21 nt, Artificial Sequence
  Synthetic
cccgacccucugggggggcga

SEQ ID NO: 51665 - RNA, 22 nt, Artificial Sequence
  Synthetic
ccccgacccucugggggggcga

SEQ ID NO: 51666 - RNA, 23 nt, Artificial Sequence
  Synthetic
cccccgacccucugggggggcga

SEQ ID NO: 51667 - RNA, 24 nt, Artificial Sequence
  Synthetic
ccccccgacccucugggggggcga

SEQ ID NO: 51668 - RNA, 18 nt, Artificial Sequence
  Synthetic
ccgguugguccccgggga

SEQ ID NO: 51669 - RNA, 19 nt, Artificial Sequence
  Synthetic
cccgguugguccccgggga

SEQ ID NO: 51670 - RNA, 20 nt, Artificial Sequence
  Synthetic
acccgguugguccccgggga

SEQ ID NO: 51671 - RNA, 21 nt, Artificial Sequence
  Synthetic
cacccgguugguccccgggga

SEQ ID NO: 51672 - RNA, 22 nt, Artificial Sequence
  Synthetic
acacccgguugguccccgggga

SEQ ID NO: 51673 - RNA, 23 nt, Artificial Sequence
  Synthetic
uacacccgguugguccccgggga

SEQ ID NO: 51674 - RNA, 24 nt, Artificial Sequence
  Synthetic
guacacccgguugguccccgggga

SEQ ID NO: 51675 - RNA, 18 nt, Artificial Sequence
  Synthetic
gagcccgagagcggggga

SEQ ID NO: 51676 - RNA, 19 nt, Artificial Sequence
  Synthetic
ggagcccgagagcggggga

SEQ ID NO: 51677 - RNA, 20 nt, Artificial Sequence
  Synthetic
aggagcccgagagcggggga

SEQ ID NO: 51678 - RNA, 21 nt, Artificial Sequence
  Synthetic
gaggagcccgagagcggggga

SEQ ID NO: 51679 - RNA, 22 nt, Artificial Sequence
  Synthetic
ggaggagcccgagagcggggga

SEQ ID NO: 51680 - RNA, 23 nt, Artificial Sequence
  Synthetic
gggaggagcccgagagcggggga

SEQ ID NO: 51681 - RNA, 24 nt, Artificial Sequence
  Synthetic
agggaggagcccgagagcggggga

SEQ ID NO: 51682 - RNA, 18 nt, Artificial Sequence
  Synthetic
agacccccggcacgguga

SEQ ID NO: 51683 - RNA, 19 nt, Artificial Sequence
  Synthetic
cagacccccggcacgguga

SEQ ID NO: 51684 - RNA, 20 nt, Artificial Sequence
  Synthetic
gcagacccccggcacgguga

SEQ ID NO: 51685 - RNA, 21 nt, Artificial Sequence
  Synthetic
ggcagacccccggcacgguga

SEQ ID NO: 51686 - RNA, 22 nt, Artificial Sequence
  Synthetic
cggcagacccccggcacgguga

SEQ ID NO: 51687 - RNA, 23 nt, Artificial Sequence
  Synthetic
gcggcagacccccggcacgguga

SEQ ID NO: 51688 - RNA, 24 nt, Artificial Sequence
  Synthetic
cgcggcagacccccggcacgguga

SEQ ID NO: 51689 - RNA, 18 nt, Artificial Sequence
  Synthetic
ggcggggggccgggguga

SEQ ID NO: 51690 - RNA, 19 nt, Artificial Sequence
  Synthetic
gggcggggggccgggguga

SEQ ID NO: 51691 - RNA, 20 nt, Artificial Sequence
  Synthetic
cgggcggggggccgggguga

SEQ ID NO: 51692 - RNA, 21 nt, Artificial Sequence
  Synthetic
gcgggcggggggccgggguga

SEQ ID NO: 51693 - RNA, 22 nt, Artificial Sequence
  Synthetic
agcgggcggggggccgggguga

SEQ ID NO: 51694 - RNA, 23 nt, Artificial Sequence
  Synthetic
cagcgggcggggggccgggguga

SEQ ID NO: 51695 - RNA, 24 nt, Artificial Sequence
  Synthetic
gcagcgggcggggggccgggguga

SEQ ID NO: 51696 - RNA, 18 nt, Artificial Sequence
  Synthetic
gggggcggggacgcuuga

SEQ ID NO: 51697 - RNA, 19 nt, Artificial Sequence
  Synthetic
cgggggcggggacgcuuga

SEQ ID NO: 51698 - RNA, 20 nt, Artificial Sequence
  Synthetic
ucgggggcggggacgcuuga

SEQ ID NO: 51699 - RNA, 21 nt, Artificial Sequence
  Synthetic
cucgggggcggggacgcuuga

SEQ ID NO: 51700 - RNA, 22 nt, Artificial Sequence
  Synthetic
gcucgggggcggggacgcuuga

SEQ ID NO: 51701 - RNA, 23 nt, Artificial Sequence
  Synthetic
ggcucgggggcggggacgcuuga

SEQ ID NO: 51702 - RNA, 24 nt, Artificial Sequence
  Synthetic
gggcucgggggcggggacgcuuga

SEQ ID NO: 51703 - RNA, 18 nt, Artificial Sequence
  Synthetic
cgccggggcgcgcggcua

SEQ ID NO: 51704 - RNA, 19 nt, Artificial Sequence
  Synthetic
ccgccggggcgcgcggcua

SEQ ID NO: 51705 - RNA, 20 nt, Artificial Sequence
  Synthetic
cccgccggggcgcgcggcua

SEQ ID NO: 51706 - RNA, 21 nt, Artificial Sequence
  Synthetic
ccccgccggggcgcgcggcua

SEQ ID NO: 51707 - RNA, 22 nt, Artificial Sequence
  Synthetic
cccccgccggggcgcgcggcua

SEQ ID NO: 51708 - RNA, 23 nt, Artificial Sequence
  Synthetic
gcccccgccggggcgcgcggcua

SEQ ID NO: 51709 - RNA, 24 nt, Artificial Sequence
  Synthetic
cgcccccgccggggcgcgcggcua

SEQ ID NO: 51710 - RNA, 18 nt, Artificial Sequence
  Synthetic
ggggggcggcgcaugcua

SEQ ID NO: 51711 - RNA, 19 nt, Artificial Sequence
  Synthetic
cggggggcggcgcaugcua

SEQ ID NO: 51712 - RNA, 20 nt, Artificial Sequence
  Synthetic
gcggggggcggcgcaugcua

SEQ ID NO: 51713 - RNA, 21 nt, Artificial Sequence
  Synthetic
ggcggggggcggcgcaugcua

SEQ ID NO: 51714 - RNA, 22 nt, Artificial Sequence
  Synthetic
cggcggggggcggcgcaugcua

SEQ ID NO: 51715 - RNA, 23 nt, Artificial Sequence
  Synthetic
ucggcggggggcggcgcaugcua

SEQ ID NO: 51716 - RNA, 24 nt, Artificial Sequence
  Synthetic
gucggcggggggcggcgcaugcua

SEQ ID NO: 51717 - RNA, 18 nt, Artificial Sequence
  Synthetic
ggggugagggagggacac

SEQ ID NO: 51718 - RNA, 19 nt, Artificial Sequence
  Synthetic
cggggugagggagggacac

SEQ ID NO: 51719 - RNA, 20 nt, Artificial Sequence
  Synthetic
ccggggugagggagggacac

SEQ ID NO: 51720 - RNA, 21 nt, Artificial Sequence
  Synthetic
gccggggugagggagggacac

SEQ ID NO: 51721 - RNA, 22 nt, Artificial Sequence
  Synthetic
ggccggggugagggagggacac

SEQ ID NO: 51722 - RNA, 23 nt, Artificial Sequence
  Synthetic
gggccggggugagggagggacac

SEQ ID NO: 51723 - RNA, 24 nt, Artificial Sequence
  Synthetic
ggggccggggugagggagggacac

SEQ ID NO: 51724 - RNA, 18 nt, Artificial Sequence
  Synthetic
ccggcgggaggaggagac

SEQ ID NO: 51725 - RNA, 19 nt, Artificial Sequence
  Synthetic
cccggcgggaggaggagac

SEQ ID NO: 51726 - RNA, 20 nt, Artificial Sequence
  Synthetic
gcccggcgggaggaggagac

SEQ ID NO: 51727 - RNA, 21 nt, Artificial Sequence
  Synthetic
ggcccggcgggaggaggagac

SEQ ID NO: 51728 - RNA, 22 nt, Artificial Sequence
  Synthetic
cggcccggcgggaggaggagac

SEQ ID NO: 51729 - RNA, 23 nt, Artificial Sequence
  Synthetic
gcggcccggcgggaggaggagac

SEQ ID NO: 51730 - RNA, 24 nt, Artificial Sequence
  Synthetic
ggcggcccggcgggaggaggagac

SEQ ID NO: 51731 - RNA, 18 nt, Artificial Sequence
  Synthetic
ggggacagggggggagac

SEQ ID NO: 51732 - RNA, 19 nt, Artificial Sequence
  Synthetic
gggggacagggggggagac

SEQ ID NO: 51733 - RNA, 20 nt, Artificial Sequence
  Synthetic
cgggggacagggggggagac

SEQ ID NO: 51734 - RNA, 21 nt, Artificial Sequence
  Synthetic
gcgggggacagggggggagac

SEQ ID NO: 51735 - RNA, 22 nt, Artificial Sequence
  Synthetic
agcgggggacagggggggagac

SEQ ID NO: 51736 - RNA, 23 nt, Artificial Sequence
  Synthetic
gagcgggggacagggggggagac

SEQ ID NO: 51737 - RNA, 24 nt, Artificial Sequence
  Synthetic
agagcgggggacagggggggagac

SEQ ID NO: 51738 - RNA, 18 nt, Artificial Sequence
  Synthetic
ccggggugagggagggac

SEQ ID NO: 51739 - RNA, 19 nt, Artificial Sequence
  Synthetic
gccggggugagggagggac

SEQ ID NO: 51740 - RNA, 20 nt, Artificial Sequence
  Synthetic
ggccggggugagggagggac

SEQ ID NO: 51741 - RNA, 21 nt, Artificial Sequence
  Synthetic
gggccggggugagggagggac

SEQ ID NO: 51742 - RNA, 22 nt, Artificial Sequence
  Synthetic
ggggccggggugagggagggac

SEQ ID NO: 51743 - RNA, 23 nt, Artificial Sequence
  Synthetic
gggggccggggugagggagggac

SEQ ID NO: 51744 - RNA, 24 nt, Artificial Sequence
  Synthetic
ggggggccggggugagggagggac

SEQ ID NO: 51745 - RNA, 18 nt, Artificial Sequence
  Synthetic
agcccgagagcgggggac

SEQ ID NO: 51746 - RNA, 19 nt, Artificial Sequence
  Synthetic
gagcccgagagcgggggac

SEQ ID NO: 51747 - RNA, 20 nt, Artificial Sequence
  Synthetic
ggagcccgagagcgggggac

SEQ ID NO: 51748 - RNA, 21 nt, Artificial Sequence
  Synthetic
aggagcccgagagcgggggac

SEQ ID NO: 51749 - RNA, 22 nt, Artificial Sequence
  Synthetic
gaggagcccgagagcgggggac

SEQ ID NO: 51750 - RNA, 23 nt, Artificial Sequence
  Synthetic
ggaggagcccgagagcgggggac

SEQ ID NO: 51751 - RNA, 24 nt, Artificial Sequence
  Synthetic
gggaggagcccgagagcgggggac

SEQ ID NO: 51752 - RNA, 18 nt, Artificial Sequence
  Synthetic
cccggcaagagagagacc

SEQ ID NO: 51753 - RNA, 19 nt, Artificial Sequence
  Synthetic
acccggcaagagagagacc

SEQ ID NO: 51754 - RNA, 20 nt, Artificial Sequence
  Synthetic
aacccggcaagagagagacc

SEQ ID NO: 51755 - RNA, 21 nt, Artificial Sequence
  Synthetic
aaacccggcaagagagagacc

SEQ ID NO: 51756 - RNA, 22 nt, Artificial Sequence
  Synthetic
aaaacccggcaagagagagacc

SEQ ID NO: 51757 - RNA, 23 nt, Artificial Sequence
  Synthetic
uaaaacccggcaagagagagacc

SEQ ID NO: 51758 - RNA, 24 nt, Artificial Sequence
  Synthetic
cuaaaacccggcaagagagagacc

SEQ ID NO: 51759 - RNA, 18 nt, Artificial Sequence
  Synthetic
cggcgggaggaggagacc

SEQ ID NO: 51760 - RNA, 19 nt, Artificial Sequence
  Synthetic
ccggcgggaggaggagacc

SEQ ID NO: 51761 - RNA, 20 nt, Artificial Sequence
  Synthetic
cccggcgggaggaggagacc

SEQ ID NO: 51762 - RNA, 21 nt, Artificial Sequence
  Synthetic
gcccggcgggaggaggagacc

SEQ ID NO: 51763 - RNA, 22 nt, Artificial Sequence
  Synthetic
ggcccggcgggaggaggagacc

SEQ ID NO: 51764 - RNA, 23 nt, Artificial Sequence
  Synthetic
cggcccggcgggaggaggagacc

SEQ ID NO: 51765 - RNA, 24 nt, Artificial Sequence
  Synthetic
gcggcccggcgggaggaggagacc

SEQ ID NO: 51766 - RNA, 18 nt, Artificial Sequence
  Synthetic
agcggucgggggaccccc

SEQ ID NO: 51767 - RNA, 19 nt, Artificial Sequence
  Synthetic
aagcggucgggggaccccc

SEQ ID NO: 51768 - RNA, 20 nt, Artificial Sequence
  Synthetic
uaagcggucgggggaccccc

SEQ ID NO: 51769 - RNA, 21 nt, Artificial Sequence
  Synthetic
uuaagcggucgggggaccccc

SEQ ID NO: 51770 - RNA, 22 nt, Artificial Sequence
  Synthetic
cuuaagcggucgggggaccccc

SEQ ID NO: 51771 - RNA, 23 nt, Artificial Sequence
  Synthetic
gcuuaagcggucgggggaccccc

SEQ ID NO: 51772 - RNA, 24 nt, Artificial Sequence
  Synthetic
cgcuuaagcggucgggggaccccc

SEQ ID NO: 51773 - RNA, 18 nt, Artificial Sequence
  Synthetic
cggggacggggccgcccc

SEQ ID NO: 51774 - RNA, 19 nt, Artificial Sequence
  Synthetic
ccggggacggggccgcccc

SEQ ID NO: 51775 - RNA, 20 nt, Artificial Sequence
  Synthetic
cccggggacggggccgcccc

SEQ ID NO: 51776 - RNA, 21 nt, Artificial Sequence
  Synthetic
ccccggggacggggccgcccc

SEQ ID NO: 51777 - RNA, 22 nt, Artificial Sequence
  Synthetic
uccccggggacggggccgcccc

SEQ ID NO: 51778 - RNA, 23 nt, Artificial Sequence
  Synthetic
guccccggggacggggccgcccc

SEQ ID NO: 51779 - RNA, 24 nt, Artificial Sequence
  Synthetic
gguccccggggacggggccgcccc

SEQ ID NO: 51780 - RNA, 18 nt, Artificial Sequence
  Synthetic
gcuaaugaauuucucccc

SEQ ID NO: 51781 - RNA, 19 nt, Artificial Sequence
  Synthetic
ugcuaaugaauuucucccc

SEQ ID NO: 51782 - RNA, 20 nt, Artificial Sequence
  Synthetic
augcuaaugaauuucucccc

SEQ ID NO: 51783 - RNA, 21 nt, Artificial Sequence
  Synthetic
uaugcuaaugaauuucucccc

SEQ ID NO: 51784 - RNA, 22 nt, Artificial Sequence
  Synthetic
guaugcuaaugaauuucucccc

SEQ ID NO: 51785 - RNA, 23 nt, Artificial Sequence
  Synthetic
aguaugcuaaugaauuucucccc

SEQ ID NO: 51786 - RNA, 24 nt, Artificial Sequence
  Synthetic
uaguaugcuaaugaauuucucccc

SEQ ID NO: 51787 - RNA, 18 nt, Artificial Sequence
  Synthetic
uacacccgguuggucccc

SEQ ID NO: 51788 - RNA, 19 nt, Artificial Sequence
  Synthetic
guacacccgguuggucccc

SEQ ID NO: 51789 - RNA, 20 nt, Artificial Sequence
  Synthetic
aguacacccgguuggucccc

SEQ ID NO: 51790 - RNA, 21 nt, Artificial Sequence
  Synthetic
gaguacacccgguuggucccc

SEQ ID NO: 51791 - RNA, 22 nt, Artificial Sequence
  Synthetic
ggaguacacccgguuggucccc

SEQ ID NO: 51792 - RNA, 23 nt, Artificial Sequence
  Synthetic
uggaguacacccgguuggucccc

SEQ ID NO: 51793 - RNA, 24 nt, Artificial Sequence
  Synthetic
uuggaguacacccgguuggucccc

SEQ ID NO: 51794 - RNA, 18 nt, Artificial Sequence
  Synthetic
ggaggcagggaggagccc

SEQ ID NO: 51795 - RNA, 19 nt, Artificial Sequence
  Synthetic
gggaggcagggaggagccc

SEQ ID NO: 51796 - RNA, 20 nt, Artificial Sequence
  Synthetic
agggaggcagggaggagccc

SEQ ID NO: 51797 - RNA, 21 nt, Artificial Sequence
  Synthetic
gagggaggcagggaggagccc

SEQ ID NO: 51798 - RNA, 22 nt, Artificial Sequence
  Synthetic
cgagggaggcagggaggagccc

SEQ ID NO: 51799 - RNA, 23 nt, Artificial Sequence
  Synthetic
gcgagggaggcagggaggagccc

SEQ ID NO: 51800 - RNA, 24 nt, Artificial Sequence
  Synthetic
ggcgagggaggcagggaggagccc

SEQ ID NO: 51801 - RNA, 18 nt, Artificial Sequence
  Synthetic
ugcuaaugaauuucuccc

SEQ ID NO: 51802 - RNA, 19 nt, Artificial Sequence
  Synthetic
augcuaaugaauuucuccc

SEQ ID NO: 51803 - RNA, 20 nt, Artificial Sequence
  Synthetic
uaugcuaaugaauuucuccc

SEQ ID NO: 51804 - RNA, 21 nt, Artificial Sequence
  Synthetic
guaugcuaaugaauuucuccc

SEQ ID NO: 51805 - RNA, 22 nt, Artificial Sequence
  Synthetic
aguaugcuaaugaauuucuccc

SEQ ID NO: 51806 - RNA, 23 nt, Artificial Sequence
  Synthetic
uaguaugcuaaugaauuucuccc

SEQ ID NO: 51807 - RNA, 24 nt, Artificial Sequence
  Synthetic
cuaguaugcuaaugaauuucuccc

SEQ ID NO: 51808 - RNA, 18 nt, Artificial Sequence
  Synthetic
ucggccccuauugguccc

SEQ ID NO: 51809 - RNA, 19 nt, Artificial Sequence
  Synthetic
aucggccccuauugguccc

SEQ ID NO: 51810 - RNA, 20 nt, Artificial Sequence
  Synthetic
gaucggccccuauugguccc

SEQ ID NO: 51811 - RNA, 21 nt, Artificial Sequence
  Synthetic
ugaucggccccuauugguccc

SEQ ID NO: 51812 - RNA, 22 nt, Artificial Sequence
  Synthetic
cugaucggccccuauugguccc

SEQ ID NO: 51813 - RNA, 23 nt, Artificial Sequence
  Synthetic
gcugaucggccccuauugguccc

SEQ ID NO: 51814 - RNA, 24 nt, Artificial Sequence
  Synthetic
ggcugaucggccccuauugguccc

SEQ ID NO: 51815 - RNA, 18 nt, Artificial Sequence
  Synthetic
guacacccgguugguccc

SEQ ID NO: 51816 - RNA, 19 nt, Artificial Sequence
  Synthetic
aguacacccgguugguccc

SEQ ID NO: 51817 - RNA, 20 nt, Artificial Sequence
  Synthetic
gaguacacccgguugguccc

SEQ ID NO: 51818 - RNA, 21 nt, Artificial Sequence
  Synthetic
ggaguacacccgguugguccc

SEQ ID NO: 51819 - RNA, 22 nt, Artificial Sequence
  Synthetic
uggaguacacccgguugguccc

SEQ ID NO: 51820 - RNA, 23 nt, Artificial Sequence
  Synthetic
uuggaguacacccgguugguccc

SEQ ID NO: 51821 - RNA, 24 nt, Artificial Sequence
  Synthetic
cuuggaguacacccgguugguccc

SEQ ID NO: 51822 - RNA, 18 nt, Artificial Sequence
  Synthetic
cccggggacggggccgcc

SEQ ID NO: 51823 - RNA, 19 nt, Artificial Sequence
  Synthetic
ccccggggacggggccgcc

SEQ ID NO: 51824 - RNA, 20 nt, Artificial Sequence
  Synthetic
uccccggggacggggccgcc

SEQ ID NO: 51825 - RNA, 21 nt, Artificial Sequence
  Synthetic
guccccggggacggggccgcc

SEQ ID NO: 51826 - RNA, 22 nt, Artificial Sequence
  Synthetic
gguccccggggacggggccgcc

SEQ ID NO: 51827 - RNA, 23 nt, Artificial Sequence
  Synthetic
ugguccccggggacggggccgcc

SEQ ID NO: 51828 - RNA, 24 nt, Artificial Sequence
  Synthetic
uugguccccggggacggggccgcc

SEQ ID NO: 51829 - RNA, 18 nt, Artificial Sequence
  Synthetic
ccgcgccggcggggcgcc

SEQ ID NO: 51830 - RNA, 19 nt, Artificial Sequence
  Synthetic
gccgcgccggcggggcgcc

SEQ ID NO: 51831 - RNA, 20 nt, Artificial Sequence
  Synthetic
ggccgcgccggcggggcgcc

SEQ ID NO: 51832 - RNA, 21 nt, Artificial Sequence
  Synthetic
gggccgcgccggcggggcgcc

SEQ ID NO: 51833 - RNA, 22 nt, Artificial Sequence
  Synthetic
agggccgcgccggcggggcgcc

SEQ ID NO: 51834 - RNA, 23 nt, Artificial Sequence
  Synthetic
cagggccgcgccggcggggcgcc

SEQ ID NO: 51835 - RNA, 24 nt, Artificial Sequence
  Synthetic
ucagggccgcgccggcggggcgcc

SEQ ID NO: 51836 - RNA, 18 nt, Artificial Sequence
  Synthetic
cccgggcggaccccggcc

SEQ ID NO: 51837 - RNA, 19 nt, Artificial Sequence
  Synthetic
ucccgggcggaccccggcc

SEQ ID NO: 51838 - RNA, 20 nt, Artificial Sequence
  Synthetic
cucccgggcggaccccggcc

SEQ ID NO: 51839 - RNA, 21 nt, Artificial Sequence
  Synthetic
gcucccgggcggaccccggcc

SEQ ID NO: 51840 - RNA, 22 nt, Artificial Sequence
  Synthetic
agcucccgggcggaccccggcc

SEQ ID NO: 51841 - RNA, 23 nt, Artificial Sequence
  Synthetic
gagcucccgggcggaccccggcc

SEQ ID NO: 51842 - RNA, 24 nt, Artificial Sequence
  Synthetic
cgagcucccgggcggaccccggcc

SEQ ID NO: 51843 - RNA, 18 nt, Artificial Sequence
  Synthetic
augcuaaugaauuucucc

SEQ ID NO: 51844 - RNA, 19 nt, Artificial Sequence
  Synthetic
uaugcuaaugaauuucucc

SEQ ID NO: 51845 - RNA, 20 nt, Artificial Sequence
  Synthetic
guaugcuaaugaauuucucc

SEQ ID NO: 51846 - RNA, 21 nt, Artificial Sequence
  Synthetic
aguaugcuaaugaauuucucc

SEQ ID NO: 51847 - RNA, 22 nt, Artificial Sequence
  Synthetic
uaguaugcuaaugaauuucucc

SEQ ID NO: 51848 - RNA, 23 nt, Artificial Sequence
  Synthetic
cuaguaugcuaaugaauuucucc

SEQ ID NO: 51849 - RNA, 24 nt, Artificial Sequence
  Synthetic
ccuaguaugcuaaugaauuucucc

SEQ ID NO: 51850 - RNA, 18 nt, Artificial Sequence
  Synthetic
aguacacccgguuggucc

SEQ ID NO: 51851 - RNA, 19 nt, Artificial Sequence
  Synthetic
gaguacacccgguuggucc

SEQ ID NO: 51852 - RNA, 20 nt, Artificial Sequence
  Synthetic
ggaguacacccgguuggucc

SEQ ID NO: 51853 - RNA, 21 nt, Artificial Sequence
  Synthetic
uggaguacacccgguuggucc

SEQ ID NO: 51854 - RNA, 22 nt, Artificial Sequence
  Synthetic
uuggaguacacccgguuggucc

SEQ ID NO: 51855 - RNA, 23 nt, Artificial Sequence
  Synthetic
cuuggaguacacccgguuggucc

SEQ ID NO: 51856 - RNA, 24 nt, Artificial Sequence
  Synthetic
ucuuggaguacacccgguuggucc

SEQ ID NO: 51857 - RNA, 18 nt, Artificial Sequence
  Synthetic
ucaggcccccccuuuucc

SEQ ID NO: 51858 - RNA, 19 nt, Artificial Sequence
  Synthetic
cucaggcccccccuuuucc

SEQ ID NO: 51859 - RNA, 20 nt, Artificial Sequence
  Synthetic
ucucaggcccccccuuuucc

SEQ ID NO: 51860 - RNA, 21 nt, Artificial Sequence
  Synthetic
gucucaggcccccccuuuucc

SEQ ID NO: 51861 - RNA, 22 nt, Artificial Sequence
  Synthetic
ggucucaggcccccccuuuucc

SEQ ID NO: 51862 - RNA, 23 nt, Artificial Sequence
  Synthetic
gggucucaggcccccccuuuucc

SEQ ID NO: 51863 - RNA, 24 nt, Artificial Sequence
  Synthetic
cgggucucaggcccccccuuuucc

SEQ ID NO: 51864 - RNA, 18 nt, Artificial Sequence
  Synthetic
agggaggagcccgagagc

SEQ ID NO: 51865 - RNA, 19 nt, Artificial Sequence
  Synthetic
cagggaggagcccgagagc

SEQ ID NO: 51866 - RNA, 20 nt, Artificial Sequence
  Synthetic
gcagggaggagcccgagagc

SEQ ID NO: 51867 - RNA, 21 nt, Artificial Sequence
  Synthetic
ggcagggaggagcccgagagc

SEQ ID NO: 51868 - RNA, 22 nt, Artificial Sequence
  Synthetic
aggcagggaggagcccgagagc

SEQ ID NO: 51869 - RNA, 23 nt, Artificial Sequence
  Synthetic
gaggcagggaggagcccgagagc

SEQ ID NO: 51870 - RNA, 24 nt, Artificial Sequence
  Synthetic
ggaggcagggaggagcccgagagc

SEQ ID NO: 51871 - RNA, 18 nt, Artificial Sequence
  Synthetic
agggaggcagggaggagc

SEQ ID NO: 51872 - RNA, 19 nt, Artificial Sequence
  Synthetic
gagggaggcagggaggagc

SEQ ID NO: 51873 - RNA, 20 nt, Artificial Sequence
  Synthetic
cgagggaggcagggaggagc

SEQ ID NO: 51874 - RNA, 21 nt, Artificial Sequence
  Synthetic
gcgagggaggcagggaggagc

SEQ ID NO: 51875 - RNA, 22 nt, Artificial Sequence
  Synthetic
ggcgagggaggcagggaggagc

SEQ ID NO: 51876 - RNA, 23 nt, Artificial Sequence
  Synthetic
gggcgagggaggcagggaggagc

SEQ ID NO: 51877 - RNA, 24 nt, Artificial Sequence
  Synthetic
ggggcgagggaggcagggaggagc

SEQ ID NO: 51878 - RNA, 18 nt, Artificial Sequence
  Synthetic
cccucccuccgcccccgc

SEQ ID NO: 51879 - RNA, 19 nt, Artificial Sequence
  Synthetic
ucccucccuccgcccccgc

SEQ ID NO: 51880 - RNA, 20 nt, Artificial Sequence
  Synthetic
uucccucccuccgcccccgc

SEQ ID NO: 51881 - RNA, 21 nt, Artificial Sequence
  Synthetic
auucccucccuccgcccccgc

SEQ ID NO: 51882 - RNA, 22 nt, Artificial Sequence
  Synthetic
gauucccucccuccgcccccgc

SEQ ID NO: 51883 - RNA, 23 nt, Artificial Sequence
  Synthetic
ggauucccucccuccgcccccgc

SEQ ID NO: 51884 - RNA, 24 nt, Artificial Sequence
  Synthetic
gggauucccucccuccgcccccgc

SEQ ID NO: 51885 - RNA, 18 nt, Artificial Sequence
  Synthetic
gccgcgccggcggggcgc

SEQ ID NO: 51886 - RNA, 19 nt, Artificial Sequence
  Synthetic
ggccgcgccggcggggcgc

SEQ ID NO: 51887 - RNA, 20 nt, Artificial Sequence
  Synthetic
gggccgcgccggcggggcgc

SEQ ID NO: 51888 - RNA, 21 nt, Artificial Sequence
  Synthetic
agggccgcgccggcggggcgc

SEQ ID NO: 51889 - RNA, 22 nt, Artificial Sequence
  Synthetic
cagggccgcgccggcggggcgc

SEQ ID NO: 51890 - RNA, 23 nt, Artificial Sequence
  Synthetic
ucagggccgcgccggcggggcgc

SEQ ID NO: 51891 - RNA, 24 nt, Artificial Sequence
  Synthetic
cucagggccgcgccggcggggcgc

SEQ ID NO: 51892 - RNA, 18 nt, Artificial Sequence
  Synthetic
ugggggggcgagggaggc

SEQ ID NO: 51893 - RNA, 19 nt, Artificial Sequence
  Synthetic
cugggggggcgagggaggc

SEQ ID NO: 51894 - RNA, 20 nt, Artificial Sequence
  Synthetic
ucugggggggcgagggaggc

SEQ ID NO: 51895 - RNA, 21 nt, Artificial Sequence
  Synthetic
cucugggggggcgagggaggc

SEQ ID NO: 51896 - RNA, 22 nt, Artificial Sequence
  Synthetic
ccucugggggggcgagggaggc

SEQ ID NO: 51897 - RNA, 23 nt, Artificial Sequence
  Synthetic
cccucugggggggcgagggaggc

SEQ ID NO: 51898 - RNA, 24 nt, Artificial Sequence
  Synthetic
acccucugggggggcgagggaggc

SEQ ID NO: 51899 - RNA, 18 nt, Artificial Sequence
  Synthetic
ggacacgggggacacggc

SEQ ID NO: 51900 - RNA, 19 nt, Artificial Sequence
  Synthetic
gggacacgggggacacggc

SEQ ID NO: 51901 - RNA, 20 nt, Artificial Sequence
  Synthetic
agggacacgggggacacggc

SEQ ID NO: 51902 - RNA, 21 nt, Artificial Sequence
  Synthetic
gagggacacgggggacacggc

SEQ ID NO: 51903 - RNA, 22 nt, Artificial Sequence
  Synthetic
ggagggacacgggggacacggc

SEQ ID NO: 51904 - RNA, 23 nt, Artificial Sequence
  Synthetic
gggagggacacgggggacacggc

SEQ ID NO: 51905 - RNA, 24 nt, Artificial Sequence
  Synthetic
agggagggacacgggggacacggc

SEQ ID NO: 51906 - RNA, 18 nt, Artificial Sequence
  Synthetic
cagagacuaaaacccggc

SEQ ID NO: 51907 - RNA, 19 nt, Artificial Sequence
  Synthetic
acagagacuaaaacccggc

SEQ ID NO: 51908 - RNA, 20 nt, Artificial Sequence
  Synthetic
gacagagacuaaaacccggc

SEQ ID NO: 51909 - RNA, 21 nt, Artificial Sequence
  Synthetic
agacagagacuaaaacccggc

SEQ ID NO: 51910 - RNA, 22 nt, Artificial Sequence
  Synthetic
gagacagagacuaaaacccggc

SEQ ID NO: 51911 - RNA, 23 nt, Artificial Sequence
  Synthetic
agagacagagacuaaaacccggc

SEQ ID NO: 51912 - RNA, 24 nt, Artificial Sequence
  Synthetic
gagagacagagacuaaaacccggc

SEQ ID NO: 51913 - RNA, 18 nt, Artificial Sequence
  Synthetic
acggagcggcggcccggc

SEQ ID NO: 51914 - RNA, 19 nt, Artificial Sequence
  Synthetic
gacggagcggcggcccggc

SEQ ID NO: 51915 - RNA, 20 nt, Artificial Sequence
  Synthetic
cgacggagcggcggcccggc

SEQ ID NO: 51916 - RNA, 21 nt, Artificial Sequence
  Synthetic
gcgacggagcggcggcccggc

SEQ ID NO: 51917 - RNA, 22 nt, Artificial Sequence
  Synthetic
agcgacggagcggcggcccggc

SEQ ID NO: 51918 - RNA, 23 nt, Artificial Sequence
  Synthetic
gagcgacggagcggcggcccggc

SEQ ID NO: 51919 - RNA, 24 nt, Artificial Sequence
  Synthetic
cgagcgacggagcggcggcccggc

SEQ ID NO: 51920 - RNA, 18 nt, Artificial Sequence
  Synthetic
acucccaucugcgucggc

SEQ ID NO: 51921 - RNA, 19 nt, Artificial Sequence
  Synthetic
gacucccaucugcgucggc

SEQ ID NO: 51922 - RNA, 20 nt, Artificial Sequence
  Synthetic
ggacucccaucugcgucggc

SEQ ID NO: 51923 - RNA, 21 nt, Artificial Sequence
  Synthetic
gggacucccaucugcgucggc

SEQ ID NO: 51924 - RNA, 22 nt, Artificial Sequence
  Synthetic
ggggacucccaucugcgucggc

SEQ ID NO: 51925 - RNA, 23 nt, Artificial Sequence
  Synthetic
gggggacucccaucugcgucggc

SEQ ID NO: 51926 - RNA, 24 nt, Artificial Sequence
  Synthetic
ggggggacucccaucugcgucggc

SEQ ID NO: 51927 - RNA, 18 nt, Artificial Sequence
  Synthetic
gaacaaaaagcagcgggc

SEQ ID NO: 51928 - RNA, 19 nt, Artificial Sequence
  Synthetic
cgaacaaaaagcagcgggc

SEQ ID NO: 51929 - RNA, 20 nt, Artificial Sequence
  Synthetic
ccgaacaaaaagcagcgggc

SEQ ID NO: 51930 - RNA, 21 nt, Artificial Sequence
  Synthetic
uccgaacaaaaagcagcgggc

SEQ ID NO: 51931 - RNA, 22 nt, Artificial Sequence
  Synthetic
uuccgaacaaaaagcagcgggc

SEQ ID NO: 51932 - RNA, 23 nt, Artificial Sequence
  Synthetic
cuuccgaacaaaaagcagcgggc

SEQ ID NO: 51933 - RNA, 24 nt, Artificial Sequence
  Synthetic
ccuuccgaacaaaaagcagcgggc

SEQ ID NO: 51934 - RNA, 18 nt, Artificial Sequence
  Synthetic
ggcggugggcucgggggc

SEQ ID NO: 51935 - RNA, 19 nt, Artificial Sequence
  Synthetic
gggcggugggcucgggggc

SEQ ID NO: 51936 - RNA, 20 nt, Artificial Sequence
  Synthetic
cgggcggugggcucgggggc

SEQ ID NO: 51937 - RNA, 21 nt, Artificial Sequence
  Synthetic
gcgggcggugggcucgggggc

SEQ ID NO: 51938 - RNA, 22 nt, Artificial Sequence
  Synthetic
cgcgggcggugggcucgggggc

SEQ ID NO: 51939 - RNA, 23 nt, Artificial Sequence
  Synthetic
ucgcgggcggugggcucgggggc

SEQ ID NO: 51940 - RNA, 24 nt, Artificial Sequence
  Synthetic
gucgcgggcggugggcucgggggc

SEQ ID NO: 51941 - RNA, 18 nt, Artificial Sequence
  Synthetic
ccgacccucugggggggc

SEQ ID NO: 51942 - RNA, 19 nt, Artificial Sequence
  Synthetic
cccgacccucugggggggc

SEQ ID NO: 51943 - RNA, 20 nt, Artificial Sequence
  Synthetic
ccccgacccucugggggggc

SEQ ID NO: 51944 - RNA, 21 nt, Artificial Sequence
  Synthetic
cccccgacccucugggggggc

SEQ ID NO: 51945 - RNA, 22 nt, Artificial Sequence
  Synthetic
ccccccgacccucugggggggc

SEQ ID NO: 51946 - RNA, 23 nt, Artificial Sequence
  Synthetic
gccccccgacccucugggggggc

SEQ ID NO: 51947 - RNA, 24 nt, Artificial Sequence
  Synthetic
cgccccccgacccucugggggggc

SEQ ID NO: 51948 - RNA, 18 nt, Artificial Sequence
  Synthetic
uggucgcgggcggugggc

SEQ ID NO: 51949 - RNA, 19 nt, Artificial Sequence
  Synthetic
guggucgcgggcggugggc

SEQ ID NO: 51950 - RNA, 20 nt, Artificial Sequence
  Synthetic
gguggucgcgggcggugggc

SEQ ID NO: 51951 - RNA, 21 nt, Artificial Sequence
  Synthetic
ggguggucgcgggcggugggc

SEQ ID NO: 51952 - RNA, 22 nt, Artificial Sequence
  Synthetic
gggguggucgcgggcggugggc

SEQ ID NO: 51953 - RNA, 23 nt, Artificial Sequence
  Synthetic
ggggguggucgcgggcggugggc

SEQ ID NO: 51954 - RNA, 24 nt, Artificial Sequence
  Synthetic
uggggguggucgcgggcggugggc

SEQ ID NO: 51955 - RNA, 18 nt, Artificial Sequence
  Synthetic
cgccgccccccgacccuc

SEQ ID NO: 51956 - RNA, 19 nt, Artificial Sequence
  Synthetic
gcgccgccccccgacccuc

SEQ ID NO: 51957 - RNA, 20 nt, Artificial Sequence
  Synthetic
ugcgccgccccccgacccuc

SEQ ID NO: 51958 - RNA, 21 nt, Artificial Sequence
  Synthetic
gugcgccgccccccgacccuc

SEQ ID NO: 51959 - RNA, 22 nt, Artificial Sequence
  Synthetic
cgugcgccgccccccgacccuc

SEQ ID NO: 51960 - RNA, 23 nt, Artificial Sequence
  Synthetic
ccgugcgccgccccccgacccuc

SEQ ID NO: 51961 - RNA, 24 nt, Artificial Sequence
  Synthetic
gccgugcgccgccccccgacccuc

SEQ ID NO: 51962 - RNA, 18 nt, Artificial Sequence
  Synthetic
ccggcccggcacgagcuc

SEQ ID NO: 51963 - RNA, 19 nt, Artificial Sequence
  Synthetic
cccggcccggcacgagcuc

SEQ ID NO: 51964 - RNA, 20 nt, Artificial Sequence
  Synthetic
ccccggcccggcacgagcuc

SEQ ID NO: 51965 - RNA, 21 nt, Artificial Sequence
  Synthetic
accccggcccggcacgagcuc

SEQ ID NO: 51966 - RNA, 22 nt, Artificial Sequence
  Synthetic
aaccccggcccggcacgagcuc

SEQ ID NO: 51967 - RNA, 23 nt, Artificial Sequence
  Synthetic
gaaccccggcccggcacgagcuc

SEQ ID NO: 51968 - RNA, 24 nt, Artificial Sequence
  Synthetic
ggaaccccggcccggcacgagcuc

SEQ ID NO: 51969 - RNA, 18 nt, Artificial Sequence
  Synthetic
gucgcgggcggugggcuc

SEQ ID NO: 51970 - RNA, 19 nt, Artificial Sequence
  Synthetic
ggucgcgggcggugggcuc

SEQ ID NO: 51971 - RNA, 20 nt, Artificial Sequence
  Synthetic
uggucgcgggcggugggcuc

SEQ ID NO: 51972 - RNA, 21 nt, Artificial Sequence
  Synthetic
guggucgcgggcggugggcuc

SEQ ID NO: 51973 - RNA, 22 nt, Artificial Sequence
  Synthetic
gguggucgcgggcggugggcuc

SEQ ID NO: 51974 - RNA, 23 nt, Artificial Sequence
  Synthetic
ggguggucgcgggcggugggcuc

SEQ ID NO: 51975 - RNA, 24 nt, Artificial Sequence
  Synthetic
gggguggucgcgggcggugggcuc

SEQ ID NO: 51976 - RNA, 18 nt, Artificial Sequence
  Synthetic
cggcccgcuuaagcgguc

SEQ ID NO: 51977 - RNA, 19 nt, Artificial Sequence
  Synthetic
ccggcccgcuuaagcgguc

SEQ ID NO: 51978 - RNA, 20 nt, Artificial Sequence
  Synthetic
cccggcccgcuuaagcgguc

SEQ ID NO: 51979 - RNA, 21 nt, Artificial Sequence
  Synthetic
ccccggcccgcuuaagcgguc

SEQ ID NO: 51980 - RNA, 22 nt, Artificial Sequence
  Synthetic
cccccggcccgcuuaagcgguc

SEQ ID NO: 51981 - RNA, 23 nt, Artificial Sequence
  Synthetic
acccccggcccgcuuaagcgguc

SEQ ID NO: 51982 - RNA, 24 nt, Artificial Sequence
  Synthetic
gacccccggcccgcuuaagcgguc

SEQ ID NO: 51983 - RNA, 18 nt, Artificial Sequence
  Synthetic
ugcggguugggggugguc

SEQ ID NO: 51984 - RNA, 19 nt, Artificial Sequence
  Synthetic
cugcggguugggggugguc

SEQ ID NO: 51985 - RNA, 20 nt, Artificial Sequence
  Synthetic
gcugcggguugggggugguc

SEQ ID NO: 51986 - RNA, 21 nt, Artificial Sequence
  Synthetic
ggcugcggguugggggugguc

SEQ ID NO: 51987 - RNA, 22 nt, Artificial Sequence
  Synthetic
cggcugcggguugggggugguc

SEQ ID NO: 51988 - RNA, 23 nt, Artificial Sequence
  Synthetic
ccggcugcggguugggggugguc

SEQ ID NO: 51989 - RNA, 24 nt, Artificial Sequence
  Synthetic
cccggcugcggguugggggugguc

SEQ ID NO: 51990 - RNA, 18 nt, Artificial Sequence
  Synthetic
cgcaugcuaaugggguuc

SEQ ID NO: 51991 - RNA, 19 nt, Artificial Sequence
  Synthetic
gcgcaugcuaaugggguuc

SEQ ID NO: 51992 - RNA, 20 nt, Artificial Sequence
  Synthetic
ggcgcaugcuaaugggguuc

SEQ ID NO: 51993 - RNA, 21 nt, Artificial Sequence
  Synthetic
cggcgcaugcuaaugggguuc

SEQ ID NO: 51994 - RNA, 22 nt, Artificial Sequence
  Synthetic
gcggcgcaugcuaaugggguuc

SEQ ID NO: 51995 - RNA, 23 nt, Artificial Sequence
  Synthetic
ggcggcgcaugcuaaugggguuc

SEQ ID NO: 51996 - RNA, 24 nt, Artificial Sequence
  Synthetic
gggcggcgcaugcuaaugggguuc

SEQ ID NO: 51997 - RNA, 18 nt, Artificial Sequence
  Synthetic
cccgagagcgggggacag

SEQ ID NO: 51998 - RNA, 19 nt, Artificial Sequence
  Synthetic
gcccgagagcgggggacag

SEQ ID NO: 51999 - RNA, 20 nt, Artificial Sequence
  Synthetic
agcccgagagcgggggacag

SEQ ID NO: 52000 - RNA, 21 nt, Artificial Sequence
  Synthetic
gagcccgagagcgggggacag

SEQ ID NO: 52001 - RNA, 22 nt, Artificial Sequence
  Synthetic
ggagcccgagagcgggggacag

SEQ ID NO: 52002 - RNA, 23 nt, Artificial Sequence
  Synthetic
aggagcccgagagcgggggacag

SEQ ID NO: 52003 - RNA, 24 nt, Artificial Sequence
  Synthetic
gaggagcccgagagcgggggacag

SEQ ID NO: 52004 - RNA, 18 nt, Artificial Sequence
  Synthetic
acggggccgccccgagag

SEQ ID NO: 52005 - RNA, 19 nt, Artificial Sequence
  Synthetic
gacggggccgccccgagag

SEQ ID NO: 52006 - RNA, 20 nt, Artificial Sequence
  Synthetic
ggacggggccgccccgagag

SEQ ID NO: 52007 - RNA, 21 nt, Artificial Sequence
  Synthetic
gggacggggccgccccgagag

SEQ ID NO: 52008 - RNA, 22 nt, Artificial Sequence
  Synthetic
ggggacggggccgccccgagag

SEQ ID NO: 52009 - RNA, 23 nt, Artificial Sequence
  Synthetic
cggggacggggccgccccgagag

SEQ ID NO: 52010 - RNA, 24 nt, Artificial Sequence
  Synthetic
ccggggacggggccgccccgagag

SEQ ID NO: 52011 - RNA, 18 nt, Artificial Sequence
  Synthetic
cagggaggagcccgagag

SEQ ID NO: 52012 - RNA, 19 nt, Artificial Sequence
  Synthetic
gcagggaggagcccgagag

SEQ ID NO: 52013 - RNA, 20 nt, Artificial Sequence
  Synthetic
ggcagggaggagcccgagag

SEQ ID NO: 52014 - RNA, 21 nt, Artificial Sequence
  Synthetic
aggcagggaggagcccgagag

SEQ ID NO: 52015 - RNA, 22 nt, Artificial Sequence
  Synthetic
gaggcagggaggagcccgagag

SEQ ID NO: 52016 - RNA, 23 nt, Artificial Sequence
  Synthetic
ggaggcagggaggagcccgagag

SEQ ID NO: 52017 - RNA, 24 nt, Artificial Sequence
  Synthetic
gggaggcagggaggagcccgagag

SEQ ID NO: 52018 - RNA, 18 nt, Artificial Sequence
  Synthetic
ggacggggccgccccgag

SEQ ID NO: 52019 - RNA, 19 nt, Artificial Sequence
  Synthetic
gggacggggccgccccgag

SEQ ID NO: 52020 - RNA, 20 nt, Artificial Sequence
  Synthetic
ggggacggggccgccccgag

SEQ ID NO: 52021 - RNA, 21 nt, Artificial Sequence
  Synthetic
cggggacggggccgccccgag

SEQ ID NO: 52022 - RNA, 22 nt, Artificial Sequence
  Synthetic
ccggggacggggccgccccgag

SEQ ID NO: 52023 - RNA, 23 nt, Artificial Sequence
  Synthetic
cccggggacggggccgccccgag

SEQ ID NO: 52024 - RNA, 24 nt, Artificial Sequence
  Synthetic
ccccggggacggggccgccccgag

SEQ ID NO: 52025 - RNA, 18 nt, Artificial Sequence
  Synthetic
gcggcggcccggcgggag

SEQ ID NO: 52026 - RNA, 19 nt, Artificial Sequence
  Synthetic
agcggcggcccggcgggag

SEQ ID NO: 52027 - RNA, 20 nt, Artificial Sequence
  Synthetic
gagcggcggcccggcgggag

SEQ ID NO: 52028 - RNA, 21 nt, Artificial Sequence
  Synthetic
ggagcggcggcccggcgggag

SEQ ID NO: 52029 - RNA, 22 nt, Artificial Sequence
  Synthetic
cggagcggcggcccggcgggag

SEQ ID NO: 52030 - RNA, 23 nt, Artificial Sequence
  Synthetic
acggagcggcggcccggcgggag

SEQ ID NO: 52031 - RNA, 24 nt, Artificial Sequence
  Synthetic
gacggagcggcggcccggcgggag

SEQ ID NO: 52032 - RNA, 18 nt, Artificial Sequence
  Synthetic
cgggggacagggggggag

SEQ ID NO: 52033 - RNA, 19 nt, Artificial Sequence
  Synthetic
gcgggggacagggggggag

SEQ ID NO: 52034 - RNA, 20 nt, Artificial Sequence
  Synthetic
agcgggggacagggggggag

SEQ ID NO: 52035 - RNA, 21 nt, Artificial Sequence
  Synthetic
gagcgggggacagggggggag

SEQ ID NO: 52036 - RNA, 22 nt, Artificial Sequence
  Synthetic
agagcgggggacagggggggag

SEQ ID NO: 52037 - RNA, 23 nt, Artificial Sequence
  Synthetic
gagagcgggggacagggggggag

SEQ ID NO: 52038 - RNA, 24 nt, Artificial Sequence
  Synthetic
cgagagcgggggacagggggggag

SEQ ID NO: 52039 - RNA, 18 nt, Artificial Sequence
  Synthetic
cuuucuuggcagaacacg

SEQ ID NO: 52040 - RNA, 19 nt, Artificial Sequence
  Synthetic
acuuucuuggcagaacacg

SEQ ID NO: 52041 - RNA, 20 nt, Artificial Sequence
  Synthetic
uacuuucuuggcagaacacg

SEQ ID NO: 52042 - RNA, 21 nt, Artificial Sequence
  Synthetic
uuacuuucuuggcagaacacg

SEQ ID NO: 52043 - RNA, 22 nt, Artificial Sequence
  Synthetic
auuacuuucuuggcagaacacg

SEQ ID NO: 52044 - RNA, 23 nt, Artificial Sequence
  Synthetic
gauuacuuucuuggcagaacacg

SEQ ID NO: 52045 - RNA, 24 nt, Artificial Sequence
  Synthetic
ugauuacuuucuuggcagaacacg

SEQ ID NO: 52046 - RNA, 18 nt, Artificial Sequence
  Synthetic
gggugagggagggacacg

SEQ ID NO: 52047 - RNA, 19 nt, Artificial Sequence
  Synthetic
ggggugagggagggacacg

SEQ ID NO: 52048 - RNA, 20 nt, Artificial Sequence
  Synthetic
cggggugagggagggacacg

SEQ ID NO: 52049 - RNA, 21 nt, Artificial Sequence
  Synthetic
ccggggugagggagggacacg

SEQ ID NO: 52050 - RNA, 22 nt, Artificial Sequence
  Synthetic
gccggggugagggagggacacg

SEQ ID NO: 52051 - RNA, 23 nt, Artificial Sequence
  Synthetic
ggccggggugagggagggacacg

SEQ ID NO: 52052 - RNA, 24 nt, Artificial Sequence
  Synthetic
gggccggggugagggagggacacg

SEQ ID NO: 52053 - RNA, 18 nt, Artificial Sequence
  Synthetic
cggcagacccccggcacg

SEQ ID NO: 52054 - RNA, 19 nt, Artificial Sequence
  Synthetic
gcggcagacccccggcacg

SEQ ID NO: 52055 - RNA, 20 nt, Artificial Sequence
  Synthetic
cgcggcagacccccggcacg

SEQ ID NO: 52056 - RNA, 21 nt, Artificial Sequence
  Synthetic
ccgcggcagacccccggcacg

SEQ ID NO: 52057 - RNA, 22 nt, Artificial Sequence
  Synthetic
gccgcggcagacccccggcacg

SEQ ID NO: 52058 - RNA, 23 nt, Artificial Sequence
  Synthetic
cgccgcggcagacccccggcacg

SEQ ID NO: 52059 - RNA, 24 nt, Artificial Sequence
  Synthetic
ccgccgcggcagacccccggcacg

SEQ ID NO: 52060 - RNA, 18 nt, Artificial Sequence
  Synthetic
gcgggaggaggagacccg

SEQ ID NO: 52061 - RNA, 19 nt, Artificial Sequence
  Synthetic
ggcgggaggaggagacccg

SEQ ID NO: 52062 - RNA, 20 nt, Artificial Sequence
  Synthetic
cggcgggaggaggagacccg

SEQ ID NO: 52063 - RNA, 21 nt, Artificial Sequence
  Synthetic
ccggcgggaggaggagacccg

SEQ ID NO: 52064 - RNA, 22 nt, Artificial Sequence
  Synthetic
cccggcgggaggaggagacccg

SEQ ID NO: 52065 - RNA, 23 nt, Artificial Sequence
  Synthetic
gcccggcgggaggaggagacccg

SEQ ID NO: 52066 - RNA, 24 nt, Artificial Sequence
  Synthetic
ggcccggcgggaggaggagacccg

SEQ ID NO: 52067 - RNA, 18 nt, Artificial Sequence
  Synthetic
ucccucccuccgcccccg

SEQ ID NO: 52068 - RNA, 19 nt, Artificial Sequence
  Synthetic
uucccucccuccgcccccg

SEQ ID NO: 52069 - RNA, 20 nt, Artificial Sequence
  Synthetic
auucccucccuccgcccccg

SEQ ID NO: 52070 - RNA, 21 nt, Artificial Sequence
  Synthetic
gauucccucccuccgcccccg

SEQ ID NO: 52071 - RNA, 22 nt, Artificial Sequence
  Synthetic
ggauucccucccuccgcccccg

SEQ ID NO: 52072 - RNA, 23 nt, Artificial Sequence
  Synthetic
gggauucccucccuccgcccccg

SEQ ID NO: 52073 - RNA, 24 nt, Artificial Sequence
  Synthetic
ggggauucccucccuccgcccccg

SEQ ID NO: 52074 - RNA, 18 nt, Artificial Sequence
  Synthetic
cgacggagcggcggcccg

SEQ ID NO: 52075 - RNA, 19 nt, Artificial Sequence
  Synthetic
gcgacggagcggcggcccg

SEQ ID NO: 52076 - RNA, 20 nt, Artificial Sequence
  Synthetic
agcgacggagcggcggcccg

SEQ ID NO: 52077 - RNA, 21 nt, Artificial Sequence
  Synthetic
gagcgacggagcggcggcccg

SEQ ID NO: 52078 - RNA, 22 nt, Artificial Sequence
  Synthetic
cgagcgacggagcggcggcccg

SEQ ID NO: 52079 - RNA, 23 nt, Artificial Sequence
  Synthetic
gcgagcgacggagcggcggcccg

SEQ ID NO: 52080 - RNA, 24 nt, Artificial Sequence
  Synthetic
ugcgagcgacggagcggcggcccg

SEQ ID NO: 52081 - RNA, 18 nt, Artificial Sequence
  Synthetic
ccacucagggccgcgccg

SEQ ID NO: 52082 - RNA, 19 nt, Artificial Sequence
  Synthetic
accacucagggccgcgccg

SEQ ID NO: 52083 - RNA, 20 nt, Artificial Sequence
  Synthetic
caccacucagggccgcgccg

SEQ ID NO: 52084 - RNA, 21 nt, Artificial Sequence
  Synthetic
gcaccacucagggccgcgccg

SEQ ID NO: 52085 - RNA, 22 nt, Artificial Sequence
  Synthetic
ggcaccacucagggccgcgccg

SEQ ID NO: 52086 - RNA, 23 nt, Artificial Sequence
  Synthetic
gggcaccacucagggccgcgccg

SEQ ID NO: 52087 - RNA, 24 nt, Artificial Sequence
  Synthetic
cgggcaccacucagggccgcgccg

SEQ ID NO: 52088 - RNA, 18 nt, Artificial Sequence
  Synthetic
cgcgccggcggggcgccg

SEQ ID NO: 52089 - RNA, 19 nt, Artificial Sequence
  Synthetic
ccgcgccggcggggcgccg

SEQ ID NO: 52090 - RNA, 20 nt, Artificial Sequence
  Synthetic
gccgcgccggcggggcgccg

SEQ ID NO: 52091 - RNA, 21 nt, Artificial Sequence
  Synthetic
ggccgcgccggcggggcgccg

SEQ ID NO: 52092 - RNA, 22 nt, Artificial Sequence
  Synthetic
gggccgcgccggcggggcgccg

SEQ ID NO: 52093 - RNA, 23 nt, Artificial Sequence
  Synthetic
agggccgcgccggcggggcgccg

SEQ ID NO: 52094 - RNA, 24 nt, Artificial Sequence
  Synthetic
cagggccgcgccggcggggcgccg

SEQ ID NO: 52095 - RNA, 18 nt, Artificial Sequence
  Synthetic
gggaggagcccgagagcg

SEQ ID NO: 52096 - RNA, 19 nt, Artificial Sequence
  Synthetic
agggaggagcccgagagcg

SEQ ID NO: 52097 - RNA, 20 nt, Artificial Sequence
  Synthetic
cagggaggagcccgagagcg

SEQ ID NO: 52098 - RNA, 21 nt, Artificial Sequence
  Synthetic
gcagggaggagcccgagagcg

SEQ ID NO: 52099 - RNA, 22 nt, Artificial Sequence
  Synthetic
ggcagggaggagcccgagagcg

SEQ ID NO: 52100 - RNA, 23 nt, Artificial Sequence
  Synthetic
aggcagggaggagcccgagagcg

SEQ ID NO: 52101 - RNA, 24 nt, Artificial Sequence
  Synthetic
gaggcagggaggagcccgagagcg

SEQ ID NO: 52102 - RNA, 18 nt, Artificial Sequence
  Synthetic
accccggcacugcgagcg

SEQ ID NO: 52103 - RNA, 19 nt, Artificial Sequence
  Synthetic
caccccggcacugcgagcg

SEQ ID NO: 52104 - RNA, 20 nt, Artificial Sequence
  Synthetic
gcaccccggcacugcgagcg

SEQ ID NO: 52105 - RNA, 21 nt, Artificial Sequence
  Synthetic
cgcaccccggcacugcgagcg

SEQ ID NO: 52106 - RNA, 22 nt, Artificial Sequence
  Synthetic
ucgcaccccggcacugcgagcg

SEQ ID NO: 52107 - RNA, 23 nt, Artificial Sequence
  Synthetic
uucgcaccccggcacugcgagcg

SEQ ID NO: 52108 - RNA, 24 nt, Artificial Sequence
  Synthetic
auucgcaccccggcacugcgagcg

SEQ ID NO: 52109 - RNA, 18 nt, Artificial Sequence
  Synthetic
gacacgggggacacggcg

SEQ ID NO: 52110 - RNA, 19 nt, Artificial Sequence
  Synthetic
ggacacgggggacacggcg

SEQ ID NO: 52111 - RNA, 20 nt, Artificial Sequence
  Synthetic
gggacacgggggacacggcg

SEQ ID NO: 52112 - RNA, 21 nt, Artificial Sequence
  Synthetic
agggacacgggggacacggcg

SEQ ID NO: 52113 - RNA, 22 nt, Artificial Sequence
  Synthetic
gagggacacgggggacacggcg

SEQ ID NO: 52114 - RNA, 23 nt, Artificial Sequence
  Synthetic
ggagggacacgggggacacggcg

SEQ ID NO: 52115 - RNA, 24 nt, Artificial Sequence
  Synthetic
gggagggacacgggggacacggcg

SEQ ID NO: 52116 - RNA, 18 nt, Artificial Sequence
  Synthetic
cucccaucugcgucggcg

SEQ ID NO: 52117 - RNA, 19 nt, Artificial Sequence
  Synthetic
acucccaucugcgucggcg

SEQ ID NO: 52118 - RNA, 20 nt, Artificial Sequence
  Synthetic
gacucccaucugcgucggcg

SEQ ID NO: 52119 - RNA, 21 nt, Artificial Sequence
  Synthetic
ggacucccaucugcgucggcg

SEQ ID NO: 52120 - RNA, 22 nt, Artificial Sequence
  Synthetic
gggacucccaucugcgucggcg

SEQ ID NO: 52121 - RNA, 23 nt, Artificial Sequence
  Synthetic
ggggacucccaucugcgucggcg

SEQ ID NO: 52122 - RNA, 24 nt, Artificial Sequence
  Synthetic
gggggacucccaucugcgucggcg

SEQ ID NO: 52123 - RNA, 18 nt, Artificial Sequence
  Synthetic
aacaaaaagcagcgggcg

SEQ ID NO: 52124 - RNA, 19 nt, Artificial Sequence
  Synthetic
gaacaaaaagcagcgggcg

SEQ ID NO: 52125 - RNA, 20 nt, Artificial Sequence
  Synthetic
cgaacaaaaagcagcgggcg

SEQ ID NO: 52126 - RNA, 21 nt, Artificial Sequence
  Synthetic
ccgaacaaaaagcagcgggcg

SEQ ID NO: 52127 - RNA, 22 nt, Artificial Sequence
  Synthetic
uccgaacaaaaagcagcgggcg

SEQ ID NO: 52128 - RNA, 23 nt, Artificial Sequence
  Synthetic
uuccgaacaaaaagcagcgggcg

SEQ ID NO: 52129 - RNA, 24 nt, Artificial Sequence
  Synthetic
cuuccgaacaaaaagcagcgggcg

SEQ ID NO: 52130 - RNA, 18 nt, Artificial Sequence
  Synthetic
uggggguggucgcgggcg

SEQ ID NO: 52131 - RNA, 19 nt, Artificial Sequence
  Synthetic
uuggggguggucgcgggcg

SEQ ID NO: 52132 - RNA, 20 nt, Artificial Sequence
  Synthetic
guuggggguggucgcgggcg

SEQ ID NO: 52133 - RNA, 21 nt, Artificial Sequence
  Synthetic
gguuggggguggucgcgggcg

SEQ ID NO: 52134 - RNA, 22 nt, Artificial Sequence
  Synthetic
ggguuggggguggucgcgggcg

SEQ ID NO: 52135 - RNA, 23 nt, Artificial Sequence
  Synthetic
cggguuggggguggucgcgggcg

SEQ ID NO: 52136 - RNA, 24 nt, Artificial Sequence
  Synthetic
gcggguuggggguggucgcgggcg

SEQ ID NO: 52137 - RNA, 18 nt, Artificial Sequence
  Synthetic
ggccgcgccggcggggcg

SEQ ID NO: 52138 - RNA, 19 nt, Artificial Sequence
  Synthetic
gggccgcgccggcggggcg

SEQ ID NO: 52139 - RNA, 20 nt, Artificial Sequence
  Synthetic
agggccgcgccggcggggcg

SEQ ID NO: 52140 - RNA, 21 nt, Artificial Sequence
  Synthetic
cagggccgcgccggcggggcg

SEQ ID NO: 52141 - RNA, 22 nt, Artificial Sequence
  Synthetic
ucagggccgcgccggcggggcg

SEQ ID NO: 52142 - RNA, 23 nt, Artificial Sequence
  Synthetic
cucagggccgcgccggcggggcg

SEQ ID NO: 52143 - RNA, 24 nt, Artificial Sequence
  Synthetic
acucagggccgcgccggcggggcg

SEQ ID NO: 52144 - RNA, 18 nt, Artificial Sequence
  Synthetic
cgacccucugggggggcg

SEQ ID NO: 52145 - RNA, 19 nt, Artificial Sequence
  Synthetic
ccgacccucugggggggcg

SEQ ID NO: 52146 - RNA, 20 nt, Artificial Sequence
  Synthetic
cccgacccucugggggggcg

SEQ ID NO: 52147 - RNA, 21 nt, Artificial Sequence
  Synthetic
ccccgacccucugggggggcg

SEQ ID NO: 52148 - RNA, 22 nt, Artificial Sequence
  Synthetic
cccccgacccucugggggggcg

SEQ ID NO: 52149 - RNA, 23 nt, Artificial Sequence
  Synthetic
ccccccgacccucugggggggcg

SEQ ID NO: 52150 - RNA, 24 nt, Artificial Sequence
  Synthetic
gccccccgacccucugggggggcg

SEQ ID NO: 52151 - RNA, 18 nt, Artificial Sequence
  Synthetic
ggacucccaucugcgucg

SEQ ID NO: 52152 - RNA, 19 nt, Artificial Sequence
  Synthetic
gggacucccaucugcgucg

SEQ ID NO: 52153 - RNA, 20 nt, Artificial Sequence
  Synthetic
ggggacucccaucugcgucg

SEQ ID NO: 52154 - RNA, 21 nt, Artificial Sequence
  Synthetic
gggggacucccaucugcgucg

SEQ ID NO: 52155 - RNA, 22 nt, Artificial Sequence
  Synthetic
ggggggacucccaucugcgucg

SEQ ID NO: 52156 - RNA, 23 nt, Artificial Sequence
  Synthetic
cggggggacucccaucugcgucg

SEQ ID NO: 52157 - RNA, 24 nt, Artificial Sequence
  Synthetic
ccggggggacucccaucugcgucg

SEQ ID NO: 52158 - RNA, 18 nt, Artificial Sequence
  Synthetic
ggcccgcuuaagcggucg

SEQ ID NO: 52159 - RNA, 19 nt, Artificial Sequence
  Synthetic
cggcccgcuuaagcggucg

SEQ ID NO: 52160 - RNA, 20 nt, Artificial Sequence
  Synthetic
ccggcccgcuuaagcggucg

SEQ ID NO: 52161 - RNA, 21 nt, Artificial Sequence
  Synthetic
cccggcccgcuuaagcggucg

SEQ ID NO: 52162 - RNA, 22 nt, Artificial Sequence
  Synthetic
ccccggcccgcuuaagcggucg

SEQ ID NO: 52163 - RNA, 23 nt, Artificial Sequence
  Synthetic
cccccggcccgcuuaagcggucg

SEQ ID NO: 52164 - RNA, 24 nt, Artificial Sequence
  Synthetic
acccccggcccgcuuaagcggucg

SEQ ID NO: 52165 - RNA, 18 nt, Artificial Sequence
  Synthetic
ccgagagcgggggacagg

SEQ ID NO: 52166 - RNA, 19 nt, Artificial Sequence
  Synthetic
cccgagagcgggggacagg

SEQ ID NO: 52167 - RNA, 20 nt, Artificial Sequence
  Synthetic
gcccgagagcgggggacagg

SEQ ID NO: 52168 - RNA, 21 nt, Artificial Sequence
  Synthetic
agcccgagagcgggggacagg

SEQ ID NO: 52169 - RNA, 22 nt, Artificial Sequence
  Synthetic
gagcccgagagcgggggacagg

SEQ ID NO: 52170 - RNA, 23 nt, Artificial Sequence
  Synthetic
ggagcccgagagcgggggacagg

SEQ ID NO: 52171 - RNA, 24 nt, Artificial Sequence
  Synthetic
aggagcccgagagcgggggacagg

SEQ ID NO: 52172 - RNA, 18 nt, Artificial Sequence
  Synthetic
gggggcgagggaggcagg

SEQ ID NO: 52173 - RNA, 19 nt, Artificial Sequence
  Synthetic
ggggggcgagggaggcagg

SEQ ID NO: 52174 - RNA, 20 nt, Artificial Sequence
  Synthetic
gggggggcgagggaggcagg

SEQ ID NO: 52175 - RNA, 21 nt, Artificial Sequence
  Synthetic
ugggggggcgagggaggcagg

SEQ ID NO: 52176 - RNA, 22 nt, Artificial Sequence
  Synthetic
cugggggggcgagggaggcagg

SEQ ID NO: 52177 - RNA, 23 nt, Artificial Sequence
  Synthetic
ucugggggggcgagggaggcagg

SEQ ID NO: 52178 - RNA, 24 nt, Artificial Sequence
  Synthetic
cucugggggggcgagggaggcagg

SEQ ID NO: 52179 - RNA, 18 nt, Artificial Sequence
  Synthetic
cggggccgccccgagagg

SEQ ID NO: 52180 - RNA, 19 nt, Artificial Sequence
  Synthetic
acggggccgccccgagagg

SEQ ID NO: 52181 - RNA, 20 nt, Artificial Sequence
  Synthetic
gacggggccgccccgagagg

SEQ ID NO: 52182 - RNA, 21 nt, Artificial Sequence
  Synthetic
ggacggggccgccccgagagg

SEQ ID NO: 52183 - RNA, 22 nt, Artificial Sequence
  Synthetic
gggacggggccgccccgagagg

SEQ ID NO: 52184 - RNA, 23 nt, Artificial Sequence
  Synthetic
ggggacggggccgccccgagagg

SEQ ID NO: 52185 - RNA, 24 nt, Artificial Sequence
  Synthetic
cggggacggggccgccccgagagg

SEQ ID NO: 52186 - RNA, 18 nt, Artificial Sequence
  Synthetic
cugggggggcgagggagg

SEQ ID NO: 52187 - RNA, 19 nt, Artificial Sequence
  Synthetic
ucugggggggcgagggagg

SEQ ID NO: 52188 - RNA, 20 nt, Artificial Sequence
  Synthetic
cucugggggggcgagggagg

SEQ ID NO: 52189 - RNA, 21 nt, Artificial Sequence
  Synthetic
ccucugggggggcgagggagg

SEQ ID NO: 52190 - RNA, 22 nt, Artificial Sequence
  Synthetic
cccucugggggggcgagggagg

SEQ ID NO: 52191 - RNA, 23 nt, Artificial Sequence
  Synthetic
acccucugggggggcgagggagg

SEQ ID NO: 52192 - RNA, 24 nt, Artificial Sequence
  Synthetic
gacccucugggggggcgagggagg

SEQ ID NO: 52193 - RNA, 18 nt, Artificial Sequence
  Synthetic
cggcggcccggcgggagg

SEQ ID NO: 52194 - RNA, 19 nt, Artificial Sequence
  Synthetic
gcggcggcccggcgggagg

SEQ ID NO: 52195 - RNA, 20 nt, Artificial Sequence
  Synthetic
agcggcggcccggcgggagg

SEQ ID NO: 52196 - RNA, 21 nt, Artificial Sequence
  Synthetic
gagcggcggcccggcgggagg

SEQ ID NO: 52197 - RNA, 22 nt, Artificial Sequence
  Synthetic
ggagcggcggcccggcgggagg

SEQ ID NO: 52198 - RNA, 23 nt, Artificial Sequence
  Synthetic
cggagcggcggcccggcgggagg

SEQ ID NO: 52199 - RNA, 24 nt, Artificial Sequence
  Synthetic
acggagcggcggcccggcgggagg

SEQ ID NO: 52200 - RNA, 18 nt, Artificial Sequence
  Synthetic
cggggggccggggugagg

SEQ ID NO: 52201 - RNA, 19 nt, Artificial Sequence
  Synthetic
gcggggggccggggugagg

SEQ ID NO: 52202 - RNA, 20 nt, Artificial Sequence
  Synthetic
ggcggggggccggggugagg

SEQ ID NO: 52203 - RNA, 21 nt, Artificial Sequence
  Synthetic
gggcggggggccggggugagg

SEQ ID NO: 52204 - RNA, 22 nt, Artificial Sequence
  Synthetic
cgggcggggggccggggugagg

SEQ ID NO: 52205 - RNA, 23 nt, Artificial Sequence
  Synthetic
gcgggcggggggccggggugagg

SEQ ID NO: 52206 - RNA, 24 nt, Artificial Sequence
  Synthetic
agcgggcggggggccggggugagg

SEQ ID NO: 52207 - RNA, 18 nt, Artificial Sequence
  Synthetic
ggcagccccgugugacgg

SEQ ID NO: 52208 - RNA, 19 nt, Artificial Sequence
  Synthetic
aggcagccccgugugacgg

SEQ ID NO: 52209 - RNA, 20 nt, Artificial Sequence
  Synthetic
aaggcagccccgugugacgg

SEQ ID NO: 52210 - RNA, 21 nt, Artificial Sequence
  Synthetic
uaaggcagccccgugugacgg

SEQ ID NO: 52211 - RNA, 22 nt, Artificial Sequence
  Synthetic
auaaggcagccccgugugacgg

SEQ ID NO: 52212 - RNA, 23 nt, Artificial Sequence
  Synthetic
uauaaggcagccccgugugacgg

SEQ ID NO: 52213 - RNA, 24 nt, Artificial Sequence
  Synthetic
guauaaggcagccccgugugacgg

SEQ ID NO: 52214 - RNA, 18 nt, Artificial Sequence
  Synthetic
gacggagcggcggcccgg

SEQ ID NO: 52215 - RNA, 19 nt, Artificial Sequence
  Synthetic
cgacggagcggcggcccgg

SEQ ID NO: 52216 - RNA, 20 nt, Artificial Sequence
  Synthetic
gcgacggagcggcggcccgg

SEQ ID NO: 52217 - RNA, 21 nt, Artificial Sequence
  Synthetic
agcgacggagcggcggcccgg

SEQ ID NO: 52218 - RNA, 22 nt, Artificial Sequence
  Synthetic
gagcgacggagcggcggcccgg

SEQ ID NO: 52219 - RNA, 23 nt, Artificial Sequence
  Synthetic
cgagcgacggagcggcggcccgg

SEQ ID NO: 52220 - RNA, 24 nt, Artificial Sequence
  Synthetic
gcgagcgacggagcggcggcccgg

SEQ ID NO: 52221 - RNA, 18 nt, Artificial Sequence
  Synthetic
cccggcacgagcucccgg

SEQ ID NO: 52222 - RNA, 19 nt, Artificial Sequence
  Synthetic
gcccggcacgagcucccgg

SEQ ID NO: 52223 - RNA, 20 nt, Artificial Sequence
  Synthetic
ggcccggcacgagcucccgg

SEQ ID NO: 52224 - RNA, 21 nt, Artificial Sequence
  Synthetic
cggcccggcacgagcucccgg

SEQ ID NO: 52225 - RNA, 22 nt, Artificial Sequence
  Synthetic
ccggcccggcacgagcucccgg

SEQ ID NO: 52226 - RNA, 23 nt, Artificial Sequence
  Synthetic
cccggcccggcacgagcucccgg

SEQ ID NO: 52227 - RNA, 24 nt, Artificial Sequence
  Synthetic
ccccggcccggcacgagcucccgg

SEQ ID NO: 52228 - RNA, 18 nt, Artificial Sequence
  Synthetic
cacucagggccgcgccgg

SEQ ID NO: 52229 - RNA, 19 nt, Artificial Sequence
  Synthetic
ccacucagggccgcgccgg

SEQ ID NO: 52230 - RNA, 20 nt, Artificial Sequence
  Synthetic
accacucagggccgcgccgg

SEQ ID NO: 52231 - RNA, 21 nt, Artificial Sequence
  Synthetic
caccacucagggccgcgccgg

SEQ ID NO: 52232 - RNA, 22 nt, Artificial Sequence
  Synthetic
gcaccacucagggccgcgccgg

SEQ ID NO: 52233 - RNA, 23 nt, Artificial Sequence
  Synthetic
ggcaccacucagggccgcgccgg

SEQ ID NO: 52234 - RNA, 24 nt, Artificial Sequence
  Synthetic
gggcaccacucagggccgcgccgg

SEQ ID NO: 52235 - RNA, 18 nt, Artificial Sequence
  Synthetic
gcgccggcggggcgccgg

SEQ ID NO: 52236 - RNA, 19 nt, Artificial Sequence
  Synthetic
cgcgccggcggggcgccgg

SEQ ID NO: 52237 - RNA, 20 nt, Artificial Sequence
  Synthetic
ccgcgccggcggggcgccgg

SEQ ID NO: 52238 - RNA, 21 nt, Artificial Sequence
  Synthetic
gccgcgccggcggggcgccgg

SEQ ID NO: 52239 - RNA, 22 nt, Artificial Sequence
  Synthetic
ggccgcgccggcggggcgccgg

SEQ ID NO: 52240 - RNA, 23 nt, Artificial Sequence
  Synthetic
gggccgcgccggcggggcgccgg

SEQ ID NO: 52241 - RNA, 24 nt, Artificial Sequence
  Synthetic
agggccgcgccggcggggcgccgg

SEQ ID NO: 52242 - RNA, 18 nt, Artificial Sequence
  Synthetic
cccggcccgcuuaagcgg

SEQ ID NO: 52243 - RNA, 19 nt, Artificial Sequence
  Synthetic
ccccggcccgcuuaagcgg

SEQ ID NO: 52244 - RNA, 20 nt, Artificial Sequence
  Synthetic
cccccggcccgcuuaagcgg

SEQ ID NO: 52245 - RNA, 21 nt, Artificial Sequence
  Synthetic
acccccggcccgcuuaagcgg

SEQ ID NO: 52246 - RNA, 22 nt, Artificial Sequence
  Synthetic
gacccccggcccgcuuaagcgg

SEQ ID NO: 52247 - RNA, 23 nt, Artificial Sequence
  Synthetic
cgacccccggcccgcuuaagcgg

SEQ ID NO: 52248 - RNA, 24 nt, Artificial Sequence
  Synthetic
ccgacccccggcccgcuuaagcgg

SEQ ID NO: 52249 - RNA, 18 nt, Artificial Sequence
  Synthetic
ccgaacaaaaagcagcgg

SEQ ID NO: 52250 - RNA, 19 nt, Artificial Sequence
  Synthetic
uccgaacaaaaagcagcgg

SEQ ID NO: 52251 - RNA, 20 nt, Artificial Sequence
  Synthetic
uuccgaacaaaaagcagcgg

SEQ ID NO: 52252 - RNA, 21 nt, Artificial Sequence
  Synthetic
cuuccgaacaaaaagcagcgg

SEQ ID NO: 52253 - RNA, 22 nt, Artificial Sequence
  Synthetic
ccuuccgaacaaaaagcagcgg

SEQ ID NO: 52254 - RNA, 23 nt, Artificial Sequence
  Synthetic
cccuuccgaacaaaaagcagcgg

SEQ ID NO: 52255 - RNA, 24 nt, Artificial Sequence
  Synthetic
ccccuuccgaacaaaaagcagcgg

SEQ ID NO: 52256 - RNA, 18 nt, Artificial Sequence
  Synthetic
ggagcggcggcccggcgg

SEQ ID NO: 52257 - RNA, 19 nt, Artificial Sequence
  Synthetic
cggagcggcggcccggcgg

SEQ ID NO: 52258 - RNA, 20 nt, Artificial Sequence
  Synthetic
acggagcggcggcccggcgg

SEQ ID NO: 52259 - RNA, 21 nt, Artificial Sequence
  Synthetic
gacggagcggcggcccggcgg

SEQ ID NO: 52260 - RNA, 22 nt, Artificial Sequence
  Synthetic
cgacggagcggcggcccggcgg

SEQ ID NO: 52261 - RNA, 23 nt, Artificial Sequence
  Synthetic
gcgacggagcggcggcccggcgg

SEQ ID NO: 52262 - RNA, 24 nt, Artificial Sequence
  Synthetic
agcgacggagcggcggcccggcgg

SEQ ID NO: 52263 - RNA, 18 nt, Artificial Sequence
  Synthetic
gacucccaucugcgucgg

SEQ ID NO: 52264 - RNA, 19 nt, Artificial Sequence
  Synthetic
ggacucccaucugcgucgg

SEQ ID NO: 52265 - RNA, 20 nt, Artificial Sequence
  Synthetic
gggacucccaucugcgucgg

SEQ ID NO: 52266 - RNA, 21 nt, Artificial Sequence
  Synthetic
ggggacucccaucugcgucgg

SEQ ID NO: 52267 - RNA, 22 nt, Artificial Sequence
  Synthetic
gggggacucccaucugcgucgg

SEQ ID NO: 52268 - RNA, 23 nt, Artificial Sequence
  Synthetic
ggggggacucccaucugcgucgg

SEQ ID NO: 52269 - RNA, 24 nt, Artificial Sequence
  Synthetic
cggggggacucccaucugcgucgg

SEQ ID NO: 52270 - RNA, 18 nt, Artificial Sequence
  Synthetic
cgagagcgggggacaggg

SEQ ID NO: 52271 - RNA, 19 nt, Artificial Sequence
  Synthetic
ccgagagcgggggacaggg

SEQ ID NO: 52272 - RNA, 20 nt, Artificial Sequence
  Synthetic
cccgagagcgggggacaggg

SEQ ID NO: 52273 - RNA, 21 nt, Artificial Sequence
  Synthetic
gcccgagagcgggggacaggg

SEQ ID NO: 52274 - RNA, 22 nt, Artificial Sequence
  Synthetic
agcccgagagcgggggacaggg

SEQ ID NO: 52275 - RNA, 23 nt, Artificial Sequence
  Synthetic
gagcccgagagcgggggacaggg

SEQ ID NO: 52276 - RNA, 24 nt, Artificial Sequence
  Synthetic
ggagcccgagagcgggggacaggg

SEQ ID NO: 52277 - RNA, 18 nt, Artificial Sequence
  Synthetic
ggggcgagggaggcaggg

SEQ ID NO: 52278 - RNA, 19 nt, Artificial Sequence
  Synthetic
gggggcgagggaggcaggg

SEQ ID NO: 52279 - RNA, 20 nt, Artificial Sequence
  Synthetic
ggggggcgagggaggcaggg

SEQ ID NO: 52280 - RNA, 21 nt, Artificial Sequence
  Synthetic
gggggggcgagggaggcaggg

SEQ ID NO: 52281 - RNA, 22 nt, Artificial Sequence
  Synthetic
ugggggggcgagggaggcaggg

SEQ ID NO: 52282 - RNA, 23 nt, Artificial Sequence
  Synthetic
cugggggggcgagggaggcaggg

SEQ ID NO: 52283 - RNA, 24 nt, Artificial Sequence
  Synthetic
ucugggggggcgagggaggcaggg

SEQ ID NO: 52284 - RNA, 18 nt, Artificial Sequence
  Synthetic
ggggggccggggugaggg

SEQ ID NO: 52285 - RNA, 19 nt, Artificial Sequence
  Synthetic
cggggggccggggugaggg

SEQ ID NO: 52286 - RNA, 20 nt, Artificial Sequence
  Synthetic
gcggggggccggggugaggg

SEQ ID NO: 52287 - RNA, 21 nt, Artificial Sequence
  Synthetic
ggcggggggccggggugaggg

SEQ ID NO: 52288 - RNA, 22 nt, Artificial Sequence
  Synthetic
gggcggggggccggggugaggg

SEQ ID NO: 52289 - RNA, 23 nt, Artificial Sequence
  Synthetic
cgggcggggggccggggugaggg

SEQ ID NO: 52290 - RNA, 24 nt, Artificial Sequence
  Synthetic
gcgggcggggggccggggugaggg

SEQ ID NO: 52291 - RNA, 18 nt, Artificial Sequence
  Synthetic
agcgggcggggggccggg

SEQ ID NO: 52292 - RNA, 19 nt, Artificial Sequence
  Synthetic
cagcgggcggggggccggg

SEQ ID NO: 52293 - RNA, 20 nt, Artificial Sequence
  Synthetic
gcagcgggcggggggccggg

SEQ ID NO: 52294 - RNA, 21 nt, Artificial Sequence
  Synthetic
agcagcgggcggggggccggg

SEQ ID NO: 52295 - RNA, 22 nt, Artificial Sequence
  Synthetic
aagcagcgggcggggggccggg

SEQ ID NO: 52296 - RNA, 23 nt, Artificial Sequence
  Synthetic
aaagcagcgggcggggggccggg

SEQ ID NO: 52297 - RNA, 24 nt, Artificial Sequence
  Synthetic
aaaagcagcgggcggggggccggg

SEQ ID NO: 52298 - RNA, 18 nt, Artificial Sequence
  Synthetic
cgaacaaaaagcagcggg

SEQ ID NO: 52299 - RNA, 19 nt, Artificial Sequence
  Synthetic
ccgaacaaaaagcagcggg

SEQ ID NO: 52300 - RNA, 20 nt, Artificial Sequence
  Synthetic
uccgaacaaaaagcagcggg

SEQ ID NO: 52301 - RNA, 21 nt, Artificial Sequence
  Synthetic
uuccgaacaaaaagcagcggg

SEQ ID NO: 52302 - RNA, 22 nt, Artificial Sequence
  Synthetic
cuuccgaacaaaaagcagcggg

SEQ ID NO: 52303 - RNA, 23 nt, Artificial Sequence
  Synthetic
ccuuccgaacaaaaagcagcggg

SEQ ID NO: 52304 - RNA, 24 nt, Artificial Sequence
  Synthetic
cccuuccgaacaaaaagcagcggg

SEQ ID NO: 52305 - RNA, 18 nt, Artificial Sequence
  Synthetic
gagcggcggcccggcggg

SEQ ID NO: 52306 - RNA, 19 nt, Artificial Sequence
  Synthetic
ggagcggcggcccggcggg

SEQ ID NO: 52307 - RNA, 20 nt, Artificial Sequence
  Synthetic
cggagcggcggcccggcggg

SEQ ID NO: 52308 - RNA, 21 nt, Artificial Sequence
  Synthetic
acggagcggcggcccggcggg

SEQ ID NO: 52309 - RNA, 22 nt, Artificial Sequence
  Synthetic
gacggagcggcggcccggcggg

SEQ ID NO: 52310 - RNA, 23 nt, Artificial Sequence
  Synthetic
cgacggagcggcggcccggcggg

SEQ ID NO: 52311 - RNA, 24 nt, Artificial Sequence
  Synthetic
gcgacggagcggcggcccggcggg

SEQ ID NO: 52312 - RNA, 18 nt, Artificial Sequence
  Synthetic
ggaccacccggcugcggg

SEQ ID NO: 52313 - RNA, 19 nt, Artificial Sequence
  Synthetic
cggaccacccggcugcggg

SEQ ID NO: 52314 - RNA, 20 nt, Artificial Sequence
  Synthetic
ccggaccacccggcugcggg

SEQ ID NO: 52315 - RNA, 21 nt, Artificial Sequence
  Synthetic
cccggaccacccggcugcggg

SEQ ID NO: 52316 - RNA, 22 nt, Artificial Sequence
  Synthetic
ccccggaccacccggcugcggg

SEQ ID NO: 52317 - RNA, 23 nt, Artificial Sequence
  Synthetic
uccccggaccacccggcugcggg

SEQ ID NO: 52318 - RNA, 24 nt, Artificial Sequence
  Synthetic
uuccccggaccacccggcugcggg

SEQ ID NO: 52319 - RNA, 18 nt, Artificial Sequence
  Synthetic
gagagcgggggacagggg

SEQ ID NO: 52320 - RNA, 19 nt, Artificial Sequence
  Synthetic
cgagagcgggggacagggg

SEQ ID NO: 52321 - RNA, 20 nt, Artificial Sequence
  Synthetic
ccgagagcgggggacagggg

SEQ ID NO: 52322 - RNA, 21 nt, Artificial Sequence
  Synthetic
cccgagagcgggggacagggg

SEQ ID NO: 52323 - RNA, 22 nt, Artificial Sequence
  Synthetic
gcccgagagcgggggacagggg

SEQ ID NO: 52324 - RNA, 23 nt, Artificial Sequence
  Synthetic
agcccgagagcgggggacagggg

SEQ ID NO: 52325 - RNA, 24 nt, Artificial Sequence
  Synthetic
gagcccgagagcgggggacagggg

SEQ ID NO: 52326 - RNA, 18 nt, Artificial Sequence
  Synthetic
agggggggagacgagggg

SEQ ID NO: 52327 - RNA, 19 nt, Artificial Sequence
  Synthetic
cagggggggagacgagggg

SEQ ID NO: 52328 - RNA, 20 nt, Artificial Sequence
  Synthetic
acagggggggagacgagggg

SEQ ID NO: 52329 - RNA, 21 nt, Artificial Sequence
  Synthetic
gacagggggggagacgagggg

SEQ ID NO: 52330 - RNA, 22 nt, Artificial Sequence
  Synthetic
ggacagggggggagacgagggg

SEQ ID NO: 52331 - RNA, 23 nt, Artificial Sequence
  Synthetic
gggacagggggggagacgagggg

SEQ ID NO: 52332 - RNA, 24 nt, Artificial Sequence
  Synthetic
ggggacagggggggagacgagggg

SEQ ID NO: 52333 - RNA, 18 nt, Artificial Sequence
  Synthetic
augaauuucuccccgggg

SEQ ID NO: 52334 - RNA, 19 nt, Artificial Sequence
  Synthetic
aaugaauuucuccccgggg

SEQ ID NO: 52335 - RNA, 20 nt, Artificial Sequence
  Synthetic
uaaugaauuucuccccgggg

SEQ ID NO: 52336 - RNA, 21 nt, Artificial Sequence
  Synthetic
cuaaugaauuucuccccgggg

SEQ ID NO: 52337 - RNA, 22 nt, Artificial Sequence
  Synthetic
gcuaaugaauuucuccccgggg

SEQ ID NO: 52338 - RNA, 23 nt, Artificial Sequence
  Synthetic
ugcuaaugaauuucuccccgggg

SEQ ID NO: 52339 - RNA, 24 nt, Artificial Sequence
  Synthetic
augcuaaugaauuucuccccgggg

SEQ ID NO: 52340 - RNA, 18 nt, Artificial Sequence
  Synthetic
cccgguugguccccgggg

SEQ ID NO: 52341 - RNA, 19 nt, Artificial Sequence
  Synthetic
acccgguugguccccgggg

SEQ ID NO: 52342 - RNA, 20 nt, Artificial Sequence
  Synthetic
cacccgguugguccccgggg

SEQ ID NO: 52343 - RNA, 21 nt, Artificial Sequence
  Synthetic
acacccgguugguccccgggg

SEQ ID NO: 52344 - RNA, 22 nt, Artificial Sequence
  Synthetic
uacacccgguugguccccgggg

SEQ ID NO: 52345 - RNA, 23 nt, Artificial Sequence
  Synthetic
guacacccgguugguccccgggg

SEQ ID NO: 52346 - RNA, 24 nt, Artificial Sequence
  Synthetic
aguacacccgguugguccccgggg

SEQ ID NO: 52347 - RNA, 18 nt, Artificial Sequence
  Synthetic
cgggcggugggcucgggg

SEQ ID NO: 52348 - RNA, 19 nt, Artificial Sequence
  Synthetic
gcgggcggugggcucgggg

SEQ ID NO: 52349 - RNA, 20 nt, Artificial Sequence
  Synthetic
cgcgggcggugggcucgggg

SEQ ID NO: 52350 - RNA, 21 nt, Artificial Sequence
  Synthetic
ucgcgggcggugggcucgggg

SEQ ID NO: 52351 - RNA, 22 nt, Artificial Sequence
  Synthetic
gucgcgggcggugggcucgggg

SEQ ID NO: 52352 - RNA, 23 nt, Artificial Sequence
  Synthetic
ggucgcgggcggugggcucgggg

SEQ ID NO: 52353 - RNA, 24 nt, Artificial Sequence
  Synthetic
uggucgcgggcggugggcucgggg

SEQ ID NO: 52354 - RNA, 18 nt, Artificial Sequence
  Synthetic
gggcggugggcucggggg

SEQ ID NO: 52355 - RNA, 19 nt, Artificial Sequence
  Synthetic
cgggcggugggcucggggg

SEQ ID NO: 52356 - RNA, 20 nt, Artificial Sequence
  Synthetic
gcgggcggugggcucggggg

SEQ ID NO: 52357 - RNA, 21 nt, Artificial Sequence
  Synthetic
cgcgggcggugggcucggggg

SEQ ID NO: 52358 - RNA, 22 nt, Artificial Sequence
  Synthetic
ucgcgggcggugggcucggggg

SEQ ID NO: 52359 - RNA, 23 nt, Artificial Sequence
  Synthetic
gucgcgggcggugggcucggggg

SEQ ID NO: 52360 - RNA, 24 nt, Artificial Sequence
  Synthetic
ggucgcgggcggugggcucggggg

SEQ ID NO: 52361 - RNA, 18 nt, Artificial Sequence
  Synthetic
aaagcagcgggcgggggg

SEQ ID NO: 52362 - RNA, 19 nt, Artificial Sequence
  Synthetic
aaaagcagcgggcgggggg

SEQ ID NO: 52363 - RNA, 20 nt, Artificial Sequence
  Synthetic
aaaaagcagcgggcgggggg

SEQ ID NO: 52364 - RNA, 21 nt, Artificial Sequence
  Synthetic
caaaaagcagcgggcgggggg

SEQ ID NO: 52365 - RNA, 22 nt, Artificial Sequence
  Synthetic
acaaaaagcagcgggcgggggg

SEQ ID NO: 52366 - RNA, 23 nt, Artificial Sequence
  Synthetic
aacaaaaagcagcgggcgggggg

SEQ ID NO: 52367 - RNA, 24 nt, Artificial Sequence
  Synthetic
gaacaaaaagcagcgggcgggggg

SEQ ID NO: 52368 - RNA, 18 nt, Artificial Sequence
  Synthetic
ccccgacccucugggggg

SEQ ID NO: 52369 - RNA, 19 nt, Artificial Sequence
  Synthetic
cccccgacccucugggggg

SEQ ID NO: 52370 - RNA, 20 nt, Artificial Sequence
  Synthetic
ccccccgacccucugggggg

SEQ ID NO: 52371 - RNA, 21 nt, Artificial Sequence
  Synthetic
gccccccgacccucugggggg

SEQ ID NO: 52372 - RNA, 22 nt, Artificial Sequence
  Synthetic
cgccccccgacccucugggggg

SEQ ID NO: 52373 - RNA, 23 nt, Artificial Sequence
  Synthetic
ccgccccccgacccucugggggg

SEQ ID NO: 52374 - RNA, 24 nt, Artificial Sequence
  Synthetic
gccgccccccgacccucugggggg

SEQ ID NO: 52375 - RNA, 18 nt, Artificial Sequence
  Synthetic
cgccccccgacccucugg

SEQ ID NO: 52376 - RNA, 19 nt, Artificial Sequence
  Synthetic
ccgccccccgacccucugg

SEQ ID NO: 52377 - RNA, 20 nt, Artificial Sequence
  Synthetic
gccgccccccgacccucugg

SEQ ID NO: 52378 - RNA, 21 nt, Artificial Sequence
  Synthetic
cgccgccccccgacccucugg

SEQ ID NO: 52379 - RNA, 22 nt, Artificial Sequence
  Synthetic
gcgccgccccccgacccucugg

SEQ ID NO: 52380 - RNA, 23 nt, Artificial Sequence
  Synthetic
ugcgccgccccccgacccucugg

SEQ ID NO: 52381 - RNA, 24 nt, Artificial Sequence
  Synthetic
gugcgccgccccccgacccucugg

SEQ ID NO: 52382 - RNA, 18 nt, Artificial Sequence
  Synthetic
ucgcgcgccgccgggugg

SEQ ID NO: 52383 - RNA, 19 nt, Artificial Sequence
  Synthetic
cucgcgcgccgccgggugg

SEQ ID NO: 52384 - RNA, 20 nt, Artificial Sequence
  Synthetic
ccucgcgcgccgccgggugg

SEQ ID NO: 52385 - RNA, 21 nt, Artificial Sequence
  Synthetic
gccucgcgcgccgccgggugg

SEQ ID NO: 52386 - RNA, 22 nt, Artificial Sequence
  Synthetic
agccucgcgcgccgccgggugg

SEQ ID NO: 52387 - RNA, 23 nt, Artificial Sequence
  Synthetic
gagccucgcgcgccgccgggugg

SEQ ID NO: 52388 - RNA, 24 nt, Artificial Sequence
  Synthetic
agagccucgcgcgccgccgggugg

SEQ ID NO: 52389 - RNA, 18 nt, Artificial Sequence
  Synthetic
ccgccccccgacccucug

SEQ ID NO: 52390 - RNA, 19 nt, Artificial Sequence
  Synthetic
gccgccccccgacccucug

SEQ ID NO: 52391 - RNA, 20 nt, Artificial Sequence
  Synthetic
cgccgccccccgacccucug

SEQ ID NO: 52392 - RNA, 21 nt, Artificial Sequence
  Synthetic
gcgccgccccccgacccucug

SEQ ID NO: 52393 - RNA, 22 nt, Artificial Sequence
  Synthetic
ugcgccgccccccgacccucug

SEQ ID NO: 52394 - RNA, 23 nt, Artificial Sequence
  Synthetic
gugcgccgccccccgacccucug

SEQ ID NO: 52395 - RNA, 24 nt, Artificial Sequence
  Synthetic
cgugcgccgccccccgacccucug

SEQ ID NO: 52396 - RNA, 18 nt, Artificial Sequence
  Synthetic
gggcggggggccggggug

SEQ ID NO: 52397 - RNA, 19 nt, Artificial Sequence
  Synthetic
cgggcggggggccggggug

SEQ ID NO: 52398 - RNA, 20 nt, Artificial Sequence
  Synthetic
gcgggcggggggccggggug

SEQ ID NO: 52399 - RNA, 21 nt, Artificial Sequence
  Synthetic
agcgggcggggggccggggug

SEQ ID NO: 52400 - RNA, 22 nt, Artificial Sequence
  Synthetic
cagcgggcggggggccggggug

SEQ ID NO: 52401 - RNA, 23 nt, Artificial Sequence
  Synthetic
gcagcgggcggggggccggggug

SEQ ID NO: 52402 - RNA, 24 nt, Artificial Sequence
  Synthetic
agcagcgggcggggggccggggug

SEQ ID NO: 52403 - RNA, 18 nt, Artificial Sequence
  Synthetic
cggggcgcgcggcuauug

SEQ ID NO: 52404 - RNA, 19 nt, Artificial Sequence
  Synthetic
ccggggcgcgcggcuauug

SEQ ID NO: 52405 - RNA, 20 nt, Artificial Sequence
  Synthetic
gccggggcgcgcggcuauug

SEQ ID NO: 52406 - RNA, 21 nt, Artificial Sequence
  Synthetic
cgccggggcgcgcggcuauug

SEQ ID NO: 52407 - RNA, 22 nt, Artificial Sequence
  Synthetic
ccgccggggcgcgcggcuauug

SEQ ID NO: 52408 - RNA, 23 nt, Artificial Sequence
  Synthetic
cccgccggggcgcgcggcuauug

SEQ ID NO: 52409 - RNA, 24 nt, Artificial Sequence
  Synthetic
ccccgccggggcgcgcggcuauug

SEQ ID NO: 52410 - RNA, 18 nt, Artificial Sequence
  Synthetic
cgggggcggggacgcuug

SEQ ID NO: 52411 - RNA, 19 nt, Artificial Sequence
  Synthetic
ucgggggcggggacgcuug

SEQ ID NO: 52412 - RNA, 20 nt, Artificial Sequence
  Synthetic
cucgggggcggggacgcuug

SEQ ID NO: 52413 - RNA, 21 nt, Artificial Sequence
  Synthetic
gcucgggggcggggacgcuug

SEQ ID NO: 52414 - RNA, 22 nt, Artificial Sequence
  Synthetic
ggcucgggggcggggacgcuug

SEQ ID NO: 52415 - RNA, 23 nt, Artificial Sequence
  Synthetic
gggcucgggggcggggacgcuug

SEQ ID NO: 52416 - RNA, 24 nt, Artificial Sequence
  Synthetic
ugggcucgggggcggggacgcuug

SEQ ID NO: 52417 - RNA, 18 nt, Artificial Sequence
  Synthetic
guaaaugccgccccuuug

SEQ ID NO: 52418 - RNA, 19 nt, Artificial Sequence
  Synthetic
cguaaaugccgccccuuug

SEQ ID NO: 52419 - RNA, 20 nt, Artificial Sequence
  Synthetic
ucguaaaugccgccccuuug

SEQ ID NO: 52420 - RNA, 21 nt, Artificial Sequence
  Synthetic
aucguaaaugccgccccuuug

SEQ ID NO: 52421 - RNA, 22 nt, Artificial Sequence
  Synthetic
aaucguaaaugccgccccuuug

SEQ ID NO: 52422 - RNA, 23 nt, Artificial Sequence
  Synthetic
gaaucguaaaugccgccccuuug

SEQ ID NO: 52423 - RNA, 24 nt, Artificial Sequence
  Synthetic
ggaaucguaaaugccgccccuuug

SEQ ID NO: 52424 - RNA, 18 nt, Artificial Sequence
  Synthetic
gccggggcgcgcggcuau

SEQ ID NO: 52425 - RNA, 19 nt, Artificial Sequence
  Synthetic
cgccggggcgcgcggcuau

SEQ ID NO: 52426 - RNA, 20 nt, Artificial Sequence
  Synthetic
ccgccggggcgcgcggcuau

SEQ ID NO: 52427 - RNA, 21 nt, Artificial Sequence
  Synthetic
cccgccggggcgcgcggcuau

SEQ ID NO: 52428 - RNA, 22 nt, Artificial Sequence
  Synthetic
ccccgccggggcgcgcggcuau

SEQ ID NO: 52429 - RNA, 23 nt, Artificial Sequence
  Synthetic
cccccgccggggcgcgcggcuau

SEQ ID NO: 52430 - RNA, 24 nt, Artificial Sequence
  Synthetic
gcccccgccggggcgcgcggcuau

SEQ ID NO: 52431 - RNA, 18 nt, Artificial Sequence
  Synthetic
ccgggggcgggcaccacu

SEQ ID NO: 52432 - RNA, 19 nt, Artificial Sequence
  Synthetic
cccgggggcgggcaccacu

SEQ ID NO: 52433 - RNA, 20 nt, Artificial Sequence
  Synthetic
ccccgggggcgggcaccacu

SEQ ID NO: 52434 - RNA, 21 nt, Artificial Sequence
  Synthetic
uccccgggggcgggcaccacu

SEQ ID NO: 52435 - RNA, 22 nt, Artificial Sequence
  Synthetic
cuccccgggggcgggcaccacu

SEQ ID NO: 52436 - RNA, 23 nt, Artificial Sequence
  Synthetic
ucuccccgggggcgggcaccacu

SEQ ID NO: 52437 - RNA, 24 nt, Artificial Sequence
  Synthetic
uucuccccgggggcgggcaccacu

SEQ ID NO: 52438 - RNA, 18 nt, Artificial Sequence
  Synthetic
cauucgcaccccggcacu

SEQ ID NO: 52439 - RNA, 19 nt, Artificial Sequence
  Synthetic
gcauucgcaccccggcacu

SEQ ID NO: 52440 - RNA, 20 nt, Artificial Sequence
  Synthetic
cgcauucgcaccccggcacu

SEQ ID NO: 52441 - RNA, 21 nt, Artificial Sequence
  Synthetic
ccgcauucgcaccccggcacu

SEQ ID NO: 52442 - RNA, 22 nt, Artificial Sequence
  Synthetic
gccgcauucgcaccccggcacu

SEQ ID NO: 52443 - RNA, 23 nt, Artificial Sequence
  Synthetic
ggccgcauucgcaccccggcacu

SEQ ID NO: 52444 - RNA, 24 nt, Artificial Sequence
  Synthetic
gggccgcauucgcaccccggcacu

SEQ ID NO: 52445 - RNA, 18 nt, Artificial Sequence
  Synthetic
gcgccgccccccgacccu

SEQ ID NO: 52446 - RNA, 19 nt, Artificial Sequence
  Synthetic
ugcgccgccccccgacccu

SEQ ID NO: 52447 - RNA, 20 nt, Artificial Sequence
  Synthetic
gugcgccgccccccgacccu

SEQ ID NO: 52448 - RNA, 21 nt, Artificial Sequence
  Synthetic
cgugcgccgccccccgacccu

SEQ ID NO: 52449 - RNA, 22 nt, Artificial Sequence
  Synthetic
ccgugcgccgccccccgacccu

SEQ ID NO: 52450 - RNA, 23 nt, Artificial Sequence
  Synthetic
gccgugcgccgccccccgacccu

SEQ ID NO: 52451 - RNA, 24 nt, Artificial Sequence
  Synthetic
ggccgugcgccgccccccgacccu

SEQ ID NO: 52452 - RNA, 18 nt, Artificial Sequence
  Synthetic
aucguaaaugccgccccu

SEQ ID NO: 52453 - RNA, 19 nt, Artificial Sequence
  Synthetic
aaucguaaaugccgccccu

SEQ ID NO: 52454 - RNA, 20 nt, Artificial Sequence
  Synthetic
gaaucguaaaugccgccccu

SEQ ID NO: 52455 - RNA, 21 nt, Artificial Sequence
  Synthetic
ggaaucguaaaugccgccccu

SEQ ID NO: 52456 - RNA, 22 nt, Artificial Sequence
  Synthetic
gggaaucguaaaugccgccccu

SEQ ID NO: 52457 - RNA, 23 nt, Artificial Sequence
  Synthetic
ggggaaucguaaaugccgccccu

SEQ ID NO: 52458 - RNA, 24 nt, Artificial Sequence
  Synthetic
gggggaaucguaaaugccgccccu

SEQ ID NO: 52459 - RNA, 18 nt, Artificial Sequence
  Synthetic
ggucgcgggcggugggcu

SEQ ID NO: 52460 - RNA, 19 nt, Artificial Sequence
  Synthetic
uggucgcgggcggugggcu

SEQ ID NO: 52461 - RNA, 20 nt, Artificial Sequence
  Synthetic
guggucgcgggcggugggcu

SEQ ID NO: 52462 - RNA, 21 nt, Artificial Sequence
  Synthetic
gguggucgcgggcggugggcu

SEQ ID NO: 52463 - RNA, 22 nt, Artificial Sequence
  Synthetic
ggguggucgcgggcggugggcu

SEQ ID NO: 52464 - RNA, 23 nt, Artificial Sequence
  Synthetic
gggguggucgcgggcggugggcu

SEQ ID NO: 52465 - RNA, 24 nt, Artificial Sequence
  Synthetic
ggggguggucgcgggcggugggcu

SEQ ID NO: 52466 - RNA, 18 nt, Artificial Sequence
  Synthetic
gccgccccccgacccucu

SEQ ID NO: 52467 - RNA, 19 nt, Artificial Sequence
  Synthetic
cgccgccccccgacccucu

SEQ ID NO: 52468 - RNA, 20 nt, Artificial Sequence
  Synthetic
gcgccgccccccgacccucu

SEQ ID NO: 52469 - RNA, 21 nt, Artificial Sequence
  Synthetic
ugcgccgccccccgacccucu

SEQ ID NO: 52470 - RNA, 22 nt, Artificial Sequence
  Synthetic
gugcgccgccccccgacccucu

SEQ ID NO: 52471 - RNA, 23 nt, Artificial Sequence
  Synthetic
cgugcgccgccccccgacccucu

SEQ ID NO: 52472 - RNA, 24 nt, Artificial Sequence
  Synthetic
ccgugcgccgccccccgacccucu

SEQ ID NO: 52473 - RNA, 18 nt, Artificial Sequence
  Synthetic
gcagacccccggcacggu

SEQ ID NO: 52474 - RNA, 19 nt, Artificial Sequence
  Synthetic
ggcagacccccggcacggu

SEQ ID NO: 52475 - RNA, 20 nt, Artificial Sequence
  Synthetic
cggcagacccccggcacggu

SEQ ID NO: 52476 - RNA, 21 nt, Artificial Sequence
  Synthetic
gcggcagacccccggcacggu

SEQ ID NO: 52477 - RNA, 22 nt, Artificial Sequence
  Synthetic
cgcggcagacccccggcacggu

SEQ ID NO: 52478 - RNA, 23 nt, Artificial Sequence
  Synthetic
ccgcggcagacccccggcacggu

SEQ ID NO: 52479 - RNA, 24 nt, Artificial Sequence
  Synthetic
gccgcggcagacccccggcacggu

SEQ ID NO: 52480 - RNA, 18 nt, Artificial Sequence
  Synthetic
ccggcccgcuuaagcggu

SEQ ID NO: 52481 - RNA, 19 nt, Artificial Sequence
  Synthetic
cccggcccgcuuaagcggu

SEQ ID NO: 52482 - RNA, 20 nt, Artificial Sequence
  Synthetic
ccccggcccgcuuaagcggu

SEQ ID NO: 52483 - RNA, 21 nt, Artificial Sequence
  Synthetic
cccccggcccgcuuaagcggu

SEQ ID NO: 52484 - RNA, 22 nt, Artificial Sequence
  Synthetic
acccccggcccgcuuaagcggu

SEQ ID NO: 52485 - RNA, 23 nt, Artificial Sequence
  Synthetic
gacccccggcccgcuuaagcggu

SEQ ID NO: 52486 - RNA, 24 nt, Artificial Sequence
  Synthetic
cgacccccggcccgcuuaagcggu

SEQ ID NO: 52487 - RNA, 18 nt, Artificial Sequence
  Synthetic
gaccacccggcugcgggu

SEQ ID NO: 52488 - RNA, 19 nt, Artificial Sequence
  Synthetic
ggaccacccggcugcgggu

SEQ ID NO: 52489 - RNA, 20 nt, Artificial Sequence
  Synthetic
cggaccacccggcugcgggu

SEQ ID NO: 52490 - RNA, 21 nt, Artificial Sequence
  Synthetic
ccggaccacccggcugcgggu

SEQ ID NO: 52491 - RNA, 22 nt, Artificial Sequence
  Synthetic
cccggaccacccggcugcgggu

SEQ ID NO: 52492 - RNA, 23 nt, Artificial Sequence
  Synthetic
ccccggaccacccggcugcgggu

SEQ ID NO: 52493 - RNA, 24 nt, Artificial Sequence
  Synthetic
uccccggaccacccggcugcgggu

SEQ ID NO: 52494 - RNA, 18 nt, Artificial Sequence
  Synthetic
cgggcggggggccggggu

SEQ ID NO: 52495 - RNA, 19 nt, Artificial Sequence
  Synthetic
gcgggcggggggccggggu

SEQ ID NO: 52496 - RNA, 20 nt, Artificial Sequence
  Synthetic
agcgggcggggggccggggu

SEQ ID NO: 52497 - RNA, 21 nt, Artificial Sequence
  Synthetic
cagcgggcggggggccggggu

SEQ ID NO: 52498 - RNA, 22 nt, Artificial Sequence
  Synthetic
gcagcgggcggggggccggggu

SEQ ID NO: 52499 - RNA, 23 nt, Artificial Sequence
  Synthetic
agcagcgggcggggggccggggu

SEQ ID NO: 52500 - RNA, 24 nt, Artificial Sequence
  Synthetic
aagcagcgggcggggggccggggu

SEQ ID NO: 52501 - RNA, 18 nt, Artificial Sequence
  Synthetic
ccggggcgcgcggcuauu

SEQ ID NO: 52502 - RNA, 19 nt, Artificial Sequence
  Synthetic
gccggggcgcgcggcuauu

SEQ ID NO: 52503 - RNA, 20 nt, Artificial Sequence
  Synthetic
cgccggggcgcgcggcuauu

SEQ ID NO: 52504 - RNA, 21 nt, Artificial Sequence
  Synthetic
ccgccggggcgcgcggcuauu

SEQ ID NO: 52505 - RNA, 22 nt, Artificial Sequence
  Synthetic
cccgccggggcgcgcggcuauu

SEQ ID NO: 52506 - RNA, 23 nt, Artificial Sequence
  Synthetic
ccccgccggggcgcgcggcuauu

SEQ ID NO: 52507 - RNA, 24 nt, Artificial Sequence
  Synthetic
cccccgccggggcgcgcggcuauu

SEQ ID NO: 52508 - RNA, 18 nt, Artificial Sequence
  Synthetic
ccccuuucucccccccuu

SEQ ID NO: 52509 - RNA, 19 nt, Artificial Sequence
  Synthetic
accccuuucucccccccuu

SEQ ID NO: 52510 - RNA, 20 nt, Artificial Sequence
  Synthetic
gaccccuuucucccccccuu

SEQ ID NO: 52511 - RNA, 21 nt, Artificial Sequence
  Synthetic
ggaccccuuucucccccccuu

SEQ ID NO: 52512 - RNA, 22 nt, Artificial Sequence
  Synthetic
cggaccccuuucucccccccuu

SEQ ID NO: 52513 - RNA, 23 nt, Artificial Sequence
  Synthetic
acggaccccuuucucccccccuu

SEQ ID NO: 52514 - RNA, 24 nt, Artificial Sequence
  Synthetic
uacggaccccuuucucccccccuu

SEQ ID NO: 52515 - RNA, 18 nt, Artificial Sequence
  Synthetic
ucguaaaugccgccccuu

SEQ ID NO: 52516 - RNA, 19 nt, Artificial Sequence
  Synthetic
aucguaaaugccgccccuu

SEQ ID NO: 52517 - RNA, 20 nt, Artificial Sequence
  Synthetic
aaucguaaaugccgccccuu

SEQ ID NO: 52518 - RNA, 21 nt, Artificial Sequence
  Synthetic
gaaucguaaaugccgccccuu

SEQ ID NO: 52519 - RNA, 22 nt, Artificial Sequence
  Synthetic
ggaaucguaaaugccgccccuu

SEQ ID NO: 52520 - RNA, 23 nt, Artificial Sequence
  Synthetic
gggaaucguaaaugccgccccuu

SEQ ID NO: 52521 - RNA, 24 nt, Artificial Sequence
  Synthetic
ggggaaucguaaaugccgccccuu

SEQ ID NO: 52522 - RNA, 18 nt, Artificial Sequence
  Synthetic
cgcagaccaccuuugguu

SEQ ID NO: 52523 - RNA, 19 nt, Artificial Sequence
  Synthetic
acgcagaccaccuuugguu

SEQ ID NO: 52524 - RNA, 20 nt, Artificial Sequence
  Synthetic
gacgcagaccaccuuugguu

SEQ ID NO: 52525 - RNA, 21 nt, Artificial Sequence
  Synthetic
ggacgcagaccaccuuugguu

SEQ ID NO: 52526 - RNA, 22 nt, Artificial Sequence
  Synthetic
aggacgcagaccaccuuugguu

SEQ ID NO: 52527 - RNA, 23 nt, Artificial Sequence
  Synthetic
aaggacgcagaccaccuuugguu

SEQ ID NO: 52528 - RNA, 24 nt, Artificial Sequence
  Synthetic
aaaggacgcagaccaccuuugguu

SEQ ID NO: 52529 - RNA, 18 nt, Artificial Sequence
  Synthetic
cguaaaugccgccccuuu

SEQ ID NO: 52530 - RNA, 19 nt, Artificial Sequence
  Synthetic
ucguaaaugccgccccuuu

SEQ ID NO: 52531 - RNA, 20 nt, Artificial Sequence
  Synthetic
aucguaaaugccgccccuuu

SEQ ID NO: 52532 - RNA, 21 nt, Artificial Sequence
  Synthetic
aaucguaaaugccgccccuuu

SEQ ID NO: 52533 - RNA, 22 nt, Artificial Sequence
  Synthetic
gaaucguaaaugccgccccuuu

SEQ ID NO: 52534 - RNA, 23 nt, Artificial Sequence
  Synthetic
ggaaucguaaaugccgccccuuu

SEQ ID NO: 52535 - RNA, 24 nt, Artificial Sequence
  Synthetic
gggaaucguaaaugccgccccuuu

SEQ ID NO: 52536 - RNA, 18 nt, Artificial Sequence
  Synthetic
gggacacguguugcgcaa

SEQ ID NO: 52537 - RNA, 19 nt, Artificial Sequence
  Synthetic
ggggacacguguugcgcaa

SEQ ID NO: 52538 - RNA, 24 nt, Artificial Sequence
  Synthetic
gcacaggggacacguguugcgcaa

SEQ ID NO: 52539 - RNA, 19 nt, Artificial Sequence
  Synthetic
gaauccaggucuucaugca

SEQ ID NO: 52540 - RNA, 20 nt, Artificial Sequence
  Synthetic
ggaauccaggucuucaugca

SEQ ID NO: 52541 - RNA, 22 nt, Artificial Sequence
  Synthetic
gucuucaugcacgggaugcaga

SEQ ID NO: 52542 - RNA, 23 nt, Artificial Sequence
  Synthetic
ggucuucaugcacgggaugcaga

SEQ ID NO: 52543 - RNA, 21 nt, Artificial Sequence
  Synthetic
gcccacuaucagguacgccac

SEQ ID NO: 52544 - RNA, 19 nt, Artificial Sequence
  Synthetic
guuuuuaauuaccauaagc

SEQ ID NO: 52545 - RNA, 23 nt, Artificial Sequence
  Synthetic
gaacguuuuuaauuaccauaagc

SEQ ID NO: 52546 - RNA, 19 nt, Artificial Sequence
  Synthetic
guugcuaauuaccaugcgc

SEQ ID NO: 52547 - RNA, 18 nt, Artificial Sequence
  Synthetic
gggcggcgccgggcccuc

SEQ ID NO: 52548 - RNA, 19 nt, Artificial Sequence
  Synthetic
ggggcggcgccgggcccuc

SEQ ID NO: 52549 - RNA, 21 nt, Artificial Sequence
  Synthetic
gcggggcggcgccgggcccuc

SEQ ID NO: 52550 - RNA, 22 nt, Artificial Sequence
  Synthetic
ggcggggcggcgccgggcccuc

SEQ ID NO: 52551 - RNA, 24 nt, Artificial Sequence
  Synthetic
gcggcggggcggcgccgggcccuc

SEQ ID NO: 52552 - RNA, 19 nt, Artificial Sequence
  Synthetic
gugcugcccgccucggagg

SEQ ID NO: 52553 - RNA, 23 nt, Artificial Sequence
  Synthetic
guccgugcugcccgccucggagg

SEQ ID NO: 52554 - RNA, 18 nt, Artificial Sequence
  Synthetic
gcggggcggucgccgggg

SEQ ID NO: 52555 - RNA, 20 nt, Artificial Sequence
  Synthetic
gcgcggggcggucgccgggg

SEQ ID NO: 52556 - RNA, 21 nt, Artificial Sequence
  Synthetic
ggcgcggggcggucgccgggg

SEQ ID NO: 52557 - RNA, 24 nt, Artificial Sequence
  Synthetic
gccggcgcggggcggucgccgggg

SEQ ID NO: 52558 - RNA, 20 nt, Artificial Sequence
  Synthetic
guccgggggucguucacuau

SEQ ID NO: 52559 - RNA, 21 nt, Artificial Sequence
  Synthetic
gguccgggggucguucacuau

SEQ ID NO: 52560 - RNA, 22 nt, Artificial Sequence
  Synthetic
ggguccgggggucguucacuau

SEQ ID NO: 52561 - RNA, 24 nt, Artificial Sequence
  Synthetic
gcggguccgggggucguucacuau

SEQ ID NO: 52562 - RNA, 23 nt, Artificial Sequence
  Synthetic
gauucccaccucggucuccuccu

SEQ ID NO: 52563 - RNA, 20 nt, Artificial Sequence
  Synthetic
gauagugggcgugaccgcca

SEQ ID NO: 52564 - RNA, 19 nt, Artificial Sequence
  Synthetic
gcaucccgugcaugaagac

SEQ ID NO: 52565 - RNA, 20 nt, Artificial Sequence
  Synthetic
gauccugcgggggugggccc

SEQ ID NO: 52566 - RNA, 21 nt, Artificial Sequence
  Synthetic
ggauccugcgggggugggccc

SEQ ID NO: 52567 - RNA, 22 nt, Artificial Sequence
  Synthetic
gggauccugcgggggugggccc

SEQ ID NO: 52568 - RNA, 21 nt, Artificial Sequence
  Synthetic
gccccacgcccgccgacgcgc

SEQ ID NO: 52569 - RNA, 24 nt, Artificial Sequence
  Synthetic
gcagccccacgcccgccgacgcgc

SEQ ID NO: 52570 - RNA, 19 nt, Artificial Sequence
  Synthetic
gaggcggcggcggcggcgc

SEQ ID NO: 52571 - RNA, 20 nt, Artificial Sequence
  Synthetic
ggaggcggcggcggcggcgc

SEQ ID NO: 52572 - RNA, 22 nt, Artificial Sequence
  Synthetic
gaggaggcggcggcggcggcgc

SEQ ID NO: 52573 - RNA, 23 nt, Artificial Sequence
  Synthetic
ggaggaggcggcggcggcggcgc

SEQ ID NO: 52574 - RNA, 18 nt, Artificial Sequence
  Synthetic
gacgcgcagggauccugc

SEQ ID NO: 52575 - RNA, 21 nt, Artificial Sequence
  Synthetic
gccgacgcgcagggauccugc

SEQ ID NO: 52576 - RNA, 18 nt, Artificial Sequence
  Synthetic
gccccgccccugcgcugc

SEQ ID NO: 52577 - RNA, 22 nt, Artificial Sequence
  Synthetic
gaucgccccgccccugcgcugc

SEQ ID NO: 52578 - RNA, 24 nt, Artificial Sequence
  Synthetic
gagaucgccccgccccugcgcugc

SEQ ID NO: 52579 - RNA, 20 nt, Artificial Sequence
  Synthetic
gcccgggccgucgggcgguc

SEQ ID NO: 52580 - RNA, 21 nt, Artificial Sequence
  Synthetic
ggcccgggccgucgggcgguc

SEQ ID NO: 52581 - RNA, 22 nt, Artificial Sequence
  Synthetic
gggcccgggccgucgggcgguc

SEQ ID NO: 52582 - RNA, 24 nt, Artificial Sequence
  Synthetic
gcgggcccgggccgucgggcgguc

SEQ ID NO: 52583 - RNA, 22 nt, Artificial Sequence
  Synthetic
gcuccccgcguaauuacucccu

SEQ ID NO: 52584 - RNA, 18 nt, Artificial Sequence
  Synthetic
ggaggaggagaccgaggu

SEQ ID NO: 52585 - RNA, 23 nt, Artificial Sequence
  Synthetic
gacucggaggaggagaccgaggu

SEQ ID NO: 52586 - RNA, 20 nt, Artificial Sequence
  Synthetic
guaauuacucccucgggguu

SEQ ID NO: 52587 - RNA, 22 nt, Artificial Sequence
  Synthetic
gcguaauuacucccucgggguu

SEQ ID NO: 52588 - RNA, 20 nt, Artificial Sequence
  Synthetic
aggggacacguguugcgcaa

SEQ ID NO: 52589 - RNA, 21 nt, Artificial Sequence
  Synthetic
caggggacacguguugcgcaa

SEQ ID NO: 52590 - RNA, 22 nt, Artificial Sequence
  Synthetic
acaggggacacguguugcgcaa

SEQ ID NO: 52591 - RNA, 23 nt, Artificial Sequence
  Synthetic
cacaggggacacguguugcgcaa

SEQ ID NO: 52592 - RNA, 18 nt, Artificial Sequence
  Synthetic
aauccaggucuucaugca

SEQ ID NO: 52593 - RNA, 21 nt, Artificial Sequence
  Synthetic
cggaauccaggucuucaugca

SEQ ID NO: 52594 - RNA, 22 nt, Artificial Sequence
  Synthetic
acggaauccaggucuucaugca

SEQ ID NO: 52595 - RNA, 23 nt, Artificial Sequence
  Synthetic
aacggaauccaggucuucaugca

SEQ ID NO: 52596 - RNA, 24 nt, Artificial Sequence
  Synthetic
caacggaauccaggucuucaugca

SEQ ID NO: 52597 - RNA, 18 nt, Artificial Sequence
  Synthetic
ucaugcacgggaugcaga

SEQ ID NO: 52598 - RNA, 19 nt, Artificial Sequence
  Synthetic
uucaugcacgggaugcaga

SEQ ID NO: 52599 - RNA, 20 nt, Artificial Sequence
  Synthetic
cuucaugcacgggaugcaga

SEQ ID NO: 52600 - RNA, 21 nt, Artificial Sequence
  Synthetic
ucuucaugcacgggaugcaga

SEQ ID NO: 52601 - RNA, 24 nt, Artificial Sequence
  Synthetic
aggucuucaugcacgggaugcaga

SEQ ID NO: 52602 - RNA, 18 nt, Artificial Sequence
  Synthetic
cacuaucagguacgccac

SEQ ID NO: 52603 - RNA, 19 nt, Artificial Sequence
  Synthetic
ccacuaucagguacgccac

SEQ ID NO: 52604 - RNA, 20 nt, Artificial Sequence
  Synthetic
cccacuaucagguacgccac

SEQ ID NO: 52605 - RNA, 22 nt, Artificial Sequence
  Synthetic
cgcccacuaucagguacgccac

SEQ ID NO: 52606 - RNA, 23 nt, Artificial Sequence
  Synthetic
acgcccacuaucagguacgccac

SEQ ID NO: 52607 - RNA, 24 nt, Artificial Sequence
  Synthetic
cacgcccacuaucagguacgccac

SEQ ID NO: 52608 - RNA, 18 nt, Artificial Sequence
  Synthetic
uuuuuaauuaccauaagc

SEQ ID NO: 52609 - RNA, 20 nt, Artificial Sequence
  Synthetic
cguuuuuaauuaccauaagc

SEQ ID NO: 52610 - RNA, 21 nt, Artificial Sequence
  Synthetic
acguuuuuaauuaccauaagc

SEQ ID NO: 52611 - RNA, 22 nt, Artificial Sequence
  Synthetic
aacguuuuuaauuaccauaagc

SEQ ID NO: 52612 - RNA, 24 nt, Artificial Sequence
  Synthetic
cgaacguuuuuaauuaccauaagc

SEQ ID NO: 52613 - RNA, 18 nt, Artificial Sequence
  Synthetic
uugcuaauuaccaugcgc

SEQ ID NO: 52614 - RNA, 20 nt, Artificial Sequence
  Synthetic
aguugcuaauuaccaugcgc

SEQ ID NO: 52615 - RNA, 21 nt, Artificial Sequence
  Synthetic
aaguugcuaauuaccaugcgc

SEQ ID NO: 52616 - RNA, 22 nt, Artificial Sequence
  Synthetic
aaaguugcuaauuaccaugcgc

SEQ ID NO: 52617 - RNA, 23 nt, Artificial Sequence
  Synthetic
aaaaguugcuaauuaccaugcgc

SEQ ID NO: 52618 - RNA, 24 nt, Artificial Sequence
  Synthetic
uaaaaguugcuaauuaccaugcgc

SEQ ID NO: 52619 - RNA, 20 nt, Artificial Sequence
  Synthetic
cggggcggcgccgggcccuc

SEQ ID NO: 52620 - RNA, 23 nt, Artificial Sequence
  Synthetic
cggcggggcggcgccgggcccuc

SEQ ID NO: 52621 - RNA, 18 nt, Artificial Sequence
  Synthetic
cccacgggcccacccccg

SEQ ID NO: 52622 - RNA, 19 nt, Artificial Sequence
  Synthetic
acccacgggcccacccccg

SEQ ID NO: 52623 - RNA, 20 nt, Artificial Sequence
  Synthetic
cacccacgggcccacccccg

SEQ ID NO: 52624 - RNA, 21 nt, Artificial Sequence
  Synthetic
ucacccacgggcccacccccg

SEQ ID NO: 52625 - RNA, 22 nt, Artificial Sequence
  Synthetic
cucacccacgggcccacccccg

SEQ ID NO: 52626 - RNA, 23 nt, Artificial Sequence
  Synthetic
ccucacccacgggcccacccccg

SEQ ID NO: 52627 - RNA, 24 nt, Artificial Sequence
  Synthetic
uccucacccacgggcccacccccg

SEQ ID NO: 52628 - RNA, 18 nt, Artificial Sequence
  Synthetic
ugcugcccgccucggagg

SEQ ID NO: 52629 - RNA, 20 nt, Artificial Sequence
  Synthetic
cgugcugcccgccucggagg

SEQ ID NO: 52630 - RNA, 21 nt, Artificial Sequence
  Synthetic
ccgugcugcccgccucggagg

SEQ ID NO: 52631 - RNA, 22 nt, Artificial Sequence
  Synthetic
uccgugcugcccgccucggagg

SEQ ID NO: 52632 - RNA, 24 nt, Artificial Sequence
  Synthetic
uguccgugcugcccgccucggagg

SEQ ID NO: 52633 - RNA, 19 nt, Artificial Sequence
  Synthetic
cgcggggcggucgccgggg

SEQ ID NO: 52634 - RNA, 22 nt, Artificial Sequence
  Synthetic
cggcgcggggcggucgccgggg

SEQ ID NO: 52635 - RNA, 23 nt, Artificial Sequence
  Synthetic
ccggcgcggggcggucgccgggg

SEQ ID NO: 52636 - RNA, 18 nt, Artificial Sequence
  Synthetic
ccgggggucguucacuau

SEQ ID NO: 52637 - RNA, 19 nt, Artificial Sequence
  Synthetic
uccgggggucguucacuau

SEQ ID NO: 52638 - RNA, 23 nt, Artificial Sequence
  Synthetic
cggguccgggggucguucacuau

SEQ ID NO: 52639 - RNA, 18 nt, Artificial Sequence
  Synthetic
ccaccucggucuccuccu

SEQ ID NO: 52640 - RNA, 19 nt, Artificial Sequence
  Synthetic
cccaccucggucuccuccu

SEQ ID NO: 52641 - RNA, 20 nt, Artificial Sequence
  Synthetic
ucccaccucggucuccuccu

SEQ ID NO: 52642 - RNA, 21 nt, Artificial Sequence
  Synthetic
uucccaccucggucuccuccu

SEQ ID NO: 52643 - RNA, 22 nt, Artificial Sequence
  Synthetic
auucccaccucggucuccuccu

SEQ ID NO: 52644 - RNA, 24 nt, Artificial Sequence
  Synthetic
agauucccaccucggucuccuccu

SEQ ID NO: 52645 - RNA, 18 nt, Artificial Sequence
  Synthetic
uagugggcgugaccgcca

SEQ ID NO: 52646 - RNA, 19 nt, Artificial Sequence
  Synthetic
auagugggcgugaccgcca

SEQ ID NO: 52647 - RNA, 21 nt, Artificial Sequence
  Synthetic
ugauagugggcgugaccgcca

SEQ ID NO: 52648 - RNA, 22 nt, Artificial Sequence
  Synthetic
cugauagugggcgugaccgcca

SEQ ID NO: 52649 - RNA, 23 nt, Artificial Sequence
  Synthetic
ccugauagugggcgugaccgcca

SEQ ID NO: 52650 - RNA, 24 nt, Artificial Sequence
  Synthetic
accugauagugggcgugaccgcca

SEQ ID NO: 52651 - RNA, 18 nt, Artificial Sequence
  Synthetic
caucccgugcaugaagac

SEQ ID NO: 52652 - RNA, 20 nt, Artificial Sequence
  Synthetic
ugcaucccgugcaugaagac

SEQ ID NO: 52653 - RNA, 21 nt, Artificial Sequence
  Synthetic
cugcaucccgugcaugaagac

SEQ ID NO: 52654 - RNA, 22 nt, Artificial Sequence
  Synthetic
ucugcaucccgugcaugaagac

SEQ ID NO: 52655 - RNA, 23 nt, Artificial Sequence
  Synthetic
uucugcaucccgugcaugaagac

SEQ ID NO: 52656 - RNA, 24 nt, Artificial Sequence
  Synthetic
cuucugcaucccgugcaugaagac

SEQ ID NO: 52657 - RNA, 18 nt, Artificial Sequence
  Synthetic
uccugcgggggugggccc

SEQ ID NO: 52658 - RNA, 19 nt, Artificial Sequence
  Synthetic
auccugcgggggugggccc

SEQ ID NO: 52659 - RNA, 23 nt, Artificial Sequence
  Synthetic
agggauccugcgggggugggccc

SEQ ID NO: 52660 - RNA, 24 nt, Artificial Sequence
  Synthetic
cagggauccugcgggggugggccc

SEQ ID NO: 52661 - RNA, 18 nt, Artificial Sequence
  Synthetic
ccacgcccgccgacgcgc

SEQ ID NO: 52662 - RNA, 19 nt, Artificial Sequence
  Synthetic
cccacgcccgccgacgcgc

SEQ ID NO: 52663 - RNA, 20 nt, Artificial Sequence
  Synthetic
ccccacgcccgccgacgcgc

SEQ ID NO: 52664 - RNA, 22 nt, Artificial Sequence
  Synthetic
agccccacgcccgccgacgcgc

SEQ ID NO: 52665 - RNA, 23 nt, Artificial Sequence
  Synthetic
cagccccacgcccgccgacgcgc

SEQ ID NO: 52666 - RNA, 18 nt, Artificial Sequence
  Synthetic
aggcggcggcggcggcgc

SEQ ID NO: 52667 - RNA, 21 nt, Artificial Sequence
  Synthetic
aggaggcggcggcggcggcgc

SEQ ID NO: 52668 - RNA, 24 nt, Artificial Sequence
  Synthetic
aggaggaggcggcggcggcggcgc

SEQ ID NO: 52669 - RNA, 19 nt, Artificial Sequence
  Synthetic
cgacgcgcagggauccugc

SEQ ID NO: 52670 - RNA, 20 nt, Artificial Sequence
  Synthetic
ccgacgcgcagggauccugc

SEQ ID NO: 52671 - RNA, 22 nt, Artificial Sequence
  Synthetic
cgccgacgcgcagggauccugc

SEQ ID NO: 52672 - RNA, 23 nt, Artificial Sequence
  Synthetic
ccgccgacgcgcagggauccugc

SEQ ID NO: 52673 - RNA, 24 nt, Artificial Sequence
  Synthetic
cccgccgacgcgcagggauccugc

SEQ ID NO: 52674 - RNA, 19 nt, Artificial Sequence
  Synthetic
cgccccgccccugcgcugc

SEQ ID NO: 52675 - RNA, 20 nt, Artificial Sequence
  Synthetic
ucgccccgccccugcgcugc

SEQ ID NO: 52676 - RNA, 21 nt, Artificial Sequence
  Synthetic
aucgccccgccccugcgcugc

SEQ ID NO: 52677 - RNA, 23 nt, Artificial Sequence
  Synthetic
agaucgccccgccccugcgcugc

SEQ ID NO: 52678 - RNA, 18 nt, Artificial Sequence
  Synthetic
ccgggccgucgggcgguc

SEQ ID NO: 52679 - RNA, 19 nt, Artificial Sequence
  Synthetic
cccgggccgucgggcgguc

SEQ ID NO: 52680 - RNA, 23 nt, Artificial Sequence
  Synthetic
cgggcccgggccgucgggcgguc

SEQ ID NO: 52681 - RNA, 18 nt, Artificial Sequence
  Synthetic
cccgcguaauuacucccu

SEQ ID NO: 52682 - RNA, 19 nt, Artificial Sequence
  Synthetic
ccccgcguaauuacucccu

SEQ ID NO: 52683 - RNA, 20 nt, Artificial Sequence
  Synthetic
uccccgcguaauuacucccu

SEQ ID NO: 52684 - RNA, 21 nt, Artificial Sequence
  Synthetic
cuccccgcguaauuacucccu

SEQ ID NO: 52685 - RNA, 23 nt, Artificial Sequence
  Synthetic
cgcuccccgcguaauuacucccu

SEQ ID NO: 52686 - RNA, 24 nt, Artificial Sequence
  Synthetic
ucgcuccccgcguaauuacucccu

SEQ ID NO: 52687 - RNA, 19 nt, Artificial Sequence
  Synthetic
cggaggaggagaccgaggu

SEQ ID NO: 52688 - RNA, 20 nt, Artificial Sequence
  Synthetic
ucggaggaggagaccgaggu

SEQ ID NO: 52689 - RNA, 21 nt, Artificial Sequence
  Synthetic
cucggaggaggagaccgaggu

SEQ ID NO: 52690 - RNA, 22 nt, Artificial Sequence
  Synthetic
acucggaggaggagaccgaggu

SEQ ID NO: 52691 - RNA, 24 nt, Artificial Sequence
  Synthetic
cgacucggaggaggagaccgaggu

SEQ ID NO: 52692 - RNA, 18 nt, Artificial Sequence
  Synthetic
aauuacucccucgggguu

SEQ ID NO: 52693 - RNA, 19 nt, Artificial Sequence
  Synthetic
uaauuacucccucgggguu

SEQ ID NO: 52694 - RNA, 21 nt, Artificial Sequence
  Synthetic
cguaauuacucccucgggguu

SEQ ID NO: 52695 - RNA, 23 nt, Artificial Sequence
  Synthetic
cgcguaauuacucccucgggguu

SEQ ID NO: 52696 - RNA, 24 nt, Artificial Sequence
  Synthetic
ccgcguaauuacucccucgggguu

SEQ ID NO: 52697 - skipped

SEQ ID NO: 52698 - RNA, 18 nt, Artificial Sequence
  Synthetic
cguuuuuaauuaccauaa

SEQ ID NO: 52699 - RNA, 19 nt, Artificial Sequence
  Synthetic
acguuuuuaauuaccauaa

SEQ ID NO: 52700 - RNA, 20 nt, Artificial Sequence
  Synthetic
aacguuuuuaauuaccauaa

SEQ ID NO: 52701 - RNA, 21 nt, Artificial Sequence
  Synthetic
gaacguuuuuaauuaccauaa

SEQ ID NO: 52702 - RNA, 22 nt, Artificial Sequence
  Synthetic
cgaacguuuuuaauuaccauaa

SEQ ID NO: 52703 - RNA, 23 nt, Artificial Sequence
  Synthetic
ccgaacguuuuuaauuaccauaa

SEQ ID NO: 52704 - RNA, 24 nt, Artificial Sequence
  Synthetic
uccgaacguuuuuaauuaccauaa

SEQ ID NO: 52705 - RNA, 18 nt, Artificial Sequence
  Synthetic
ccaccgggguguugcaca

SEQ ID NO: 52706 - RNA, 19 nt, Artificial Sequence
  Synthetic
gccaccgggguguugcaca

SEQ ID NO: 52707 - RNA, 20 nt, Artificial Sequence
  Synthetic
cgccaccgggguguugcaca

SEQ ID NO: 52708 - RNA, 21 nt, Artificial Sequence
  Synthetic
acgccaccgggguguugcaca

SEQ ID NO: 52709 - RNA, 22 nt, Artificial Sequence
  Synthetic
uacgccaccgggguguugcaca

SEQ ID NO: 52710 - RNA, 23 nt, Artificial Sequence
  Synthetic
guacgccaccgggguguugcaca

SEQ ID NO: 52711 - RNA, 24 nt, Artificial Sequence
  Synthetic
gguacgccaccgggguguugcaca

SEQ ID NO: 52712 - RNA, 18 nt, Artificial Sequence
  Synthetic
ccacuaucagguacgcca

SEQ ID NO: 52713 - RNA, 19 nt, Artificial Sequence
  Synthetic
cccacuaucagguacgcca

SEQ ID NO: 52714 - RNA, 20 nt, Artificial Sequence
  Synthetic
gcccacuaucagguacgcca

SEQ ID NO: 52715 - RNA, 21 nt, Artificial Sequence
  Synthetic
cgcccacuaucagguacgcca

SEQ ID NO: 52716 - RNA, 22 nt, Artificial Sequence
  Synthetic
acgcccacuaucagguacgcca

SEQ ID NO: 52717 - RNA, 23 nt, Artificial Sequence
  Synthetic
cacgcccacuaucagguacgcca

SEQ ID NO: 52718 - RNA, 24 nt, Artificial Sequence
  Synthetic
ucacgcccacuaucagguacgcca

SEQ ID NO: 52719 - RNA, 18 nt, Artificial Sequence
  Synthetic
ggggacacguguugcgca

SEQ ID NO: 52720 - RNA, 19 nt, Artificial Sequence
  Synthetic
aggggacacguguugcgca

SEQ ID NO: 52721 - RNA, 20 nt, Artificial Sequence
  Synthetic
caggggacacguguugcgca

SEQ ID NO: 52722 - RNA, 21 nt, Artificial Sequence
  Synthetic
acaggggacacguguugcgca

SEQ ID NO: 52723 - RNA, 22 nt, Artificial Sequence
  Synthetic
cacaggggacacguguugcgca

SEQ ID NO: 52724 - RNA, 23 nt, Artificial Sequence
  Synthetic
gcacaggggacacguguugcgca

SEQ ID NO: 52725 - RNA, 24 nt, Artificial Sequence
  Synthetic
ugcacaggggacacguguugcgca

SEQ ID NO: 52726 - RNA, 18 nt, Artificial Sequence
  Synthetic
gcagaaggggugcaggca

SEQ ID NO: 52727 - RNA, 19 nt, Artificial Sequence
  Synthetic
ugcagaaggggugcaggca

SEQ ID NO: 52728 - RNA, 20 nt, Artificial Sequence
  Synthetic
augcagaaggggugcaggca

SEQ ID NO: 52729 - RNA, 21 nt, Artificial Sequence
  Synthetic
gaugcagaaggggugcaggca

SEQ ID NO: 52730 - RNA, 22 nt, Artificial Sequence
  Synthetic
ggaugcagaaggggugcaggca

SEQ ID NO: 52731 - RNA, 23 nt, Artificial Sequence
  Synthetic
gggaugcagaaggggugcaggca

SEQ ID NO: 52732 - RNA, 24 nt, Artificial Sequence
  Synthetic
cgggaugcagaaggggugcaggca

SEQ ID NO: 52733 - RNA, 18 nt, Artificial Sequence
  Synthetic
cgccaccgggguguugca

SEQ ID NO: 52734 - RNA, 19 nt, Artificial Sequence
  Synthetic
acgccaccgggguguugca

SEQ ID NO: 52735 - RNA, 20 nt, Artificial Sequence
  Synthetic
uacgccaccgggguguugca

SEQ ID NO: 52736 - RNA, 21 nt, Artificial Sequence
  Synthetic
guacgccaccgggguguugca

SEQ ID NO: 52737 - RNA, 22 nt, Artificial Sequence
  Synthetic
gguacgccaccgggguguugca

SEQ ID NO: 52738 - RNA, 23 nt, Artificial Sequence
  Synthetic
agguacgccaccgggguguugca

SEQ ID NO: 52739 - RNA, 24 nt, Artificial Sequence
  Synthetic
cagguacgccaccgggguguugca

SEQ ID NO: 52740 - RNA, 18 nt, Artificial Sequence
  Synthetic
agcugcuaauuaccgcga

SEQ ID NO: 52741 - RNA, 19 nt, Artificial Sequence
  Synthetic
aagcugcuaauuaccgcga

SEQ ID NO: 52742 - RNA, 20 nt, Artificial Sequence
  Synthetic
aaagcugcuaauuaccgcga

SEQ ID NO: 52743 - RNA, 21 nt, Artificial Sequence
  Synthetic
aaaagcugcuaauuaccgcga

SEQ ID NO: 52744 - RNA, 22 nt, Artificial Sequence
  Synthetic
uaaaagcugcuaauuaccgcga

SEQ ID NO: 52745 - RNA, 23 nt, Artificial Sequence
  Synthetic
uuaaaagcugcuaauuaccgcga

SEQ ID NO: 52746 - RNA, 24 nt, Artificial Sequence
  Synthetic
guuaaaagcugcuaauuaccgcga

SEQ ID NO: 52747 - RNA, 18 nt, Artificial Sequence
  Synthetic
ggaguaauuacgcgggga

SEQ ID NO: 52748 - RNA, 19 nt, Artificial Sequence
  Synthetic
gggaguaauuacgcgggga

SEQ ID NO: 52749 - RNA, 20 nt, Artificial Sequence
  Synthetic
agggaguaauuacgcgggga

SEQ ID NO: 52750 - RNA, 21 nt, Artificial Sequence
  Synthetic
gagggaguaauuacgcgggga

SEQ ID NO: 52751 - RNA, 22 nt, Artificial Sequence
  Synthetic
cgagggaguaauuacgcgggga

SEQ ID NO: 52752 - RNA, 23 nt, Artificial Sequence
  Synthetic
ccgagggaguaauuacgcgggga

SEQ ID NO: 52753 - RNA, 24 nt, Artificial Sequence
  Synthetic
cccgagggaguaauuacgcgggga

SEQ ID NO: 52754 - RNA, 18 nt, Artificial Sequence
  Synthetic
aaguuucuaauuaccaua

SEQ ID NO: 52755 - RNA, 19 nt, Artificial Sequence
  Synthetic
aaaguuucuaauuaccaua

SEQ ID NO: 52756 - RNA, 20 nt, Artificial Sequence
  Synthetic
aaaaguuucuaauuaccaua

SEQ ID NO: 52757 - RNA, 21 nt, Artificial Sequence
  Synthetic
uaaaaguuucuaauuaccaua

SEQ ID NO: 52758 - RNA, 22 nt, Artificial Sequence
  Synthetic
uuaaaaguuucuaauuaccaua

SEQ ID NO: 52759 - RNA, 23 nt, Artificial Sequence
  Synthetic
auuaaaaguuucuaauuaccaua

SEQ ID NO: 52760 - RNA, 24 nt, Artificial Sequence
  Synthetic
uauuaaaaguuucuaauuaccaua

SEQ ID NO: 52761 - RNA, 18 nt, Artificial Sequence
  Synthetic
uccgggggucguucacua

SEQ ID NO: 52762 - RNA, 19 nt, Artificial Sequence
  Synthetic
guccgggggucguucacua

SEQ ID NO: 52763 - RNA, 20 nt, Artificial Sequence
  Synthetic
gguccgggggucguucacua

SEQ ID NO: 52764 - RNA, 21 nt, Artificial Sequence
  Synthetic
ggguccgggggucguucacua

SEQ ID NO: 52765 - RNA, 22 nt, Artificial Sequence
  Synthetic
cggguccgggggucguucacua

SEQ ID NO: 52766 - RNA, 23 nt, Artificial Sequence
  Synthetic
gcggguccgggggucguucacua

SEQ ID NO: 52767 - RNA, 24 nt, Artificial Sequence
  Synthetic
cgcggguccgggggucguucacua

SEQ ID NO: 52768 - RNA, 18 nt, Artificial Sequence
  Synthetic
gccaccgggguguugcac

SEQ ID NO: 52769 - RNA, 19 nt, Artificial Sequence
  Synthetic
cgccaccgggguguugcac

SEQ ID NO: 52770 - RNA, 20 nt, Artificial Sequence
  Synthetic
acgccaccgggguguugcac

SEQ ID NO: 52771 - RNA, 21 nt, Artificial Sequence
  Synthetic
uacgccaccgggguguugcac

SEQ ID NO: 52772 - RNA, 22 nt, Artificial Sequence
  Synthetic
guacgccaccgggguguugcac

SEQ ID NO: 52773 - RNA, 23 nt, Artificial Sequence
  Synthetic
gguacgccaccgggguguugcac

SEQ ID NO: 52774 - RNA, 24 nt, Artificial Sequence
  Synthetic
agguacgccaccgggguguugcac

SEQ ID NO: 52775 - RNA, 18 nt, Artificial Sequence
  Synthetic
aguuucuaauuaccauac

SEQ ID NO: 52776 - RNA, 19 nt, Artificial Sequence
  Synthetic
aaguuucuaauuaccauac

SEQ ID NO: 52777 - RNA, 20 nt, Artificial Sequence
  Synthetic
aaaguuucuaauuaccauac

SEQ ID NO: 52778 - RNA, 21 nt, Artificial Sequence
  Synthetic
aaaaguuucuaauuaccauac

SEQ ID NO: 52779 - RNA, 22 nt, Artificial Sequence
  Synthetic
uaaaaguuucuaauuaccauac

SEQ ID NO: 52780 - RNA, 23 nt, Artificial Sequence
  Synthetic
uuaaaaguuucuaauuaccauac

SEQ ID NO: 52781 - RNA, 24 nt, Artificial Sequence
  Synthetic
auuaaaaguuucuaauuaccauac

SEQ ID NO: 52782 - RNA, 18 nt, Artificial Sequence
  Synthetic
gcccucgcggauauauac

SEQ ID NO: 52783 - RNA, 19 nt, Artificial Sequence
  Synthetic
ggcccucgcggauauauac

SEQ ID NO: 52784 - RNA, 20 nt, Artificial Sequence
  Synthetic
gggcccucgcggauauauac

SEQ ID NO: 52785 - RNA, 21 nt, Artificial Sequence
  Synthetic
cgggcccucgcggauauauac

SEQ ID NO: 52786 - RNA, 22 nt, Artificial Sequence
  Synthetic
ccgggcccucgcggauauauac

SEQ ID NO: 52787 - RNA, 23 nt, Artificial Sequence
  Synthetic
gccgggcccucgcggauauauac

SEQ ID NO: 52788 - RNA, 24 nt, Artificial Sequence
  Synthetic
cgccgggcccucgcggauauauac

SEQ ID NO: 52789 - RNA, 18 nt, Artificial Sequence
  Synthetic
ccccgagggaguaauuac

SEQ ID NO: 52790 - RNA, 19 nt, Artificial Sequence
  Synthetic
accccgagggaguaauuac

SEQ ID NO: 52791 - RNA, 20 nt, Artificial Sequence
  Synthetic
aaccccgagggaguaauuac

SEQ ID NO: 52792 - RNA, 21 nt, Artificial Sequence
  Synthetic
gaaccccgagggaguaauuac

SEQ ID NO: 52793 - RNA, 22 nt, Artificial Sequence
  Synthetic
ggaaccccgagggaguaauuac

SEQ ID NO: 52794 - RNA, 23 nt, Artificial Sequence
  Synthetic
cggaaccccgagggaguaauuac

SEQ ID NO: 52795 - RNA, 24 nt, Artificial Sequence
  Synthetic
ccggaaccccgagggaguaauuac

SEQ ID NO: 52796 - RNA, 18 nt, Artificial Sequence
  Synthetic
guuucuaauuaccauacc

SEQ ID NO: 52797 - RNA, 19 nt, Artificial Sequence
  Synthetic
aguuucuaauuaccauacc

SEQ ID NO: 52798 - RNA, 20 nt, Artificial Sequence
  Synthetic
aaguuucuaauuaccauacc

SEQ ID NO: 52799 - RNA, 21 nt, Artificial Sequence
  Synthetic
aaaguuucuaauuaccauacc

SEQ ID NO: 52800 - RNA, 22 nt, Artificial Sequence
  Synthetic
aaaaguuucuaauuaccauacc

SEQ ID NO: 52801 - RNA, 23 nt, Artificial Sequence
  Synthetic
uaaaaguuucuaauuaccauacc

SEQ ID NO: 52802 - RNA, 24 nt, Artificial Sequence
  Synthetic
uuaaaaguuucuaauuaccauacc

SEQ ID NO: 52803 - RNA, 18 nt, Artificial Sequence
  Synthetic
uaaaagcugcuaauuacc

SEQ ID NO: 52804 - RNA, 19 nt, Artificial Sequence
  Synthetic
uuaaaagcugcuaauuacc

SEQ ID NO: 52805 - RNA, 20 nt, Artificial Sequence
  Synthetic
guuaaaagcugcuaauuacc

SEQ ID NO: 52806 - RNA, 21 nt, Artificial Sequence
  Synthetic
cguuaaaagcugcuaauuacc

SEQ ID NO: 52807 - RNA, 22 nt, Artificial Sequence
  Synthetic
ccguuaaaagcugcuaauuacc

SEQ ID NO: 52808 - RNA, 23 nt, Artificial Sequence
  Synthetic
cccguuaaaagcugcuaauuacc

SEQ ID NO: 52809 - RNA, 24 nt, Artificial Sequence
  Synthetic
gcccguuaaaagcugcuaauuacc

SEQ ID NO: 52810 - RNA, 18 nt, Artificial Sequence
  Synthetic
uccgcuuccuccucaccc

SEQ ID NO: 52811 - RNA, 19 nt, Artificial Sequence
  Synthetic
uuccgcuuccuccucaccc

SEQ ID NO: 52812 - RNA, 20 nt, Artificial Sequence
  Synthetic
cuuccgcuuccuccucaccc

SEQ ID NO: 52813 - RNA, 21 nt, Artificial Sequence
  Synthetic
gcuuccgcuuccuccucaccc

SEQ ID NO: 52814 - RNA, 22 nt, Artificial Sequence
  Synthetic
cgcuuccgcuuccuccucaccc

SEQ ID NO: 52815 - RNA, 23 nt, Artificial Sequence
  Synthetic
ccgcuuccgcuuccuccucaccc

SEQ ID NO: 52816 - RNA, 24 nt, Artificial Sequence
  Synthetic
cccgcuuccgcuuccuccucaccc

SEQ ID NO: 52817 - RNA, 18 nt, Artificial Sequence
  Synthetic
uuggccggcgccgccccc

SEQ ID NO: 52818 - RNA, 19 nt, Artificial Sequence
  Synthetic
guuggccggcgccgccccc

SEQ ID NO: 52819 - RNA, 20 nt, Artificial Sequence
  Synthetic
gguuggccggcgccgccccc

SEQ ID NO: 52820 - RNA, 21 nt, Artificial Sequence
  Synthetic
cgguuggccggcgccgccccc

SEQ ID NO: 52821 - RNA, 22 nt, Artificial Sequence
  Synthetic
gcgguuggccggcgccgccccc

SEQ ID NO: 52822 - RNA, 23 nt, Artificial Sequence
  Synthetic
cgcgguuggccggcgccgccccc

SEQ ID NO: 52823 - RNA, 24 nt, Artificial Sequence
  Synthetic
gcgcgguuggccggcgccgccccc

SEQ ID NO: 52824 - RNA, 18 nt, Artificial Sequence
  Synthetic
guuggccggcgccgcccc

SEQ ID NO: 52825 - RNA, 19 nt, Artificial Sequence
  Synthetic
gguuggccggcgccgcccc

SEQ ID NO: 52826 - RNA, 20 nt, Artificial Sequence
  Synthetic
cgguuggccggcgccgcccc

SEQ ID NO: 52827 - RNA, 21 nt, Artificial Sequence
  Synthetic
gcgguuggccggcgccgcccc

SEQ ID NO: 52828 - RNA, 22 nt, Artificial Sequence
  Synthetic
cgcgguuggccggcgccgcccc

SEQ ID NO: 52829 - RNA, 23 nt, Artificial Sequence
  Synthetic
gcgcgguuggccggcgccgcccc

SEQ ID NO: 52830 - RNA, 24 nt, Artificial Sequence
  Synthetic
cgcgcgguuggccggcgccgcccc

SEQ ID NO: 52831 - RNA, 18 nt, Artificial Sequence
  Synthetic
gcguccaucaggcccgcc

SEQ ID NO: 52832 - RNA, 19 nt, Artificial Sequence
  Synthetic
cgcguccaucaggcccgcc

SEQ ID NO: 52833 - RNA, 20 nt, Artificial Sequence
  Synthetic
ccgcguccaucaggcccgcc

SEQ ID NO: 52834 - RNA, 21 nt, Artificial Sequence
  Synthetic
gccgcguccaucaggcccgcc

SEQ ID NO: 52835 - RNA, 22 nt, Artificial Sequence
  Synthetic
ggccgcguccaucaggcccgcc

SEQ ID NO: 52836 - RNA, 23 nt, Artificial Sequence
  Synthetic
uggccgcguccaucaggcccgcc

SEQ ID NO: 52837 - RNA, 24 nt, Artificial Sequence
  Synthetic
guggccgcguccaucaggcccgcc

SEQ ID NO: 52838 - RNA, 18 nt, Artificial Sequence
  Synthetic
guguccgugcugcccgcc

SEQ ID NO: 52839 - RNA, 19 nt, Artificial Sequence
  Synthetic
cguguccgugcugcccgcc

SEQ ID NO: 52840 - RNA, 20 nt, Artificial Sequence
  Synthetic
ccguguccgugcugcccgcc

SEQ ID NO: 52841 - RNA, 21 nt, Artificial Sequence
  Synthetic
uccguguccgugcugcccgcc

SEQ ID NO: 52842 - RNA, 22 nt, Artificial Sequence
  Synthetic
cuccguguccgugcugcccgcc

SEQ ID NO: 52843 - RNA, 23 nt, Artificial Sequence
  Synthetic
ucuccguguccgugcugcccgcc

SEQ ID NO: 52844 - RNA, 24 nt, Artificial Sequence
  Synthetic
aucuccguguccgugcugcccgcc

SEQ ID NO: 52845 - RNA, 18 nt, Artificial Sequence
  Synthetic
cugcccuggcgcucggcc

SEQ ID NO: 52846 - RNA, 19 nt, Artificial Sequence
  Synthetic
gcugcccuggcgcucggcc

SEQ ID NO: 52847 - RNA, 20 nt, Artificial Sequence
  Synthetic
ggcugcccuggcgcucggcc

SEQ ID NO: 52848 - RNA, 21 nt, Artificial Sequence
  Synthetic
gggcugcccuggcgcucggcc

SEQ ID NO: 52849 - RNA, 22 nt, Artificial Sequence
  Synthetic
ggggcugcccuggcgcucggcc

SEQ ID NO: 52850 - RNA, 23 nt, Artificial Sequence
  Synthetic
uggggcugcccuggcgcucggcc

SEQ ID NO: 52851 - RNA, 24 nt, Artificial Sequence
  Synthetic
guggggcugcccuggcgcucggcc

SEQ ID NO: 52852 - RNA, 18 nt, Artificial Sequence
  Synthetic
ucggccgggggccgggcc

SEQ ID NO: 52853 - RNA, 19 nt, Artificial Sequence
  Synthetic
cucggccgggggccgggcc

SEQ ID NO: 52854 - RNA, 20 nt, Artificial Sequence
  Synthetic
gcucggccgggggccgggcc

SEQ ID NO: 52855 - RNA, 21 nt, Artificial Sequence
  Synthetic
cgcucggccgggggccgggcc

SEQ ID NO: 52856 - RNA, 22 nt, Artificial Sequence
  Synthetic
gcgcucggccgggggccgggcc

SEQ ID NO: 52857 - RNA, 23 nt, Artificial Sequence
  Synthetic
ggcgcucggccgggggccgggcc

SEQ ID NO: 52858 - RNA, 24 nt, Artificial Sequence
  Synthetic
uggcgcucggccgggggccgggcc

SEQ ID NO: 52859 - RNA, 18 nt, Artificial Sequence
  Synthetic
cugcuaauuaccgcgagc

SEQ ID NO: 52860 - RNA, 19 nt, Artificial Sequence
  Synthetic
gcugcuaauuaccgcgagc

SEQ ID NO: 52861 - RNA, 20 nt, Artificial Sequence
  Synthetic
agcugcuaauuaccgcgagc

SEQ ID NO: 52862 - RNA, 21 nt, Artificial Sequence
  Synthetic
aagcugcuaauuaccgcgagc

SEQ ID NO: 52863 - RNA, 22 nt, Artificial Sequence
  Synthetic
aaagcugcuaauuaccgcgagc

SEQ ID NO: 52864 - RNA, 23 nt, Artificial Sequence
  Synthetic
aaaagcugcuaauuaccgcgagc

SEQ ID NO: 52865 - RNA, 24 nt, Artificial Sequence
  Synthetic
uaaaagcugcuaauuaccgcgagc

SEQ ID NO: 52866 - RNA, 18 nt, Artificial Sequence
  Synthetic
aguaauuacgcggggagc

SEQ ID NO: 52867 - RNA, 19 nt, Artificial Sequence
  Synthetic
gaguaauuacgcggggagc

SEQ ID NO: 52868 - RNA, 20 nt, Artificial Sequence
  Synthetic
ggaguaauuacgcggggagc

SEQ ID NO: 52869 - RNA, 21 nt, Artificial Sequence
  Synthetic
gggaguaauuacgcggggagc

SEQ ID NO: 52870 - RNA, 22 nt, Artificial Sequence
  Synthetic
agggaguaauuacgcggggagc

SEQ ID NO: 52871 - RNA, 23 nt, Artificial Sequence
  Synthetic
gagggaguaauuacgcggggagc

SEQ ID NO: 52872 - RNA, 24 nt, Artificial Sequence
  Synthetic
cgagggaguaauuacgcggggagc

SEQ ID NO: 52873 - RNA, 18 nt, Artificial Sequence
  Synthetic
ccgagggaguaauuacgc

SEQ ID NO: 52874 - RNA, 19 nt, Artificial Sequence
  Synthetic
cccgagggaguaauuacgc

SEQ ID NO: 52875 - RNA, 20 nt, Artificial Sequence
  Synthetic
ccccgagggaguaauuacgc

SEQ ID NO: 52876 - RNA, 21 nt, Artificial Sequence
  Synthetic
accccgagggaguaauuacgc

SEQ ID NO: 52877 - RNA, 22 nt, Artificial Sequence
  Synthetic
aaccccgagggaguaauuacgc

SEQ ID NO: 52878 - RNA, 23 nt, Artificial Sequence
  Synthetic
gaaccccgagggaguaauuacgc

SEQ ID NO: 52879 - RNA, 24 nt, Artificial Sequence
  Synthetic
ggaaccccgagggaguaauuacgc

SEQ ID NO: 52880 - RNA, 18 nt, Artificial Sequence
  Synthetic
ggaaaacucuggcagcgc

SEQ ID NO: 52881 - RNA, 19 nt, Artificial Sequence
  Synthetic
gggaaaacucuggcagcgc

SEQ ID NO: 52882 - RNA, 20 nt, Artificial Sequence
  Synthetic
agggaaaacucuggcagcgc

SEQ ID NO: 52883 - RNA, 21 nt, Artificial Sequence
  Synthetic
cagggaaaacucuggcagcgc

SEQ ID NO: 52884 - RNA, 22 nt, Artificial Sequence
  Synthetic
gcagggaaaacucuggcagcgc

SEQ ID NO: 52885 - RNA, 23 nt, Artificial Sequence
  Synthetic
ggcagggaaaacucuggcagcgc

SEQ ID NO: 52886 - RNA, 24 nt, Artificial Sequence
  Synthetic
aggcagggaaaacucuggcagcgc

SEQ ID NO: 52887 - RNA, 18 nt, Artificial Sequence
  Synthetic
ccggcgcggggcggucgc

SEQ ID NO: 52888 - RNA, 19 nt, Artificial Sequence
  Synthetic
gccggcgcggggcggucgc

SEQ ID NO: 52889 - RNA, 20 nt, Artificial Sequence
  Synthetic
agccggcgcggggcggucgc

SEQ ID NO: 52890 - RNA, 21 nt, Artificial Sequence
  Synthetic
aagccggcgcggggcggucgc

SEQ ID NO: 52891 - RNA, 22 nt, Artificial Sequence
  Synthetic
gaagccggcgcggggcggucgc

SEQ ID NO: 52892 - RNA, 23 nt, Artificial Sequence
  Synthetic
ggaagccggcgcggggcggucgc

SEQ ID NO: 52893 - RNA, 24 nt, Artificial Sequence
  Synthetic
gggaagccggcgcggggcggucgc

SEQ ID NO: 52894 - RNA, 18 nt, Artificial Sequence
  Synthetic
ugcagaaggggugcaggc

SEQ ID NO: 52895 - RNA, 19 nt, Artificial Sequence
  Synthetic
augcagaaggggugcaggc

SEQ ID NO: 52896 - RNA, 20 nt, Artificial Sequence
  Synthetic
gaugcagaaggggugcaggc

SEQ ID NO: 52897 - RNA, 21 nt, Artificial Sequence
  Synthetic
ggaugcagaaggggugcaggc

SEQ ID NO: 52898 - RNA, 22 nt, Artificial Sequence
  Synthetic
gggaugcagaaggggugcaggc

SEQ ID NO: 52899 - RNA, 23 nt, Artificial Sequence
  Synthetic
cgggaugcagaaggggugcaggc

SEQ ID NO: 52900 - RNA, 24 nt, Artificial Sequence
  Synthetic
acgggaugcagaaggggugcaggc

SEQ ID NO: 52901 - RNA, 18 nt, Artificial Sequence
  Synthetic
ccuagaccgcccgacggc

SEQ ID NO: 52902 - RNA, 19 nt, Artificial Sequence
  Synthetic
cccuagaccgcccgacggc

SEQ ID NO: 52903 - RNA, 20 nt, Artificial Sequence
  Synthetic
acccuagaccgcccgacggc

SEQ ID NO: 52904 - RNA, 21 nt, Artificial Sequence
  Synthetic
aacccuagaccgcccgacggc

SEQ ID NO: 52905 - RNA, 22 nt, Artificial Sequence
  Synthetic
caacccuagaccgcccgacggc

SEQ ID NO: 52906 - RNA, 23 nt, Artificial Sequence
  Synthetic
ucaacccuagaccgcccgacggc

SEQ ID NO: 52907 - RNA, 24 nt, Artificial Sequence
  Synthetic
uucaacccuagaccgcccgacggc

SEQ ID NO: 52908 - RNA, 18 nt, Artificial Sequence
  Synthetic
ccauaccgggaagccggc

SEQ ID NO: 52909 - RNA, 19 nt, Artificial Sequence
  Synthetic
accauaccgggaagccggc

SEQ ID NO: 52910 - RNA, 20 nt, Artificial Sequence
  Synthetic
uaccauaccgggaagccggc

SEQ ID NO: 52911 - RNA, 21 nt, Artificial Sequence
  Synthetic
uuaccauaccgggaagccggc

SEQ ID NO: 52912 - RNA, 22 nt, Artificial Sequence
  Synthetic
auuaccauaccgggaagccggc

SEQ ID NO: 52913 - RNA, 23 nt, Artificial Sequence
  Synthetic
aauuaccauaccgggaagccggc

SEQ ID NO: 52914 - RNA, 24 nt, Artificial Sequence
  Synthetic
uaauuaccauaccgggaagccggc

SEQ ID NO: 52915 - RNA, 18 nt, Artificial Sequence
  Synthetic
augcgcggggauggcggc

SEQ ID NO: 52916 - RNA, 19 nt, Artificial Sequence
  Synthetic
caugcgcggggauggcggc

SEQ ID NO: 52917 - RNA, 20 nt, Artificial Sequence
  Synthetic
ccaugcgcggggauggcggc

SEQ ID NO: 52918 - RNA, 21 nt, Artificial Sequence
  Synthetic
accaugcgcggggauggcggc

SEQ ID NO: 52919 - RNA, 22 nt, Artificial Sequence
  Synthetic
uaccaugcgcggggauggcggc

SEQ ID NO: 52920 - RNA, 23 nt, Artificial Sequence
  Synthetic
uuaccaugcgcggggauggcggc

SEQ ID NO: 52921 - RNA, 24 nt, Artificial Sequence
  Synthetic
auuaccaugcgcggggauggcggc

SEQ ID NO: 52922 - RNA, 18 nt, Artificial Sequence
  Synthetic
gcugcccuggcgcucggc

SEQ ID NO: 52923 - RNA, 19 nt, Artificial Sequence
  Synthetic
ggcugcccuggcgcucggc

SEQ ID NO: 52924 - RNA, 20 nt, Artificial Sequence
  Synthetic
gggcugcccuggcgcucggc

SEQ ID NO: 52925 - RNA, 21 nt, Artificial Sequence
  Synthetic
ggggcugcccuggcgcucggc

SEQ ID NO: 52926 - RNA, 22 nt, Artificial Sequence
  Synthetic
uggggcugcccuggcgcucggc

SEQ ID NO: 52927 - RNA, 23 nt, Artificial Sequence
  Synthetic
guggggcugcccuggcgcucggc

SEQ ID NO: 52928 - RNA, 24 nt, Artificial Sequence
  Synthetic
cguggggcugcccuggcgcucggc

SEQ ID NO: 52929 - RNA, 18 nt, Artificial Sequence
  Synthetic
cucggccgggggccgggc

SEQ ID NO: 52930 - RNA, 19 nt, Artificial Sequence
  Synthetic
gcucggccgggggccgggc

SEQ ID NO: 52931 - RNA, 20 nt, Artificial Sequence
  Synthetic
cgcucggccgggggccgggc

SEQ ID NO: 52932 - RNA, 21 nt, Artificial Sequence
  Synthetic
gcgcucggccgggggccgggc

SEQ ID NO: 52933 - RNA, 22 nt, Artificial Sequence
  Synthetic
ggcgcucggccgggggccgggc

SEQ ID NO: 52934 - RNA, 23 nt, Artificial Sequence
  Synthetic
uggcgcucggccgggggccgggc

SEQ ID NO: 52935 - RNA, 24 nt, Artificial Sequence
  Synthetic
cuggcgcucggccgggggccgggc

SEQ ID NO: 52936 - RNA, 18 nt, Artificial Sequence
  Synthetic
cccugcgcgucggcgggc

SEQ ID NO: 52937 - RNA, 19 nt, Artificial Sequence
  Synthetic
ucccugcgcgucggcgggc

SEQ ID NO: 52938 - RNA, 20 nt, Artificial Sequence
  Synthetic
aucccugcgcgucggcgggc

SEQ ID NO: 52939 - RNA, 21 nt, Artificial Sequence
  Synthetic
gaucccugcgcgucggcgggc

SEQ ID NO: 52940 - RNA, 22 nt, Artificial Sequence
  Synthetic
ggaucccugcgcgucggcgggc

SEQ ID NO: 52941 - RNA, 23 nt, Artificial Sequence
  Synthetic
aggaucccugcgcgucggcgggc

SEQ ID NO: 52942 - RNA, 24 nt, Artificial Sequence
  Synthetic
caggaucccugcgcgucggcgggc

SEQ ID NO: 52943 - RNA, 18 nt, Artificial Sequence
  Synthetic
aguugcuaauuaccaugc

SEQ ID NO: 52944 - RNA, 19 nt, Artificial Sequence
  Synthetic
aaguugcuaauuaccaugc

SEQ ID NO: 52945 - RNA, 20 nt, Artificial Sequence
  Synthetic
aaaguugcuaauuaccaugc

SEQ ID NO: 52946 - RNA, 21 nt, Artificial Sequence
  Synthetic
aaaaguugcuaauuaccaugc

SEQ ID NO: 52947 - RNA, 22 nt, Artificial Sequence
  Synthetic
uaaaaguugcuaauuaccaugc

SEQ ID NO: 52948 - RNA, 23 nt, Artificial Sequence
  Synthetic
uuaaaaguugcuaauuaccaugc

SEQ ID NO: 52949 - RNA, 24 nt, Artificial Sequence
  Synthetic
auuaaaaguugcuaauuaccaugc

SEQ ID NO: 52950 - RNA, 18 nt, Artificial Sequence
  Synthetic
gaauccaggucuucaugc

SEQ ID NO: 52951 - RNA, 19 nt, Artificial Sequence
  Synthetic
ggaauccaggucuucaugc

SEQ ID NO: 52952 - RNA, 20 nt, Artificial Sequence
  Synthetic
cggaauccaggucuucaugc

SEQ ID NO: 52953 - RNA, 21 nt, Artificial Sequence
  Synthetic
acggaauccaggucuucaugc

SEQ ID NO: 52954 - RNA, 22 nt, Artificial Sequence
  Synthetic
aacggaauccaggucuucaugc

SEQ ID NO: 52955 - RNA, 23 nt, Artificial Sequence
  Synthetic
caacggaauccaggucuucaugc

SEQ ID NO: 52956 - RNA, 24 nt, Artificial Sequence
  Synthetic
gcaacggaauccaggucuucaugc

SEQ ID NO: 52957 - RNA, 18 nt, Artificial Sequence
  Synthetic
cgcagaccuucggagcuc

SEQ ID NO: 52958 - RNA, 19 nt, Artificial Sequence
  Synthetic
gcgcagaccuucggagcuc

SEQ ID NO: 52959 - RNA, 20 nt, Artificial Sequence
  Synthetic
cgcgcagaccuucggagcuc

SEQ ID NO: 52960 - RNA, 21 nt, Artificial Sequence
  Synthetic
ucgcgcagaccuucggagcuc

SEQ ID NO: 52961 - RNA, 22 nt, Artificial Sequence
  Synthetic
cucgcgcagaccuucggagcuc

SEQ ID NO: 52962 - RNA, 23 nt, Artificial Sequence
  Synthetic
ccucgcgcagaccuucggagcuc

SEQ ID NO: 52963 - RNA, 24 nt, Artificial Sequence
  Synthetic
gccucgcgcagaccuucggagcuc

SEQ ID NO: 52964 - RNA, 18 nt, Artificial Sequence
  Synthetic
guuuuuaauuaccauaag

SEQ ID NO: 52965 - RNA, 19 nt, Artificial Sequence
  Synthetic
cguuuuuaauuaccauaag

SEQ ID NO: 52966 - RNA, 20 nt, Artificial Sequence
  Synthetic
acguuuuuaauuaccauaag

SEQ ID NO: 52967 - RNA, 21 nt, Artificial Sequence
  Synthetic
aacguuuuuaauuaccauaag

SEQ ID NO: 52968 - RNA, 22 nt, Artificial Sequence
  Synthetic
gaacguuuuuaauuaccauaag

SEQ ID NO: 52969 - RNA, 23 nt, Artificial Sequence
  Synthetic
cgaacguuuuuaauuaccauaag

SEQ ID NO: 52970 - RNA, 24 nt, Artificial Sequence
  Synthetic
ccgaacguuuuuaauuaccauaag

SEQ ID NO: 52971 - RNA, 18 nt, Artificial Sequence
  Synthetic
uucaugcacgggaugcag

SEQ ID NO: 52972 - RNA, 19 nt, Artificial Sequence
  Synthetic
cuucaugcacgggaugcag

SEQ ID NO: 52973 - RNA, 20 nt, Artificial Sequence
  Synthetic
ucuucaugcacgggaugcag

SEQ ID NO: 52974 - RNA, 21 nt, Artificial Sequence
  Synthetic
gucuucaugcacgggaugcag

SEQ ID NO: 52975 - RNA, 22 nt, Artificial Sequence
  Synthetic
ggucuucaugcacgggaugcag

SEQ ID NO: 52976 - RNA, 23 nt, Artificial Sequence
  Synthetic
aggucuucaugcacgggaugcag

SEQ ID NO: 52977 - RNA, 24 nt, Artificial Sequence
  Synthetic
caggucuucaugcacgggaugcag

SEQ ID NO: 52978 - RNA, 18 nt, Artificial Sequence
  Synthetic
gcugcuaauuaccgcgag

SEQ ID NO: 52979 - RNA, 19 nt, Artificial Sequence
  Synthetic
agcugcuaauuaccgcgag

SEQ ID NO: 52980 - RNA, 20 nt, Artificial Sequence
  Synthetic
aagcugcuaauuaccgcgag

SEQ ID NO: 52981 - RNA, 21 nt, Artificial Sequence
  Synthetic
aaagcugcuaauuaccgcgag

SEQ ID NO: 52982 - RNA, 22 nt, Artificial Sequence
  Synthetic
aaaagcugcuaauuaccgcgag

SEQ ID NO: 52983 - RNA, 23 nt, Artificial Sequence
  Synthetic
uaaaagcugcuaauuaccgcgag

SEQ ID NO: 52984 - RNA, 24 nt, Artificial Sequence
  Synthetic
uuaaaagcugcuaauuaccgcgag

SEQ ID NO: 52985 - RNA, 18 nt, Artificial Sequence
  Synthetic
gugcugcccgccucggag

SEQ ID NO: 52986 - RNA, 19 nt, Artificial Sequence
  Synthetic
cgugcugcccgccucggag

SEQ ID NO: 52987 - RNA, 20 nt, Artificial Sequence
  Synthetic
ccgugcugcccgccucggag

SEQ ID NO: 52988 - RNA, 21 nt, Artificial Sequence
  Synthetic
uccgugcugcccgccucggag

SEQ ID NO: 52989 - RNA, 22 nt, Artificial Sequence
  Synthetic
guccgugcugcccgccucggag

SEQ ID NO: 52990 - RNA, 23 nt, Artificial Sequence
  Synthetic
uguccgugcugcccgccucggag

SEQ ID NO: 52991 - RNA, 24 nt, Artificial Sequence
  Synthetic
guguccgugcugcccgccucggag

SEQ ID NO: 52992 - RNA, 18 nt, Artificial Sequence
  Synthetic
cccucgcggauauauacg

SEQ ID NO: 52993 - RNA, 19 nt, Artificial Sequence
  Synthetic
gcccucgcggauauauacg

SEQ ID NO: 52994 - RNA, 20 nt, Artificial Sequence
  Synthetic
ggcccucgcggauauauacg

SEQ ID NO: 52995 - RNA, 21 nt, Artificial Sequence
  Synthetic
gggcccucgcggauauauacg

SEQ ID NO: 52996 - RNA, 22 nt, Artificial Sequence
  Synthetic
cgggcccucgcggauauauacg

SEQ ID NO: 52997 - RNA, 23 nt, Artificial Sequence
  Synthetic
ccgggcccucgcggauauauacg

SEQ ID NO: 52998 - RNA, 24 nt, Artificial Sequence
  Synthetic
gccgggcccucgcggauauauacg

SEQ ID NO: 52999 - RNA, 18 nt, Artificial Sequence
  Synthetic
cccgagggaguaauuacg

SEQ ID NO: 53000 - RNA, 19 nt, Artificial Sequence
  Synthetic
ccccgagggaguaauuacg

SEQ ID NO: 53001 - RNA, 20 nt, Artificial Sequence
  Synthetic
accccgagggaguaauuacg

SEQ ID NO: 53002 - RNA, 21 nt, Artificial Sequence
  Synthetic
aaccccgagggaguaauuacg

SEQ ID NO: 53003 - RNA, 22 nt, Artificial Sequence
  Synthetic
gaaccccgagggaguaauuacg

SEQ ID NO: 53004 - RNA, 23 nt, Artificial Sequence
  Synthetic
ggaaccccgagggaguaauuacg

SEQ ID NO: 53005 - RNA, 24 nt, Artificial Sequence
  Synthetic
cggaaccccgagggaguaauuacg

SEQ ID NO: 53006 - RNA, 18 nt, Artificial Sequence
  Synthetic
gggaaaacucuggcagcg

SEQ ID NO: 53007 - RNA, 19 nt, Artificial Sequence
  Synthetic
agggaaaacucuggcagcg

SEQ ID NO: 53008 - RNA, 20 nt, Artificial Sequence
  Synthetic
cagggaaaacucuggcagcg

SEQ ID NO: 53009 - RNA, 21 nt, Artificial Sequence
  Synthetic
gcagggaaaacucuggcagcg

SEQ ID NO: 53010 - RNA, 22 nt, Artificial Sequence
  Synthetic
ggcagggaaaacucuggcagcg

SEQ ID NO: 53011 - RNA, 23 nt, Artificial Sequence
  Synthetic
aggcagggaaaacucuggcagcg

SEQ ID NO: 53012 - RNA, 24 nt, Artificial Sequence
  Synthetic
caggcagggaaaacucuggcagcg

SEQ ID NO: 53013 - RNA, 18 nt, Artificial Sequence
  Synthetic
ccuggggcgggcggagcg

SEQ ID NO: 53014 - RNA, 19 nt, Artificial Sequence
  Synthetic
cccuggggcgggcggagcg

SEQ ID NO: 53015 - RNA, 20 nt, Artificial Sequence
  Synthetic
ccccuggggcgggcggagcg

SEQ ID NO: 53016 - RNA, 21 nt, Artificial Sequence
  Synthetic
cccccuggggcgggcggagcg

SEQ ID NO: 53017 - RNA, 22 nt, Artificial Sequence
  Synthetic
gcccccuggggcgggcggagcg

SEQ ID NO: 53018 - RNA, 23 nt, Artificial Sequence
  Synthetic
cgcccccuggggcgggcggagcg

SEQ ID NO: 53019 - RNA, 24 nt, Artificial Sequence
  Synthetic
ccgcccccuggggcgggcggagcg

SEQ ID NO: 53020 - RNA, 18 nt, Artificial Sequence
  Synthetic
guaauuacgcggggagcg

SEQ ID NO: 53021 - RNA, 19 nt, Artificial Sequence
  Synthetic
aguaauuacgcggggagcg

SEQ ID NO: 53022 - RNA, 20 nt, Artificial Sequence
  Synthetic
gaguaauuacgcggggagcg

SEQ ID NO: 53023 - RNA, 21 nt, Artificial Sequence
  Synthetic
ggaguaauuacgcggggagcg

SEQ ID NO: 53024 - RNA, 22 nt, Artificial Sequence
  Synthetic
gggaguaauuacgcggggagcg

SEQ ID NO: 53025 - RNA, 23 nt, Artificial Sequence
  Synthetic
agggaguaauuacgcggggagcg

SEQ ID NO: 53026 - RNA, 24 nt, Artificial Sequence
  Synthetic
gagggaguaauuacgcggggagcg

SEQ ID NO: 53027 - RNA, 18 nt, Artificial Sequence
  Synthetic
cgagggaguaauuacgcg

SEQ ID NO: 53028 - RNA, 19 nt, Artificial Sequence
  Synthetic
ccgagggaguaauuacgcg

SEQ ID NO: 53029 - RNA, 20 nt, Artificial Sequence
  Synthetic
cccgagggaguaauuacgcg

SEQ ID NO: 53030 - RNA, 21 nt, Artificial Sequence
  Synthetic
ccccgagggaguaauuacgcg

SEQ ID NO: 53031 - RNA, 22 nt, Artificial Sequence
  Synthetic
accccgagggaguaauuacgcg

SEQ ID NO: 53032 - RNA, 23 nt, Artificial Sequence
  Synthetic
aaccccgagggaguaauuacgcg

SEQ ID NO: 53033 - RNA, 24 nt, Artificial Sequence
  Synthetic
gaaccccgagggaguaauuacgcg

SEQ ID NO: 53034 - RNA, 18 nt, Artificial Sequence
  Synthetic
cucggagguggagucgcg

SEQ ID NO: 53035 - RNA, 19 nt, Artificial Sequence
  Synthetic
ccucggagguggagucgcg

SEQ ID NO: 53036 - RNA, 20 nt, Artificial Sequence
  Synthetic
gccucggagguggagucgcg

SEQ ID NO: 53037 - RNA, 21 nt, Artificial Sequence
  Synthetic
cgccucggagguggagucgcg

SEQ ID NO: 53038 - RNA, 22 nt, Artificial Sequence
  Synthetic
ccgccucggagguggagucgcg

SEQ ID NO: 53039 - RNA, 23 nt, Artificial Sequence
  Synthetic
cccgccucggagguggagucgcg

SEQ ID NO: 53040 - RNA, 24 nt, Artificial Sequence
  Synthetic
gcccgccucggagguggagucgcg

SEQ ID NO: 53041 - RNA, 18 nt, Artificial Sequence
  Synthetic
cauaccgggaagccggcg

SEQ ID NO: 53042 - RNA, 19 nt, Artificial Sequence
  Synthetic
ccauaccgggaagccggcg

SEQ ID NO: 53043 - RNA, 20 nt, Artificial Sequence
  Synthetic
accauaccgggaagccggcg

SEQ ID NO: 53044 - RNA, 21 nt, Artificial Sequence
  Synthetic
uaccauaccgggaagccggcg

SEQ ID NO: 53045 - RNA, 22 nt, Artificial Sequence
  Synthetic
uuaccauaccgggaagccggcg

SEQ ID NO: 53046 - RNA, 23 nt, Artificial Sequence
  Synthetic
auuaccauaccgggaagccggcg

SEQ ID NO: 53047 - RNA, 24 nt, Artificial Sequence
  Synthetic
aauuaccauaccgggaagccggcg

SEQ ID NO: 53048 - RNA, 18 nt, Artificial Sequence
  Synthetic
cggcccgggcccgcggcg

SEQ ID NO: 53049 - RNA, 19 nt, Artificial Sequence
  Synthetic
acggcccgggcccgcggcg

SEQ ID NO: 53050 - RNA, 20 nt, Artificial Sequence
  Synthetic
gacggcccgggcccgcggcg

SEQ ID NO: 53051 - RNA, 21 nt, Artificial Sequence
  Synthetic
cgacggcccgggcccgcggcg

SEQ ID NO: 53052 - RNA, 22 nt, Artificial Sequence
  Synthetic
ccgacggcccgggcccgcggcg

SEQ ID NO: 53053 - RNA, 23 nt, Artificial Sequence
  Synthetic
cccgacggcccgggcccgcggcg

SEQ ID NO: 53054 - RNA, 24 nt, Artificial Sequence
  Synthetic
gcccgacggcccgggcccgcggcg

SEQ ID NO: 53055 - RNA, 18 nt, Artificial Sequence
  Synthetic
cccgggcccgcggcggcg

SEQ ID NO: 53056 - RNA, 19 nt, Artificial Sequence
  Synthetic
gcccgggcccgcggcggcg

SEQ ID NO: 53057 - RNA, 20 nt, Artificial Sequence
  Synthetic
ggcccgggcccgcggcggcg

SEQ ID NO: 53058 - RNA, 21 nt, Artificial Sequence
  Synthetic
cggcccgggcccgcggcggcg

SEQ ID NO: 53059 - RNA, 22 nt, Artificial Sequence
  Synthetic
acggcccgggcccgcggcggcg

SEQ ID NO: 53060 - RNA, 23 nt, Artificial Sequence
  Synthetic
gacggcccgggcccgcggcggcg

SEQ ID NO: 53061 - RNA, 24 nt, Artificial Sequence
  Synthetic
cgacggcccgggcccgcggcggcg

SEQ ID NO: 53062 - RNA, 18 nt, Artificial Sequence
  Synthetic
cggagcggcggggcggcg

SEQ ID NO: 53063 - RNA, 19 nt, Artificial Sequence
  Synthetic
gcggagcggcggggcggcg

SEQ ID NO: 53064 - RNA, 20 nt, Artificial Sequence
  Synthetic
ggcggagcggcggggcggcg

SEQ ID NO: 53065 - RNA, 21 nt, Artificial Sequence
  Synthetic
gggcggagcggcggggcggcg

SEQ ID NO: 53066 - RNA, 22 nt, Artificial Sequence
  Synthetic
cgggcggagcggcggggcggcg

SEQ ID NO: 53067 - RNA, 23 nt, Artificial Sequence
  Synthetic
gcgggcggagcggcggggcggcg

SEQ ID NO: 53068 - RNA, 24 nt, Artificial Sequence
  Synthetic
ggcgggcggagcggcggggcggcg

SEQ ID NO: 53069 - RNA, 18 nt, Artificial Sequence
  Synthetic
ccugcgcgucggcgggcg

SEQ ID NO: 53070 - RNA, 19 nt, Artificial Sequence
  Synthetic
cccugcgcgucggcgggcg

SEQ ID NO: 53071 - RNA, 20 nt, Artificial Sequence
  Synthetic
ucccugcgcgucggcgggcg

SEQ ID NO: 53072 - RNA, 21 nt, Artificial Sequence
  Synthetic
aucccugcgcgucggcgggcg

SEQ ID NO: 53073 - RNA, 22 nt, Artificial Sequence
  Synthetic
gaucccugcgcgucggcgggcg

SEQ ID NO: 53074 - RNA, 23 nt, Artificial Sequence
  Synthetic
ggaucccugcgcgucggcgggcg

SEQ ID NO: 53075 - RNA, 24 nt, Artificial Sequence
  Synthetic
aggaucccugcgcgucggcgggcg

SEQ ID NO: 53076 - RNA, 18 nt, Artificial Sequence
  Synthetic
guugcuaauuaccaugcg

SEQ ID NO: 53077 - RNA, 19 nt, Artificial Sequence
  Synthetic
aguugcuaauuaccaugcg

SEQ ID NO: 53078 - RNA, 20 nt, Artificial Sequence
  Synthetic
aaguugcuaauuaccaugcg

SEQ ID NO: 53079 - RNA, 21 nt, Artificial Sequence
  Synthetic
aaaguugcuaauuaccaugcg

SEQ ID NO: 53080 - RNA, 22 nt, Artificial Sequence
  Synthetic
aaaaguugcuaauuaccaugcg

SEQ ID NO: 53081 - RNA, 23 nt, Artificial Sequence
  Synthetic
uaaaaguugcuaauuaccaugcg

SEQ ID NO: 53082 - RNA, 24 nt, Artificial Sequence
  Synthetic
uuaaaaguugcuaauuaccaugcg

SEQ ID NO: 53083 - RNA, 18 nt, Artificial Sequence
  Synthetic
caggaucccugcgcgucg

SEQ ID NO: 53084 - RNA, 19 nt, Artificial Sequence
  Synthetic
gcaggaucccugcgcgucg

SEQ ID NO: 53085 - RNA, 20 nt, Artificial Sequence
  Synthetic
cgcaggaucccugcgcgucg

SEQ ID NO: 53086 - RNA, 21 nt, Artificial Sequence
  Synthetic
ccgcaggaucccugcgcgucg

SEQ ID NO: 53087 - RNA, 22 nt, Artificial Sequence
  Synthetic
cccgcaggaucccugcgcgucg

SEQ ID NO: 53088 - RNA, 23 nt, Artificial Sequence
  Synthetic
ccccgcaggaucccugcgcgucg

SEQ ID NO: 53089 - RNA, 24 nt, Artificial Sequence
  Synthetic
cccccgcaggaucccugcgcgucg

SEQ ID NO: 53090 - RNA, 18 nt, Artificial Sequence
  Synthetic
gccggcgcggggcggucg

SEQ ID NO: 53091 - RNA, 19 nt, Artificial Sequence
  Synthetic
agccggcgcggggcggucg

SEQ ID NO: 53092 - RNA, 20 nt, Artificial Sequence
  Synthetic
aagccggcgcggggcggucg

SEQ ID NO: 53093 - RNA, 21 nt, Artificial Sequence
  Synthetic
gaagccggcgcggggcggucg

SEQ ID NO: 53094 - RNA, 22 nt, Artificial Sequence
  Synthetic
ggaagccggcgcggggcggucg

SEQ ID NO: 53095 - RNA, 23 nt, Artificial Sequence
  Synthetic
gggaagccggcgcggggcggucg

SEQ ID NO: 53096 - RNA, 24 nt, Artificial Sequence
  Synthetic
cgggaagccggcgcggggcggucg

SEQ ID NO: 53097 - RNA, 18 nt, Artificial Sequence
  Synthetic
gcgagccacugcaugucg

SEQ ID NO: 53098 - RNA, 19 nt, Artificial Sequence
  Synthetic
ggcgagccacugcaugucg

SEQ ID NO: 53099 - RNA, 20 nt, Artificial Sequence
  Synthetic
uggcgagccacugcaugucg

SEQ ID NO: 53100 - RNA, 21 nt, Artificial Sequence
  Synthetic
cuggcgagccacugcaugucg

SEQ ID NO: 53101 - RNA, 22 nt, Artificial Sequence
  Synthetic
gcuggcgagccacugcaugucg

SEQ ID NO: 53102 - RNA, 23 nt, Artificial Sequence
  Synthetic
ugcuggcgagccacugcaugucg

SEQ ID NO: 53103 - RNA, 24 nt, Artificial Sequence
  Synthetic
cugcuggcgagccacugcaugucg

SEQ ID NO: 53104 - RNA, 18 nt, Artificial Sequence
  Synthetic
gcucccaucgucucuucg

SEQ ID NO: 53105 - RNA, 19 nt, Artificial Sequence
  Synthetic
ggcucccaucgucucuucg

SEQ ID NO: 53106 - RNA, 20 nt, Artificial Sequence
  Synthetic
gggcucccaucgucucuucg

SEQ ID NO: 53107 - RNA, 21 nt, Artificial Sequence
  Synthetic
ggggcucccaucgucucuucg

SEQ ID NO: 53108 - RNA, 22 nt, Artificial Sequence
  Synthetic
cggggcucccaucgucucuucg

SEQ ID NO: 53109 - RNA, 23 nt, Artificial Sequence
  Synthetic
gcggggcucccaucgucucuucg

SEQ ID NO: 53110 - RNA, 24 nt, Artificial Sequence
  Synthetic
cgcggggcucccaucgucucuucg

SEQ ID NO: 53111 - RNA, 18 nt, Artificial Sequence
  Synthetic
augcagaaggggugcagg

SEQ ID NO: 53112 - RNA, 19 nt, Artificial Sequence
  Synthetic
gaugcagaaggggugcagg

SEQ ID NO: 53113 - RNA, 20 nt, Artificial Sequence
  Synthetic
ggaugcagaaggggugcagg

SEQ ID NO: 53114 - RNA, 21 nt, Artificial Sequence
  Synthetic
gggaugcagaaggggugcagg

SEQ ID NO: 53115 - RNA, 22 nt, Artificial Sequence
  Synthetic
cgggaugcagaaggggugcagg

SEQ ID NO: 53116 - RNA, 23 nt, Artificial Sequence
  Synthetic
acgggaugcagaaggggugcagg

SEQ ID NO: 53117 - RNA, 24 nt, Artificial Sequence
  Synthetic
cacgggaugcagaaggggugcagg

SEQ ID NO: 53118 - RNA, 18 nt, Artificial Sequence
  Synthetic
gcuccggggcuccgccgg

SEQ ID NO: 53119 - RNA, 19 nt, Artificial Sequence
  Synthetic
agcuccggggcuccgccgg

SEQ ID NO: 53120 - RNA, 20 nt, Artificial Sequence
  Synthetic
gagcuccggggcuccgccgg

SEQ ID NO: 53121 - RNA, 21 nt, Artificial Sequence
  Synthetic
ggagcuccggggcuccgccgg

SEQ ID NO: 53122 - RNA, 22 nt, Artificial Sequence
  Synthetic
cggagcuccggggcuccgccgg

SEQ ID NO: 53123 - RNA, 23 nt, Artificial Sequence
  Synthetic
ucggagcuccggggcuccgccgg

SEQ ID NO: 53124 - RNA, 24 nt, Artificial Sequence
  Synthetic
uucggagcuccggggcuccgccgg

SEQ ID NO: 53125 - RNA, 18 nt, Artificial Sequence
  Synthetic
cuggggcgggcggagcgg

SEQ ID NO: 53126 - RNA, 19 nt, Artificial Sequence
  Synthetic
ccuggggcgggcggagcgg

SEQ ID NO: 53127 - RNA, 20 nt, Artificial Sequence
  Synthetic
cccuggggcgggcggagcgg

SEQ ID NO: 53128 - RNA, 21 nt, Artificial Sequence
  Synthetic
ccccuggggcgggcggagcgg

SEQ ID NO: 53129 - RNA, 22 nt, Artificial Sequence
  Synthetic
cccccuggggcgggcggagcgg

SEQ ID NO: 53130 - RNA, 23 nt, Artificial Sequence
  Synthetic
gcccccuggggcgggcggagcgg

SEQ ID NO: 53131 - RNA, 24 nt, Artificial Sequence
  Synthetic
cgcccccuggggcgggcggagcgg

SEQ ID NO: 53132 - RNA, 18 nt, Artificial Sequence
  Synthetic
ggcccgggcccgcggcgg

SEQ ID NO: 53133 - RNA, 19 nt, Artificial Sequence
  Synthetic
cggcccgggcccgcggcgg

SEQ ID NO: 53134 - RNA, 20 nt, Artificial Sequence
  Synthetic
acggcccgggcccgcggcgg

SEQ ID NO: 53135 - RNA, 21 nt, Artificial Sequence
  Synthetic
gacggcccgggcccgcggcgg

SEQ ID NO: 53136 - RNA, 22 nt, Artificial Sequence
  Synthetic
cgacggcccgggcccgcggcgg

SEQ ID NO: 53137 - RNA, 23 nt, Artificial Sequence
  Synthetic
ccgacggcccgggcccgcggcgg

SEQ ID NO: 53138 - RNA, 24 nt, Artificial Sequence
  Synthetic
cccgacggcccgggcccgcggcgg

SEQ ID NO: 53139 - RNA, 18 nt, Artificial Sequence
  Synthetic
cgccgcccccuggggcgg

SEQ ID NO: 53140 - RNA, 19 nt, Artificial Sequence
  Synthetic
gcgccgcccccuggggcgg

SEQ ID NO: 53141 - RNA, 20 nt, Artificial Sequence
  Synthetic
ggcgccgcccccuggggcgg

SEQ ID NO: 53142 - RNA, 21 nt, Artificial Sequence
  Synthetic
cggcgccgcccccuggggcgg

SEQ ID NO: 53143 - RNA, 22 nt, Artificial Sequence
  Synthetic
ccggcgccgcccccuggggcgg

SEQ ID NO: 53144 - RNA, 23 nt, Artificial Sequence
  Synthetic
gccggcgccgcccccuggggcgg

SEQ ID NO: 53145 - RNA, 24 nt, Artificial Sequence
  Synthetic
ggccggcgccgcccccuggggcgg

SEQ ID NO: 53146 - RNA, 18 nt, Artificial Sequence
  Synthetic
caugcgcggggauggcgg

SEQ ID NO: 53147 - RNA, 19 nt, Artificial Sequence
  Synthetic
ccaugcgcggggauggcgg

SEQ ID NO: 53148 - RNA, 20 nt, Artificial Sequence
  Synthetic
accaugcgcggggauggcgg

SEQ ID NO: 53149 - RNA, 21 nt, Artificial Sequence
  Synthetic
uaccaugcgcggggauggcgg

SEQ ID NO: 53150 - RNA, 22 nt, Artificial Sequence
  Synthetic
uuaccaugcgcggggauggcgg

SEQ ID NO: 53151 - RNA, 23 nt, Artificial Sequence
  Synthetic
auuaccaugcgcggggauggcgg

SEQ ID NO: 53152 - RNA, 24 nt, Artificial Sequence
  Synthetic
aauuaccaugcgcggggauggcgg

SEQ ID NO: 53153 - RNA, 18 nt, Artificial Sequence
  Synthetic
ggcugcccuggcgcucgg

SEQ ID NO: 53154 - RNA, 19 nt, Artificial Sequence
  Synthetic
gggcugcccuggcgcucgg

SEQ ID NO: 53155 - RNA, 20 nt, Artificial Sequence
  Synthetic
ggggcugcccuggcgcucgg

SEQ ID NO: 53156 - RNA, 21 nt, Artificial Sequence
  Synthetic
uggggcugcccuggcgcucgg

SEQ ID NO: 53157 - RNA, 22 nt, Artificial Sequence
  Synthetic
guggggcugcccuggcgcucgg

SEQ ID NO: 53158 - RNA, 23 nt, Artificial Sequence
  Synthetic
cguggggcugcccuggcgcucgg

SEQ ID NO: 53159 - RNA, 24 nt, Artificial Sequence
  Synthetic
gcguggggcugcccuggcgcucgg

SEQ ID NO: 53160 - RNA, 18 nt, Artificial Sequence
  Synthetic
aacucuggcagcgcaggg

SEQ ID NO: 53161 - RNA, 19 nt, Artificial Sequence
  Synthetic
aaacucuggcagcgcaggg

SEQ ID NO: 53162 - RNA, 20 nt, Artificial Sequence
  Synthetic
aaaacucuggcagcgcaggg

SEQ ID NO: 53163 - RNA, 21 nt, Artificial Sequence
  Synthetic
gaaaacucuggcagcgcaggg

SEQ ID NO: 53164 - RNA, 22 nt, Artificial Sequence
  Synthetic
ggaaaacucuggcagcgcaggg

SEQ ID NO: 53165 - RNA, 23 nt, Artificial Sequence
  Synthetic
gggaaaacucuggcagcgcaggg

SEQ ID NO: 53166 - RNA, 24 nt, Artificial Sequence
  Synthetic
agggaaaacucuggcagcgcaggg

SEQ ID NO: 53167 - RNA, 18 nt, Artificial Sequence
  Synthetic
cgcggggcggucgccggg

SEQ ID NO: 53168 - RNA, 19 nt, Artificial Sequence
  Synthetic
gcgcggggcggucgccggg

SEQ ID NO: 53169 - RNA, 20 nt, Artificial Sequence
  Synthetic
ggcgcggggcggucgccggg

SEQ ID NO: 53170 - RNA, 21 nt, Artificial Sequence
  Synthetic
cggcgcggggcggucgccggg

SEQ ID NO: 53171 - RNA, 22 nt, Artificial Sequence
  Synthetic
ccggcgcggggcggucgccggg

SEQ ID NO: 53172 - RNA, 23 nt, Artificial Sequence
  Synthetic
gccggcgcggggcggucgccggg

SEQ ID NO: 53173 - RNA, 24 nt, Artificial Sequence
  Synthetic
agccggcgcggggcggucgccggg

SEQ ID NO: 53174 - RNA, 18 nt, Artificial Sequence
  Synthetic
gcucggccgggggccggg

SEQ ID NO: 53175 - RNA, 19 nt, Artificial Sequence
  Synthetic
cgcucggccgggggccggg

SEQ ID NO: 53176 - RNA, 20 nt, Artificial Sequence
  Synthetic
gcgcucggccgggggccggg

SEQ ID NO: 53177 - RNA, 21 nt, Artificial Sequence
  Synthetic
ggcgcucggccgggggccggg

SEQ ID NO: 53178 - RNA, 22 nt, Artificial Sequence
  Synthetic
uggcgcucggccgggggccggg

SEQ ID NO: 53179 - RNA, 23 nt, Artificial Sequence
  Synthetic
cuggcgcucggccgggggccggg

SEQ ID NO: 53180 - RNA, 24 nt, Artificial Sequence
  Synthetic
ccuggcgcucggccgggggccggg

SEQ ID NO: 53181 - RNA, 18 nt, Artificial Sequence
  Synthetic
gccgcccccuggggcggg

SEQ ID NO: 53182 - RNA, 19 nt, Artificial Sequence
  Synthetic
cgccgcccccuggggcggg

SEQ ID NO: 53183 - RNA, 20 nt, Artificial Sequence
  Synthetic
gcgccgcccccuggggcggg

SEQ ID NO: 53184 - RNA, 21 nt, Artificial Sequence
  Synthetic
ggcgccgcccccuggggcggg

SEQ ID NO: 53185 - RNA, 22 nt, Artificial Sequence
  Synthetic
cggcgccgcccccuggggcggg

SEQ ID NO: 53186 - RNA, 23 nt, Artificial Sequence
  Synthetic
ccggcgccgcccccuggggcggg

SEQ ID NO: 53187 - RNA, 24 nt, Artificial Sequence
  Synthetic
gccggcgccgcccccuggggcggg

SEQ ID NO: 53188 - RNA, 18 nt, Artificial Sequence
  Synthetic
acucuggcagcgcagggg

SEQ ID NO: 53189 - RNA, 19 nt, Artificial Sequence
  Synthetic
aacucuggcagcgcagggg

SEQ ID NO: 53190 - RNA, 20 nt, Artificial Sequence
  Synthetic
aaacucuggcagcgcagggg

SEQ ID NO: 53191 - RNA, 21 nt, Artificial Sequence
  Synthetic
aaaacucuggcagcgcagggg

SEQ ID NO: 53192 - RNA, 22 nt, Artificial Sequence
  Synthetic
gaaaacucuggcagcgcagggg

SEQ ID NO: 53193 - RNA, 23 nt, Artificial Sequence
  Synthetic
ggaaaacucuggcagcgcagggg

SEQ ID NO: 53194 - RNA, 24 nt, Artificial Sequence
  Synthetic
gggaaaacucuggcagcgcagggg

SEQ ID NO: 53195 - RNA, 18 nt, Artificial Sequence
  Synthetic
cuggcgcucggccggggg

SEQ ID NO: 53196 - RNA, 19 nt, Artificial Sequence
  Synthetic
ccuggcgcucggccggggg

SEQ ID NO: 53197 - RNA, 20 nt, Artificial Sequence
  Synthetic
cccuggcgcucggccggggg

SEQ ID NO: 53198 - RNA, 21 nt, Artificial Sequence
  Synthetic
gcccuggcgcucggccggggg

SEQ ID NO: 53199 - RNA, 22 nt, Artificial Sequence
  Synthetic
ugcccuggcgcucggccggggg

SEQ ID NO: 53200 - RNA, 23 nt, Artificial Sequence
  Synthetic
cugcccuggcgcucggccggggg

SEQ ID NO: 53201 - RNA, 24 nt, Artificial Sequence
  Synthetic
gcugcccuggcgcucggccggggg

SEQ ID NO: 53202 - RNA, 18 nt, Artificial Sequence
  Synthetic
ccggcgccgcccccuggg

SEQ ID NO: 53203 - RNA, 19 nt, Artificial Sequence
  Synthetic
gccggcgccgcccccuggg

SEQ ID NO: 53204 - RNA, 20 nt, Artificial Sequence
  Synthetic
ggccggcgccgcccccuggg

SEQ ID NO: 53205 - RNA, 21 nt, Artificial Sequence
  Synthetic
uggccggcgccgcccccuggg

SEQ ID NO: 53206 - RNA, 22 nt, Artificial Sequence
  Synthetic
uuggccggcgccgcccccuggg

SEQ ID NO: 53207 - RNA, 23 nt, Artificial Sequence
  Synthetic
guuggccggcgccgcccccuggg

SEQ ID NO: 53208 - RNA, 24 nt, Artificial Sequence
  Synthetic
gguuggccggcgccgcccccuggg

SEQ ID NO: 53209 - RNA, 18 nt, Artificial Sequence
  Synthetic
gucuucaugcacgggaug

SEQ ID NO: 53210 - RNA, 19 nt, Artificial Sequence
  Synthetic
ggucuucaugcacgggaug

SEQ ID NO: 53211 - RNA, 20 nt, Artificial Sequence
  Synthetic
aggucuucaugcacgggaug

SEQ ID NO: 53212 - RNA, 21 nt, Artificial Sequence
  Synthetic
caggucuucaugcacgggaug

SEQ ID NO: 53213 - RNA, 22 nt, Artificial Sequence
  Synthetic
ccaggucuucaugcacgggaug

SEQ ID NO: 53214 - RNA, 23 nt, Artificial Sequence
  Synthetic
uccaggucuucaugcacgggaug

SEQ ID NO: 53215 - RNA, 24 nt, Artificial Sequence
  Synthetic
auccaggucuucaugcacgggaug

SEQ ID NO: 53216 - RNA, 18 nt, Artificial Sequence
  Synthetic
uccuccgagucgcugcug

SEQ ID NO: 53217 - RNA, 19 nt, Artificial Sequence
  Synthetic
cuccuccgagucgcugcug

SEQ ID NO: 53218 - RNA, 20 nt, Artificial Sequence
  Synthetic
ccuccuccgagucgcugcug

SEQ ID NO: 53219 - RNA, 21 nt, Artificial Sequence
  Synthetic
uccuccuccgagucgcugcug

SEQ ID NO: 53220 - RNA, 22 nt, Artificial Sequence
  Synthetic
cuccuccuccgagucgcugcug

SEQ ID NO: 53221 - RNA, 23 nt, Artificial Sequence
  Synthetic
ucuccuccuccgagucgcugcug

SEQ ID NO: 53222 - RNA, 24 nt, Artificial Sequence
  Synthetic
gucuccuccuccgagucgcugcug

SEQ ID NO: 53223 - RNA, 18 nt, Artificial Sequence
  Synthetic
uucacuaucgggauggug

SEQ ID NO: 53224 - RNA, 19 nt, Artificial Sequence
  Synthetic
guucacuaucgggauggug

SEQ ID NO: 53225 - RNA, 20 nt, Artificial Sequence
  Synthetic
cguucacuaucgggauggug

SEQ ID NO: 53226 - RNA, 21 nt, Artificial Sequence
  Synthetic
ucguucacuaucgggauggug

SEQ ID NO: 53227 - RNA, 22 nt, Artificial Sequence
  Synthetic
gucguucacuaucgggauggug

SEQ ID NO: 53228 - RNA, 23 nt, Artificial Sequence
  Synthetic
ggucguucacuaucgggauggug

SEQ ID NO: 53229 - RNA, 24 nt, Artificial Sequence
  Synthetic
gggucguucacuaucgggauggug

SEQ ID NO: 53230 - RNA, 18 nt, Artificial Sequence
  Synthetic
gcggccucgcgcagaccu

SEQ ID NO: 53231 - RNA, 19 nt, Artificial Sequence
  Synthetic
agcggccucgcgcagaccu

SEQ ID NO: 53232 - RNA, 20 nt, Artificial Sequence
  Synthetic
gagcggccucgcgcagaccu

SEQ ID NO: 53233 - RNA, 21 nt, Artificial Sequence
  Synthetic
agagcggccucgcgcagaccu

SEQ ID NO: 53234 - RNA, 22 nt, Artificial Sequence
  Synthetic
gagagcggccucgcgcagaccu

SEQ ID NO: 53235 - RNA, 23 nt, Artificial Sequence
  Synthetic
ggagagcggccucgcgcagaccu

SEQ ID NO: 53236 - RNA, 24 nt, Artificial Sequence
  Synthetic
cggagagcggccucgcgcagaccu

SEQ ID NO: 53237 - RNA, 18 nt, Artificial Sequence
  Synthetic
uguccgugcugcccgccu

SEQ ID NO: 53238 - RNA, 19 nt, Artificial Sequence
  Synthetic
guguccgugcugcccgccu

SEQ ID NO: 53239 - RNA, 20 nt, Artificial Sequence
  Synthetic
cguguccgugcugcccgccu

SEQ ID NO: 53240 - RNA, 21 nt, Artificial Sequence
  Synthetic
ccguguccgugcugcccgccu

SEQ ID NO: 53241 - RNA, 22 nt, Artificial Sequence
  Synthetic
uccguguccgugcugcccgccu

SEQ ID NO: 53242 - RNA, 23 nt, Artificial Sequence
  Synthetic
cuccguguccgugcugcccgccu

SEQ ID NO: 53243 - RNA, 24 nt, Artificial Sequence
  Synthetic
ucuccguguccgugcugcccgccu

SEQ ID NO: 53244 - RNA, 18 nt, Artificial Sequence
  Synthetic
gcgcagaccuucggagcu

SEQ ID NO: 53245 - RNA, 19 nt, Artificial Sequence
  Synthetic
cgcgcagaccuucggagcu

SEQ ID NO: 53246 - RNA, 20 nt, Artificial Sequence
  Synthetic
ucgcgcagaccuucggagcu

SEQ ID NO: 53247 - RNA, 21 nt, Artificial Sequence
  Synthetic
cucgcgcagaccuucggagcu

SEQ ID NO: 53248 - RNA, 22 nt, Artificial Sequence
  Synthetic
ccucgcgcagaccuucggagcu

SEQ ID NO: 53249 - RNA, 23 nt, Artificial Sequence
  Synthetic
gccucgcgcagaccuucggagcu

SEQ ID NO: 53250 - RNA, 24 nt, Artificial Sequence
  Synthetic
ggccucgcgcagaccuucggagcu

SEQ ID NO: 53251 - RNA, 18 nt, Artificial Sequence
  Synthetic
ggggcucccaucgucucu

SEQ ID NO: 53252 - RNA, 19 nt, Artificial Sequence
  Synthetic
cggggcucccaucgucucu

SEQ ID NO: 53253 - RNA, 20 nt, Artificial Sequence
  Synthetic
gcggggcucccaucgucucu

SEQ ID NO: 53254 - RNA, 21 nt, Artificial Sequence
  Synthetic
cgcggggcucccaucgucucu

SEQ ID NO: 53255 - RNA, 22 nt, Artificial Sequence
  Synthetic
acgcggggcucccaucgucucu

SEQ ID NO: 53256 - RNA, 23 nt, Artificial Sequence
  Synthetic
uacgcggggcucccaucgucucu

SEQ ID NO: 53257 - RNA, 24 nt, Artificial Sequence
  Synthetic
auacgcggggcucccaucgucucu

SEQ ID NO: 53258 - RNA, 18 nt, Artificial Sequence
  Synthetic
cggucgccggggcggagu

SEQ ID NO: 53259 - RNA, 19 nt, Artificial Sequence
  Synthetic
gcggucgccggggcggagu

SEQ ID NO: 53260 - RNA, 20 nt, Artificial Sequence
  Synthetic
ggcggucgccggggcggagu

SEQ ID NO: 53261 - RNA, 21 nt, Artificial Sequence
  Synthetic
gggcggucgccggggcggagu

SEQ ID NO: 53262 - RNA, 22 nt, Artificial Sequence
  Synthetic
ggggcggucgccggggcggagu

SEQ ID NO: 53263 - RNA, 23 nt, Artificial Sequence
  Synthetic
cggggcggucgccggggcggagu

SEQ ID NO: 53264 - RNA, 24 nt, Artificial Sequence
  Synthetic
gcggggcggucgccggggcggagu

SEQ ID NO: 53265 - RNA, 18 nt, Artificial Sequence
  Synthetic
cggggagcgaggggccgu

SEQ ID NO: 53266 - RNA, 19 nt, Artificial Sequence
  Synthetic
gcggggagcgaggggccgu

SEQ ID NO: 53267 - RNA, 20 nt, Artificial Sequence
  Synthetic
cgcggggagcgaggggccgu

SEQ ID NO: 53268 - RNA, 21 nt, Artificial Sequence
  Synthetic
acgcggggagcgaggggccgu

SEQ ID NO: 53269 - RNA, 22 nt, Artificial Sequence
  Synthetic
uacgcggggagcgaggggccgu

SEQ ID NO: 53270 - RNA, 23 nt, Artificial Sequence
  Synthetic
uuacgcggggagcgaggggccgu

SEQ ID NO: 53271 - RNA, 24 nt, Artificial Sequence
  Synthetic
auuacgcggggagcgaggggccgu

SEQ ID NO: 53272 - RNA, 18 nt, Artificial Sequence
  Synthetic
cgcggugaaggucgucgu

SEQ ID NO: 53273 - RNA, 19 nt, Artificial Sequence
  Synthetic
ucgcggugaaggucgucgu

SEQ ID NO: 53274 - RNA, 20 nt, Artificial Sequence
  Synthetic
gucgcggugaaggucgucgu

SEQ ID NO: 53275 - RNA, 21 nt, Artificial Sequence
  Synthetic
agucgcggugaaggucgucgu

SEQ ID NO: 53276 - RNA, 22 nt, Artificial Sequence
  Synthetic
gagucgcggugaaggucgucgu

SEQ ID NO: 53277 - RNA, 23 nt, Artificial Sequence
  Synthetic
ggagucgcggugaaggucgucgu

SEQ ID NO: 53278 - RNA, 24 nt, Artificial Sequence
  Synthetic
uggagucgcggugaaggucgucgu

SEQ ID NO: 53279 - RNA, 18 nt, Artificial Sequence
  Synthetic
cggccucgcgcagaccuu

SEQ ID NO: 53280 - RNA, 19 nt, Artificial Sequence
  Synthetic
gcggccucgcgcagaccuu

SEQ ID NO: 53281 - RNA, 20 nt, Artificial Sequence
  Synthetic
agcggccucgcgcagaccuu

SEQ ID NO: 53282 - RNA, 21 nt, Artificial Sequence
  Synthetic
gagcggccucgcgcagaccuu

SEQ ID NO: 53283 - RNA, 22 nt, Artificial Sequence
  Synthetic
agagcggccucgcgcagaccuu

SEQ ID NO: 53284 - RNA, 23 nt, Artificial Sequence
  Synthetic
gagagcggccucgcgcagaccuu

SEQ ID NO: 53285 - RNA, 24 nt, Artificial Sequence
  Synthetic
ggagagcggccucgcgcagaccuu

SEQ ID NO: 53286 - RNA, 18 nt, Artificial Sequence
  Synthetic
gggcucccaucgucucuu

SEQ ID NO: 53287 - RNA, 19 nt, Artificial Sequence
  Synthetic
ggggcucccaucgucucuu

SEQ ID NO: 53288 - RNA, 20 nt, Artificial Sequence
  Synthetic
cggggcucccaucgucucuu

SEQ ID NO: 53289 - RNA, 21 nt, Artificial Sequence
  Synthetic
gcggggcucccaucgucucuu

SEQ ID NO: 53290 - RNA, 22 nt, Artificial Sequence
  Synthetic
cgcggggcucccaucgucucuu

SEQ ID NO: 53291 - RNA, 23 nt, Artificial Sequence
  Synthetic
acgcggggcucccaucgucucuu

SEQ ID NO: 53292 - RNA, 24 nt, Artificial Sequence
  Synthetic
uacgcggggcucccaucgucucuu

SEQ ID NO: 53293 - RNA, 18 nt, Artificial Sequence
  Synthetic
cccgugggugaggaggaa

SEQ ID NO: 53294 - RNA, 19 nt, Artificial Sequence
  Synthetic
gcccgugggugaggaggaa

SEQ ID NO: 53295 - RNA, 20 nt, Artificial Sequence
  Synthetic
ggcccgugggugaggaggaa

SEQ ID NO: 53296 - RNA, 21 nt, Artificial Sequence
  Synthetic
gggcccgugggugaggaggaa

SEQ ID NO: 53297 - RNA, 22 nt, Artificial Sequence
  Synthetic
ugggcccgugggugaggaggaa

SEQ ID NO: 53298 - RNA, 23 nt, Artificial Sequence
  Synthetic
gugggcccgugggugaggaggaa

SEQ ID NO: 53299 - RNA, 24 nt, Artificial Sequence
  Synthetic
ggugggcccgugggugaggaggaa

SEQ ID NO: 53300 - RNA, 18 nt, Artificial Sequence
  Synthetic
ggugaggaggaagcggaa

SEQ ID NO: 53301 - RNA, 19 nt, Artificial Sequence
  Synthetic
gggugaggaggaagcggaa

SEQ ID NO: 53302 - RNA, 20 nt, Artificial Sequence
  Synthetic
ugggugaggaggaagcggaa

SEQ ID NO: 53303 - RNA, 21 nt, Artificial Sequence
  Synthetic
gugggugaggaggaagcggaa

SEQ ID NO: 53304 - RNA, 22 nt, Artificial Sequence
  Synthetic
cgugggugaggaggaagcggaa

SEQ ID NO: 53305 - RNA, 23 nt, Artificial Sequence
  Synthetic
ccgugggugaggaggaagcggaa

SEQ ID NO: 53306 - RNA, 24 nt, Artificial Sequence
  Synthetic
cccgugggugaggaggaagcggaa

SEQ ID NO: 53307 - RNA, 18 nt, Artificial Sequence
  Synthetic
aggcgggcagcacggaca

SEQ ID NO: 53308 - RNA, 19 nt, Artificial Sequence
  Synthetic
gaggcgggcagcacggaca

SEQ ID NO: 53309 - RNA, 20 nt, Artificial Sequence
  Synthetic
cgaggcgggcagcacggaca

SEQ ID NO: 53310 - RNA, 21 nt, Artificial Sequence
  Synthetic
ccgaggcgggcagcacggaca

SEQ ID NO: 53311 - RNA, 22 nt, Artificial Sequence
  Synthetic
uccgaggcgggcagcacggaca

SEQ ID NO: 53312 - RNA, 23 nt, Artificial Sequence
  Synthetic
cuccgaggcgggcagcacggaca

SEQ ID NO: 53313 - RNA, 24 nt, Artificial Sequence
  Synthetic
ccuccgaggcgggcagcacggaca

SEQ ID NO: 53314 - RNA, 18 nt, Artificial Sequence
  Synthetic
gccgcuccgcccgcccca

SEQ ID NO: 53315 - RNA, 19 nt, Artificial Sequence
  Synthetic
cgccgcuccgcccgcccca

SEQ ID NO: 53316 - RNA, 20 nt, Artificial Sequence
  Synthetic
ccgccgcuccgcccgcccca

SEQ ID NO: 53317 - RNA, 21 nt, Artificial Sequence
  Synthetic
cccgccgcuccgcccgcccca

SEQ ID NO: 53318 - RNA, 22 nt, Artificial Sequence
  Synthetic
ccccgccgcuccgcccgcccca

SEQ ID NO: 53319 - RNA, 23 nt, Artificial Sequence
  Synthetic
gccccgccgcuccgcccgcccca

SEQ ID NO: 53320 - RNA, 24 nt, Artificial Sequence
  Synthetic
cgccccgccgcuccgcccgcccca

SEQ ID NO: 53321 - RNA, 18 nt, Artificial Sequence
  Synthetic
gcgacucggaggaggaga

SEQ ID NO: 53322 - RNA, 19 nt, Artificial Sequence
  Synthetic
agcgacucggaggaggaga

SEQ ID NO: 53323 - RNA, 20 nt, Artificial Sequence
  Synthetic
cagcgacucggaggaggaga

SEQ ID NO: 53324 - RNA, 21 nt, Artificial Sequence
  Synthetic
gcagcgacucggaggaggaga

SEQ ID NO: 53325 - RNA, 22 nt, Artificial Sequence
  Synthetic
agcagcgacucggaggaggaga

SEQ ID NO: 53326 - RNA, 23 nt, Artificial Sequence
  Synthetic
cagcagcgacucggaggaggaga

SEQ ID NO: 53327 - RNA, 24 nt, Artificial Sequence
  Synthetic
ccagcagcgacucggaggaggaga

SEQ ID NO: 53328 - RNA, 18 nt, Artificial Sequence
  Synthetic
cgcucuccgaagagacga

SEQ ID NO: 53329 - RNA, 19 nt, Artificial Sequence
  Synthetic
ccgcucuccgaagagacga

SEQ ID NO: 53330 - RNA, 20 nt, Artificial Sequence
  Synthetic
gccgcucuccgaagagacga

SEQ ID NO: 53331 - RNA, 21 nt, Artificial Sequence
  Synthetic
ggccgcucuccgaagagacga

SEQ ID NO: 53332 - RNA, 22 nt, Artificial Sequence
  Synthetic
aggccgcucuccgaagagacga

SEQ ID NO: 53333 - RNA, 23 nt, Artificial Sequence
  Synthetic
gaggccgcucuccgaagagacga

SEQ ID NO: 53334 - RNA, 24 nt, Artificial Sequence
  Synthetic
cgaggccgcucuccgaagagacga

SEQ ID NO: 53335 - RNA, 18 nt, Artificial Sequence
  Synthetic
gaggaagcggaagcggga

SEQ ID NO: 53336 - RNA, 19 nt, Artificial Sequence
  Synthetic
ggaggaagcggaagcggga

SEQ ID NO: 53337 - RNA, 20 nt, Artificial Sequence
  Synthetic
aggaggaagcggaagcggga

SEQ ID NO: 53338 - RNA, 21 nt, Artificial Sequence
  Synthetic
gaggaggaagcggaagcggga

SEQ ID NO: 53339 - RNA, 22 nt, Artificial Sequence
  Synthetic
ugaggaggaagcggaagcggga

SEQ ID NO: 53340 - RNA, 23 nt, Artificial Sequence
  Synthetic
gugaggaggaagcggaagcggga

SEQ ID NO: 53341 - RNA, 24 nt, Artificial Sequence
  Synthetic
ggugaggaggaagcggaagcggga

SEQ ID NO: 53342 - RNA, 18 nt, Artificial Sequence
  Synthetic
uucagcaccaucccgaua

SEQ ID NO: 53343 - RNA, 19 nt, Artificial Sequence
  Synthetic
guucagcaccaucccgaua

SEQ ID NO: 53344 - RNA, 20 nt, Artificial Sequence
  Synthetic
cguucagcaccaucccgaua

SEQ ID NO: 53345 - RNA, 21 nt, Artificial Sequence
  Synthetic
ucguucagcaccaucccgaua

SEQ ID NO: 53346 - RNA, 22 nt, Artificial Sequence
  Synthetic
gucguucagcaccaucccgaua

SEQ ID NO: 53347 - RNA, 23 nt, Artificial Sequence
  Synthetic
ggucguucagcaccaucccgaua

SEQ ID NO: 53348 - RNA, 24 nt, Artificial Sequence
  Synthetic
gggucguucagcaccaucccgaua

SEQ ID NO: 53349 - RNA, 18 nt, Artificial Sequence
  Synthetic
ccgguggcguaccugaua

SEQ ID NO: 53350 - RNA, 19 nt, Artificial Sequence
  Synthetic
cccgguggcguaccugaua

SEQ ID NO: 53351 - RNA, 20 nt, Artificial Sequence
  Synthetic
ccccgguggcguaccugaua

SEQ ID NO: 53352 - RNA, 21 nt, Artificial Sequence
  Synthetic
accccgguggcguaccugaua

SEQ ID NO: 53353 - RNA, 22 nt, Artificial Sequence
  Synthetic
caccccgguggcguaccugaua

SEQ ID NO: 53354 - RNA, 23 nt, Artificial Sequence
  Synthetic
acaccccgguggcguaccugaua

SEQ ID NO: 53355 - RNA, 24 nt, Artificial Sequence
  Synthetic
aacaccccgguggcguaccugaua

SEQ ID NO: 53356 - RNA, 18 nt, Artificial Sequence
  Synthetic
gguaauuagcaacuuuua

SEQ ID NO: 53357 - RNA, 19 nt, Artificial Sequence
  Synthetic
ugguaauuagcaacuuuua

SEQ ID NO: 53358 - RNA, 20 nt, Artificial Sequence
  Synthetic
augguaauuagcaacuuuua

SEQ ID NO: 53359 - RNA, 21 nt, Artificial Sequence
  Synthetic
caugguaauuagcaacuuuua

SEQ ID NO: 53360 - RNA, 22 nt, Artificial Sequence
  Synthetic
gcaugguaauuagcaacuuuua

SEQ ID NO: 53361 - RNA, 23 nt, Artificial Sequence
  Synthetic
cgcaugguaauuagcaacuuuua

SEQ ID NO: 53362 - RNA, 24 nt, Artificial Sequence
  Synthetic
gcgcaugguaauuagcaacuuuua

SEQ ID NO: 53363 - RNA, 18 nt, Artificial Sequence
  Synthetic
gguaauuagcagcuuuua

SEQ ID NO: 53364 - RNA, 19 nt, Artificial Sequence
  Synthetic
cgguaauuagcagcuuuua

SEQ ID NO: 53365 - RNA, 20 nt, Artificial Sequence
  Synthetic
gcgguaauuagcagcuuuua

SEQ ID NO: 53366 - RNA, 21 nt, Artificial Sequence
  Synthetic
cgcgguaauuagcagcuuuua

SEQ ID NO: 53367 - RNA, 22 nt, Artificial Sequence
  Synthetic
ucgcgguaauuagcagcuuuua

SEQ ID NO: 53368 - RNA, 23 nt, Artificial Sequence
  Synthetic
cucgcgguaauuagcagcuuuua

SEQ ID NO: 53369 - RNA, 24 nt, Artificial Sequence
  Synthetic
gcucgcgguaauuagcagcuuuua

SEQ ID NO: 53370 - RNA, 18 nt, Artificial Sequence
  Synthetic
uggcucgccagcagcgac

SEQ ID NO: 53371 - RNA, 19 nt, Artificial Sequence
  Synthetic
guggcucgccagcagcgac

SEQ ID NO: 53372 - RNA, 20 nt, Artificial Sequence
  Synthetic
aguggcucgccagcagcgac

SEQ ID NO: 53373 - RNA, 21 nt, Artificial Sequence
  Synthetic
caguggcucgccagcagcgac

SEQ ID NO: 53374 - RNA, 22 nt, Artificial Sequence
  Synthetic
gcaguggcucgccagcagcgac

SEQ ID NO: 53375 - RNA, 23 nt, Artificial Sequence
  Synthetic
ugcaguggcucgccagcagcgac

SEQ ID NO: 53376 - RNA, 24 nt, Artificial Sequence
  Synthetic
augcaguggcucgccagcagcgac

SEQ ID NO: 53377 - RNA, 18 nt, Artificial Sequence
  Synthetic
gaggcgggcagcacggac

SEQ ID NO: 53378 - RNA, 19 nt, Artificial Sequence
  Synthetic
cgaggcgggcagcacggac

SEQ ID NO: 53379 - RNA, 20 nt, Artificial Sequence
  Synthetic
ccgaggcgggcagcacggac

SEQ ID NO: 53380 - RNA, 21 nt, Artificial Sequence
  Synthetic
uccgaggcgggcagcacggac

SEQ ID NO: 53381 - RNA, 22 nt, Artificial Sequence
  Synthetic
cuccgaggcgggcagcacggac

SEQ ID NO: 53382 - RNA, 23 nt, Artificial Sequence
  Synthetic
ccuccgaggcgggcagcacggac

SEQ ID NO: 53383 - RNA, 24 nt, Artificial Sequence
  Synthetic
accuccgaggcgggcagcacggac

SEQ ID NO: 53384 - RNA, 18 nt, Artificial Sequence
  Synthetic
cccgauagugaacgaccc

SEQ ID NO: 53385 - RNA, 19 nt, Artificial Sequence
  Synthetic
ucccgauagugaacgaccc

SEQ ID NO: 53386 - RNA, 20 nt, Artificial Sequence
  Synthetic
aucccgauagugaacgaccc

SEQ ID NO: 53387 - RNA, 21 nt, Artificial Sequence
  Synthetic
caucccgauagugaacgaccc

SEQ ID NO: 53388 - RNA, 22 nt, Artificial Sequence
  Synthetic
ccaucccgauagugaacgaccc

SEQ ID NO: 53389 - RNA, 23 nt, Artificial Sequence
  Synthetic
accaucccgauagugaacgaccc

SEQ ID NO: 53390 - RNA, 24 nt, Artificial Sequence
  Synthetic
caccaucccgauagugaacgaccc

SEQ ID NO: 53391 - RNA, 18 nt, Artificial Sequence
  Synthetic
cgccgcuccgcccgcccc

SEQ ID NO: 53392 - RNA, 19 nt, Artificial Sequence
  Synthetic
ccgccgcuccgcccgcccc

SEQ ID NO: 53393 - RNA, 20 nt, Artificial Sequence
  Synthetic
cccgccgcuccgcccgcccc

SEQ ID NO: 53394 - RNA, 21 nt, Artificial Sequence
  Synthetic
ccccgccgcuccgcccgcccc

SEQ ID NO: 53395 - RNA, 22 nt, Artificial Sequence
  Synthetic
gccccgccgcuccgcccgcccc

SEQ ID NO: 53396 - RNA, 23 nt, Artificial Sequence
  Synthetic
cgccccgccgcuccgcccgcccc

SEQ ID NO: 53397 - RNA, 24 nt, Artificial Sequence
  Synthetic
ccgccccgccgcuccgcccgcccc

SEQ ID NO: 53398 - RNA, 18 nt, Artificial Sequence
  Synthetic
ccucggccggcggagccc

SEQ ID NO: 53399 - RNA, 19 nt, Artificial Sequence
  Synthetic
gccucggccggcggagccc

SEQ ID NO: 53400 - RNA, 20 nt, Artificial Sequence
  Synthetic
ggccucggccggcggagccc

SEQ ID NO: 53401 - RNA, 21 nt, Artificial Sequence
  Synthetic
cggccucggccggcggagccc

SEQ ID NO: 53402 - RNA, 22 nt, Artificial Sequence
  Synthetic
gcggccucggccggcggagccc

SEQ ID NO: 53403 - RNA, 23 nt, Artificial Sequence
  Synthetic
ggcggccucggccggcggagccc

SEQ ID NO: 53404 - RNA, 24 nt, Artificial Sequence
  Synthetic
gggcggccucggccggcggagccc

SEQ ID NO: 53405 - RNA, 18 nt, Artificial Sequence
  Synthetic
ccgccgcuccgcccgccc

SEQ ID NO: 53406 - RNA, 19 nt, Artificial Sequence
  Synthetic
cccgccgcuccgcccgccc

SEQ ID NO: 53407 - RNA, 20 nt, Artificial Sequence
  Synthetic
ccccgccgcuccgcccgccc

SEQ ID NO: 53408 - RNA, 21 nt, Artificial Sequence
  Synthetic
gccccgccgcuccgcccgccc

SEQ ID NO: 53409 - RNA, 22 nt, Artificial Sequence
  Synthetic
cgccccgccgcuccgcccgccc

SEQ ID NO: 53410 - RNA, 23 nt, Artificial Sequence
  Synthetic
ccgccccgccgcuccgcccgccc

SEQ ID NO: 53411 - RNA, 24 nt, Artificial Sequence
  Synthetic
gccgccccgccgcuccgcccgccc

SEQ ID NO: 53412 - RNA, 18 nt, Artificial Sequence
  Synthetic
ccccgcguaauuacuccc

SEQ ID NO: 53413 - RNA, 19 nt, Artificial Sequence
  Synthetic
uccccgcguaauuacuccc

SEQ ID NO: 53414 - RNA, 20 nt, Artificial Sequence
  Synthetic
cuccccgcguaauuacuccc

SEQ ID NO: 53415 - RNA, 21 nt, Artificial Sequence
  Synthetic
gcuccccgcguaauuacuccc

SEQ ID NO: 53416 - RNA, 22 nt, Artificial Sequence
  Synthetic
cgcuccccgcguaauuacuccc

SEQ ID NO: 53417 - RNA, 23 nt, Artificial Sequence
  Synthetic
ucgcuccccgcguaauuacuccc

SEQ ID NO: 53418 - RNA, 24 nt, Artificial Sequence
  Synthetic
cucgcuccccgcguaauuacuccc

SEQ ID NO: 53419 - RNA, 18 nt, Artificial Sequence
  Synthetic
gccucggccggcggagcc

SEQ ID NO: 53420 - RNA, 19 nt, Artificial Sequence
  Synthetic
ggccucggccggcggagcc

SEQ ID NO: 53421 - RNA, 20 nt, Artificial Sequence
  Synthetic
cggccucggccggcggagcc

SEQ ID NO: 53422 - RNA, 21 nt, Artificial Sequence
  Synthetic
gcggccucggccggcggagcc

SEQ ID NO: 53423 - RNA, 22 nt, Artificial Sequence
  Synthetic
ggcggccucggccggcggagcc

SEQ ID NO: 53424 - RNA, 23 nt, Artificial Sequence
  Synthetic
gggcggccucggccggcggagcc

SEQ ID NO: 53425 - RNA, 24 nt, Artificial Sequence
  Synthetic
agggcggccucggccggcggagcc

SEQ ID NO: 53426 - RNA, 18 nt, Artificial Sequence
  Synthetic
cgcggguccuccgccgcc

SEQ ID NO: 53427 - RNA, 19 nt, Artificial Sequence
  Synthetic
gcgcggguccuccgccgcc

SEQ ID NO: 53428 - RNA, 20 nt, Artificial Sequence
  Synthetic
cgcgcggguccuccgccgcc

SEQ ID NO: 53429 - RNA, 21 nt, Artificial Sequence
  Synthetic
gcgcgcggguccuccgccgcc

SEQ ID NO: 53430 - RNA, 22 nt, Artificial Sequence
  Synthetic
ggcgcgcggguccuccgccgcc

SEQ ID NO: 53431 - RNA, 23 nt, Artificial Sequence
  Synthetic
cggcgcgcggguccuccgccgcc

SEQ ID NO: 53432 - RNA, 24 nt, Artificial Sequence
  Synthetic
gcggcgcgcggguccuccgccgcc

SEQ ID NO: 53433 - RNA, 18 nt, Artificial Sequence
  Synthetic
agccccgcguauauaucc

SEQ ID NO: 53434 - RNA, 19 nt, Artificial Sequence
  Synthetic
gagccccgcguauauaucc

SEQ ID NO: 53435 - RNA, 20 nt, Artificial Sequence
  Synthetic
ggagccccgcguauauaucc

SEQ ID NO: 53436 - RNA, 21 nt, Artificial Sequence
  Synthetic
gggagccccgcguauauaucc

SEQ ID NO: 53437 - RNA, 22 nt, Artificial Sequence
  Synthetic
ugggagccccgcguauauaucc

SEQ ID NO: 53438 - RNA, 23 nt, Artificial Sequence
  Synthetic
augggagccccgcguauauaucc

SEQ ID NO: 53439 - RNA, 24 nt, Artificial Sequence
  Synthetic
gaugggagccccgcguauauaucc

SEQ ID NO: 53440 - RNA, 18 nt, Artificial Sequence
  Synthetic
ugaggaggaagcggaagc

SEQ ID NO: 53441 - RNA, 19 nt, Artificial Sequence
  Synthetic
gugaggaggaagcggaagc

SEQ ID NO: 53442 - RNA, 20 nt, Artificial Sequence
  Synthetic
ggugaggaggaagcggaagc

SEQ ID NO: 53443 - RNA, 21 nt, Artificial Sequence
  Synthetic
gggugaggaggaagcggaagc

SEQ ID NO: 53444 - RNA, 22 nt, Artificial Sequence
  Synthetic
ugggugaggaggaagcggaagc

SEQ ID NO: 53445 - RNA, 23 nt, Artificial Sequence
  Synthetic
gugggugaggaggaagcggaagc

SEQ ID NO: 53446 - RNA, 24 nt, Artificial Sequence
  Synthetic
cgugggugaggaggaagcggaagc

SEQ ID NO: 53447 - RNA, 18 nt, Artificial Sequence
  Synthetic
accuccgaggcgggcagc

SEQ ID NO: 53448 - RNA, 19 nt, Artificial Sequence
  Synthetic
caccuccgaggcgggcagc

SEQ ID NO: 53449 - RNA, 20 nt, Artificial Sequence
  Synthetic
ccaccuccgaggcgggcagc

SEQ ID NO: 53450 - RNA, 21 nt, Artificial Sequence
  Synthetic
uccaccuccgaggcgggcagc

SEQ ID NO: 53451 - RNA, 22 nt, Artificial Sequence
  Synthetic
cuccaccuccgaggcgggcagc

SEQ ID NO: 53452 - RNA, 23 nt, Artificial Sequence
  Synthetic
acuccaccuccgaggcgggcagc

SEQ ID NO: 53453 - RNA, 24 nt, Artificial Sequence
  Synthetic
gacuccaccuccgaggcgggcagc

SEQ ID NO: 53454 - RNA, 18 nt, Artificial Sequence
  Synthetic
aacgacccccggacccgc

SEQ ID NO: 53455 - RNA, 19 nt, Artificial Sequence
  Synthetic
gaacgacccccggacccgc

SEQ ID NO: 53456 - RNA, 20 nt, Artificial Sequence
  Synthetic
ugaacgacccccggacccgc

SEQ ID NO: 53457 - RNA, 21 nt, Artificial Sequence
  Synthetic
gugaacgacccccggacccgc

SEQ ID NO: 53458 - RNA, 22 nt, Artificial Sequence
  Synthetic
agugaacgacccccggacccgc

SEQ ID NO: 53459 - RNA, 23 nt, Artificial Sequence
  Synthetic
uagugaacgacccccggacccgc

SEQ ID NO: 53460 - RNA, 24 nt, Artificial Sequence
  Synthetic
auagugaacgacccccggacccgc

SEQ ID NO: 53461 - RNA, 18 nt, Artificial Sequence
  Synthetic
ccaaccgcgcgccgccgc

SEQ ID NO: 53462 - RNA, 19 nt, Artificial Sequence
  Synthetic
gccaaccgcgcgccgccgc

SEQ ID NO: 53463 - RNA, 20 nt, Artificial Sequence
  Synthetic
ggccaaccgcgcgccgccgc

SEQ ID NO: 53464 - RNA, 21 nt, Artificial Sequence
  Synthetic
cggccaaccgcgcgccgccgc

SEQ ID NO: 53465 - RNA, 22 nt, Artificial Sequence
  Synthetic
ccggccaaccgcgcgccgccgc

SEQ ID NO: 53466 - RNA, 23 nt, Artificial Sequence
  Synthetic
gccggccaaccgcgcgccgccgc

SEQ ID NO: 53467 - RNA, 24 nt, Artificial Sequence
  Synthetic
cgccggccaaccgcgcgccgccgc

SEQ ID NO: 53468 - RNA, 18 nt, Artificial Sequence
  Synthetic
ccccgcguauauauccgc

SEQ ID NO: 53469 - RNA, 19 nt, Artificial Sequence
  Synthetic
gccccgcguauauauccgc

SEQ ID NO: 53470 - RNA, 20 nt, Artificial Sequence
  Synthetic
agccccgcguauauauccgc

SEQ ID NO: 53471 - RNA, 21 nt, Artificial Sequence
  Synthetic
gagccccgcguauauauccgc

SEQ ID NO: 53472 - RNA, 22 nt, Artificial Sequence
  Synthetic
ggagccccgcguauauauccgc

SEQ ID NO: 53473 - RNA, 23 nt, Artificial Sequence
  Synthetic
gggagccccgcguauauauccgc

SEQ ID NO: 53474 - RNA, 24 nt, Artificial Sequence
  Synthetic
ugggagccccgcguauauauccgc

SEQ ID NO: 53475 - RNA, 18 nt, Artificial Sequence
  Synthetic
cggcccccggccgagcgc

SEQ ID NO: 53476 - RNA, 19 nt, Artificial Sequence
  Synthetic
ccggcccccggccgagcgc

SEQ ID NO: 53477 - RNA, 20 nt, Artificial Sequence
  Synthetic
cccggcccccggccgagcgc

SEQ ID NO: 53478 - RNA, 21 nt, Artificial Sequence
  Synthetic
gcccggcccccggccgagcgc

SEQ ID NO: 53479 - RNA, 22 nt, Artificial Sequence
  Synthetic
ggcccggcccccggccgagcgc

SEQ ID NO: 53480 - RNA, 23 nt, Artificial Sequence
  Synthetic
cggcccggcccccggccgagcgc

SEQ ID NO: 53481 - RNA, 24 nt, Artificial Sequence
  Synthetic
ccggcccggcccccggccgagcgc

SEQ ID NO: 53482 - RNA, 18 nt, Artificial Sequence
  Synthetic
gucuaggguugaaccggc

SEQ ID NO: 53483 - RNA, 19 nt, Artificial Sequence
  Synthetic
ggucuaggguugaaccggc

SEQ ID NO: 53484 - RNA, 20 nt, Artificial Sequence
  Synthetic
cggucuaggguugaaccggc

SEQ ID NO: 53485 - RNA, 21 nt, Artificial Sequence
  Synthetic
gcggucuaggguugaaccggc

SEQ ID NO: 53486 - RNA, 22 nt, Artificial Sequence
  Synthetic
ggcggucuaggguugaaccggc

SEQ ID NO: 53487 - RNA, 23 nt, Artificial Sequence
  Synthetic
gggcggucuaggguugaaccggc

SEQ ID NO: 53488 - RNA, 24 nt, Artificial Sequence
  Synthetic
cgggcggucuaggguugaaccggc

SEQ ID NO: 53489 - RNA, 18 nt, Artificial Sequence
  Synthetic
uccuccgccgccgcgggc

SEQ ID NO: 53490 - RNA, 19 nt, Artificial Sequence
  Synthetic
guccuccgccgccgcgggc

SEQ ID NO: 53491 - RNA, 20 nt, Artificial Sequence
  Synthetic
gguccuccgccgccgcgggc

SEQ ID NO: 53492 - RNA, 21 nt, Artificial Sequence
  Synthetic
ggguccuccgccgccgcgggc

SEQ ID NO: 53493 - RNA, 22 nt, Artificial Sequence
  Synthetic
cggguccuccgccgccgcgggc

SEQ ID NO: 53494 - RNA, 23 nt, Artificial Sequence
  Synthetic
gcggguccuccgccgccgcgggc

SEQ ID NO: 53495 - RNA, 24 nt, Artificial Sequence
  Synthetic
cgcggguccuccgccgccgcgggc

SEQ ID NO: 53496 - RNA, 18 nt, Artificial Sequence
  Synthetic
gcgcgccgccgcgcgggc

SEQ ID NO: 53497 - RNA, 19 nt, Artificial Sequence
  Synthetic
cgcgcgccgccgcgcgggc

SEQ ID NO: 53498 - RNA, 20 nt, Artificial Sequence
  Synthetic
ccgcgcgccgccgcgcgggc

SEQ ID NO: 53499 - RNA, 21 nt, Artificial Sequence
  Synthetic
accgcgcgccgccgcgcgggc

SEQ ID NO: 53500 - RNA, 22 nt, Artificial Sequence
  Synthetic
aaccgcgcgccgccgcgcgggc

SEQ ID NO: 53501 - RNA, 23 nt, Artificial Sequence
  Synthetic
caaccgcgcgccgccgcgcgggc

SEQ ID NO: 53502 - RNA, 24 nt, Artificial Sequence
  Synthetic
ccaaccgcgcgccgccgcgcgggc

SEQ ID NO: 53503 - RNA, 18 nt, Artificial Sequence
  Synthetic
ggagcuccgaaggucugc

SEQ ID NO: 53504 - RNA, 19 nt, Artificial Sequence
  Synthetic
cggagcuccgaaggucugc

SEQ ID NO: 53505 - RNA, 20 nt, Artificial Sequence
  Synthetic
ccggagcuccgaaggucugc

SEQ ID NO: 53506 - RNA, 21 nt, Artificial Sequence
  Synthetic
cccggagcuccgaaggucugc

SEQ ID NO: 53507 - RNA, 22 nt, Artificial Sequence
  Synthetic
ccccggagcuccgaaggucugc

SEQ ID NO: 53508 - RNA, 23 nt, Artificial Sequence
  Synthetic
gccccggagcuccgaaggucugc

SEQ ID NO: 53509 - RNA, 24 nt, Artificial Sequence
  Synthetic
agccccggagcuccgaaggucugc

SEQ ID NO: 53510 - RNA, 18 nt, Artificial Sequence
  Synthetic
cccuucugcaucccgugc

SEQ ID NO: 53511 - RNA, 19 nt, Artificial Sequence
  Synthetic
ccccuucugcaucccgugc

SEQ ID NO: 53512 - RNA, 20 nt, Artificial Sequence
  Synthetic
accccuucugcaucccgugc

SEQ ID NO: 53513 - RNA, 21 nt, Artificial Sequence
  Synthetic
caccccuucugcaucccgugc

SEQ ID NO: 53514 - RNA, 22 nt, Artificial Sequence
  Synthetic
gcaccccuucugcaucccgugc

SEQ ID NO: 53515 - RNA, 23 nt, Artificial Sequence
  Synthetic
ugcaccccuucugcaucccgugc

SEQ ID NO: 53516 - RNA, 24 nt, Artificial Sequence
  Synthetic
cugcaccccuucugcaucccgugc

SEQ ID NO: 53517 - RNA, 18 nt, Artificial Sequence
  Synthetic
gacgugugcgccgugugc

SEQ ID NO: 53518 - RNA, 19 nt, Artificial Sequence
  Synthetic
cgacgugugcgccgugugc

SEQ ID NO: 53519 - RNA, 20 nt, Artificial Sequence
  Synthetic
gcgacgugugcgccgugugc

SEQ ID NO: 53520 - RNA, 21 nt, Artificial Sequence
  Synthetic
ggcgacgugugcgccgugugc

SEQ ID NO: 53521 - RNA, 22 nt, Artificial Sequence
  Synthetic
gggcgacgugugcgccgugugc

SEQ ID NO: 53522 - RNA, 23 nt, Artificial Sequence
  Synthetic
ggggcgacgugugcgccgugugc

SEQ ID NO: 53523 - RNA, 24 nt, Artificial Sequence
  Synthetic
gggggcgacgugugcgccgugugc

SEQ ID NO: 53524 - RNA, 18 nt, Artificial Sequence
  Synthetic
ccgugggugaggaggaag

SEQ ID NO: 53525 - RNA, 19 nt, Artificial Sequence
  Synthetic
cccgugggugaggaggaag

SEQ ID NO: 53526 - RNA, 20 nt, Artificial Sequence
  Synthetic
gcccgugggugaggaggaag

SEQ ID NO: 53527 - RNA, 21 nt, Artificial Sequence
  Synthetic
ggcccgugggugaggaggaag

SEQ ID NO: 53528 - RNA, 22 nt, Artificial Sequence
  Synthetic
gggcccgugggugaggaggaag

SEQ ID NO: 53529 - RNA, 23 nt, Artificial Sequence
  Synthetic
ugggcccgugggugaggaggaag

SEQ ID NO: 53530 - RNA, 24 nt, Artificial Sequence
  Synthetic
gugggcccgugggugaggaggaag

SEQ ID NO: 53531 - RNA, 18 nt, Artificial Sequence
  Synthetic
gugaggaggaagcggaag

SEQ ID NO: 53532 - RNA, 19 nt, Artificial Sequence
  Synthetic
ggugaggaggaagcggaag

SEQ ID NO: 53533 - RNA, 20 nt, Artificial Sequence
  Synthetic
gggugaggaggaagcggaag

SEQ ID NO: 53534 - RNA, 21 nt, Artificial Sequence
  Synthetic
ugggugaggaggaagcggaag

SEQ ID NO: 53535 - RNA, 22 nt, Artificial Sequence
  Synthetic
gugggugaggaggaagcggaag

SEQ ID NO: 53536 - RNA, 23 nt, Artificial Sequence
  Synthetic
cgugggugaggaggaagcggaag

SEQ ID NO: 53537 - RNA, 24 nt, Artificial Sequence
  Synthetic
ccgugggugaggaggaagcggaag

SEQ ID NO: 53538 - RNA, 18 nt, Artificial Sequence
  Synthetic
ucggaggaggagaccgag

SEQ ID NO: 53539 - RNA, 19 nt, Artificial Sequence
  Synthetic
cucggaggaggagaccgag

SEQ ID NO: 53540 - RNA, 20 nt, Artificial Sequence
  Synthetic
acucggaggaggagaccgag

SEQ ID NO: 53541 - RNA, 21 nt, Artificial Sequence
  Synthetic
gacucggaggaggagaccgag

SEQ ID NO: 53542 - RNA, 22 nt, Artificial Sequence
  Synthetic
cgacucggaggaggagaccgag

SEQ ID NO: 53543 - RNA, 23 nt, Artificial Sequence
  Synthetic
gcgacucggaggaggagaccgag

SEQ ID NO: 53544 - RNA, 24 nt, Artificial Sequence
  Synthetic
agcgacucggaggaggagaccgag

SEQ ID NO: 53545 - RNA, 18 nt, Artificial Sequence
  Synthetic
cgcgacuccaccuccgag

SEQ ID NO: 53546 - RNA, 19 nt, Artificial Sequence
  Synthetic
ccgcgacuccaccuccgag

SEQ ID NO: 53547 - RNA, 20 nt, Artificial Sequence
  Synthetic
accgcgacuccaccuccgag

SEQ ID NO: 53548 - RNA, 21 nt, Artificial Sequence
  Synthetic
caccgcgacuccaccuccgag

SEQ ID NO: 53549 - RNA, 22 nt, Artificial Sequence
  Synthetic
ucaccgcgacuccaccuccgag

SEQ ID NO: 53550 - RNA, 23 nt, Artificial Sequence
  Synthetic
uucaccgcgacuccaccuccgag

SEQ ID NO: 53551 - RNA, 24 nt, Artificial Sequence
  Synthetic
cuucaccgcgacuccaccuccgag

SEQ ID NO: 53552 - RNA, 18 nt, Artificial Sequence
  Synthetic
gacacggagauguucgag

SEQ ID NO: 53553 - RNA, 19 nt, Artificial Sequence
  Synthetic
ggacacggagauguucgag

SEQ ID NO: 53554 - RNA, 20 nt, Artificial Sequence
  Synthetic
cggacacggagauguucgag

SEQ ID NO: 53555 - RNA, 21 nt, Artificial Sequence
  Synthetic
acggacacggagauguucgag

SEQ ID NO: 53556 - RNA, 22 nt, Artificial Sequence
  Synthetic
cacggacacggagauguucgag

SEQ ID NO: 53557 - RNA, 23 nt, Artificial Sequence
  Synthetic
gcacggacacggagauguucgag

SEQ ID NO: 53558 - RNA, 24 nt, Artificial Sequence
  Synthetic
agcacggacacggagauguucgag

SEQ ID NO: 53559 - RNA, 18 nt, Artificial Sequence
  Synthetic
gccagcagcgacucggag

SEQ ID NO: 53560 - RNA, 19 nt, Artificial Sequence
  Synthetic
cgccagcagcgacucggag

SEQ ID NO: 53561 - RNA, 20 nt, Artificial Sequence
  Synthetic
ucgccagcagcgacucggag

SEQ ID NO: 53562 - RNA, 21 nt, Artificial Sequence
  Synthetic
cucgccagcagcgacucggag

SEQ ID NO: 53563 - RNA, 22 nt, Artificial Sequence
  Synthetic
gcucgccagcagcgacucggag

SEQ ID NO: 53564 - RNA, 23 nt, Artificial Sequence
  Synthetic
ggcucgccagcagcgacucggag

SEQ ID NO: 53565 - RNA, 24 nt, Artificial Sequence
  Synthetic
uggcucgccagcagcgacucggag

SEQ ID NO: 53566 - RNA, 18 nt, Artificial Sequence
  Synthetic
aggaagcggaagcgggag

SEQ ID NO: 53567 - RNA, 19 nt, Artificial Sequence
  Synthetic
gaggaagcggaagcgggag

SEQ ID NO: 53568 - RNA, 20 nt, Artificial Sequence
  Synthetic
ggaggaagcggaagcgggag

SEQ ID NO: 53569 - RNA, 21 nt, Artificial Sequence
  Synthetic
aggaggaagcggaagcgggag

SEQ ID NO: 53570 - RNA, 22 nt, Artificial Sequence
  Synthetic
gaggaggaagcggaagcgggag

SEQ ID NO: 53571 - RNA, 23 nt, Artificial Sequence
  Synthetic
ugaggaggaagcggaagcgggag

SEQ ID NO: 53572 - RNA, 24 nt, Artificial Sequence
  Synthetic
gugaggaggaagcggaagcgggag

SEQ ID NO: 53573 - RNA, 18 nt, Artificial Sequence
  Synthetic
ggugggcccgugggugag

SEQ ID NO: 53574 - RNA, 19 nt, Artificial Sequence
  Synthetic
gggugggcccgugggugag

SEQ ID NO: 53575 - RNA, 20 nt, Artificial Sequence
  Synthetic
ggggugggcccgugggugag

SEQ ID NO: 53576 - RNA, 21 nt, Artificial Sequence
  Synthetic
gggggugggcccgugggugag

SEQ ID NO: 53577 - RNA, 22 nt, Artificial Sequence
  Synthetic
cgggggugggcccgugggugag

SEQ ID NO: 53578 - RNA, 23 nt, Artificial Sequence
  Synthetic
gcgggggugggcccgugggugag

SEQ ID NO: 53579 - RNA, 24 nt, Artificial Sequence
  Synthetic
ugcgggggugggcccgugggugag

SEQ ID NO: 53580 - RNA, 18 nt, Artificial Sequence
  Synthetic
ccgcucuccgaagagacg

SEQ ID NO: 53581 - RNA, 19 nt, Artificial Sequence
  Synthetic
gccgcucuccgaagagacg

SEQ ID NO: 53582 - RNA, 20 nt, Artificial Sequence
  Synthetic
ggccgcucuccgaagagacg

SEQ ID NO: 53583 - RNA, 21 nt, Artificial Sequence
  Synthetic
aggccgcucuccgaagagacg

SEQ ID NO: 53584 - RNA, 22 nt, Artificial Sequence
  Synthetic
gaggccgcucuccgaagagacg

SEQ ID NO: 53585 - RNA, 23 nt, Artificial Sequence
  Synthetic
cgaggccgcucuccgaagagacg

SEQ ID NO: 53586 - RNA, 24 nt, Artificial Sequence
  Synthetic
gcgaggccgcucuccgaagagacg

SEQ ID NO: 53587 - RNA, 18 nt, Artificial Sequence
  Synthetic
cggucuaggguugaaccg

SEQ ID NO: 53588 - RNA, 19 nt, Artificial Sequence
  Synthetic
gcggucuaggguugaaccg

SEQ ID NO: 53589 - RNA, 20 nt, Artificial Sequence
  Synthetic
ggcggucuaggguugaaccg

SEQ ID NO: 53590 - RNA, 21 nt, Artificial Sequence
  Synthetic
gggcggucuaggguugaaccg

SEQ ID NO: 53591 - RNA, 22 nt, Artificial Sequence
  Synthetic
cgggcggucuaggguugaaccg

SEQ ID NO: 53592 - RNA, 23 nt, Artificial Sequence
  Synthetic
ucgggcggucuaggguugaaccg

SEQ ID NO: 53593 - RNA, 24 nt, Artificial Sequence
  Synthetic
gucgggcggucuaggguugaaccg

SEQ ID NO: 53594 - RNA, 18 nt, Artificial Sequence
  Synthetic
cgagggcggccucggccg

SEQ ID NO: 53595 - RNA, 19 nt, Artificial Sequence
  Synthetic
gcgagggcggccucggccg

SEQ ID NO: 53596 - RNA, 20 nt, Artificial Sequence
  Synthetic
ggcgagggcggccucggccg

SEQ ID NO: 53597 - RNA, 21 nt, Artificial Sequence
  Synthetic
cggcgagggcggccucggccg

SEQ ID NO: 53598 - RNA, 22 nt, Artificial Sequence
  Synthetic
ccggcgagggcggccucggccg

SEQ ID NO: 53599 - RNA, 23 nt, Artificial Sequence
  Synthetic
accggcgagggcggccucggccg

SEQ ID NO: 53600 - RNA, 24 nt, Artificial Sequence
  Synthetic
aaccggcgagggcggccucggccg

SEQ ID NO: 53601 - RNA, 18 nt, Artificial Sequence
  Synthetic
cgccgcgggcccgggccg

SEQ ID NO: 53602 - RNA, 19 nt, Artificial Sequence
  Synthetic
ccgccgcgggcccgggccg

SEQ ID NO: 53603 - RNA, 20 nt, Artificial Sequence
  Synthetic
gccgccgcgggcccgggccg

SEQ ID NO: 53604 - RNA, 21 nt, Artificial Sequence
  Synthetic
cgccgccgcgggcccgggccg

SEQ ID NO: 53605 - RNA, 22 nt, Artificial Sequence
  Synthetic
ccgccgccgcgggcccgggccg

SEQ ID NO: 53606 - RNA, 23 nt, Artificial Sequence
  Synthetic
uccgccgccgcgggcccgggccg

SEQ ID NO: 53607 - RNA, 24 nt, Artificial Sequence
  Synthetic
cuccgccgccgcgggcccgggccg

SEQ ID NO: 53608 - RNA, 18 nt, Artificial Sequence
  Synthetic
gcgcgaggccgcucuccg

SEQ ID NO: 53609 - RNA, 19 nt, Artificial Sequence
  Synthetic
ugcgcgaggccgcucuccg

SEQ ID NO: 53610 - RNA, 20 nt, Artificial Sequence
  Synthetic
cugcgcgaggccgcucuccg

SEQ ID NO: 53611 - RNA, 21 nt, Artificial Sequence
  Synthetic
ucugcgcgaggccgcucuccg

SEQ ID NO: 53612 - RNA, 22 nt, Artificial Sequence
  Synthetic
gucugcgcgaggccgcucuccg

SEQ ID NO: 53613 - RNA, 23 nt, Artificial Sequence
  Synthetic
ggucugcgcgaggccgcucuccg

SEQ ID NO: 53614 - RNA, 24 nt, Artificial Sequence
  Synthetic
aggucugcgcgaggccgcucuccg

SEQ ID NO: 53615 - RNA, 18 nt, Artificial Sequence
  Synthetic
cccacgcccgccgacgcg

SEQ ID NO: 53616 - RNA, 19 nt, Artificial Sequence
  Synthetic
ccccacgcccgccgacgcg

SEQ ID NO: 53617 - RNA, 20 nt, Artificial Sequence
  Synthetic
gccccacgcccgccgacgcg

SEQ ID NO: 53618 - RNA, 21 nt, Artificial Sequence
  Synthetic
agccccacgcccgccgacgcg

SEQ ID NO: 53619 - RNA, 22 nt, Artificial Sequence
  Synthetic
cagccccacgcccgccgacgcg

SEQ ID NO: 53620 - RNA, 23 nt, Artificial Sequence
  Synthetic
gcagccccacgcccgccgacgcg

SEQ ID NO: 53621 - RNA, 24 nt, Artificial Sequence
  Synthetic
ggcagccccacgcccgccgacgcg

SEQ ID NO: 53622 - RNA, 18 nt, Artificial Sequence
  Synthetic
acgacccccggacccgcg

SEQ ID NO: 53623 - RNA, 19 nt, Artificial Sequence
  Synthetic
aacgacccccggacccgcg

SEQ ID NO: 53624 - RNA, 20 nt, Artificial Sequence
  Synthetic
gaacgacccccggacccgcg

SEQ ID NO: 53625 - RNA, 21 nt, Artificial Sequence
  Synthetic
ugaacgacccccggacccgcg

SEQ ID NO: 53626 - RNA, 22 nt, Artificial Sequence
  Synthetic
gugaacgacccccggacccgcg

SEQ ID NO: 53627 - RNA, 23 nt, Artificial Sequence
  Synthetic
agugaacgacccccggacccgcg

SEQ ID NO: 53628 - RNA, 24 nt, Artificial Sequence
  Synthetic
uagugaacgacccccggacccgcg

SEQ ID NO: 53629 - RNA, 18 nt, Artificial Sequence
  Synthetic
cucgccagcagcgacucg

SEQ ID NO: 53630 - RNA, 19 nt, Artificial Sequence
  Synthetic
gcucgccagcagcgacucg

SEQ ID NO: 53631 - RNA, 20 nt, Artificial Sequence
  Synthetic
ggcucgccagcagcgacucg

SEQ ID NO: 53632 - RNA, 21 nt, Artificial Sequence
  Synthetic
uggcucgccagcagcgacucg

SEQ ID NO: 53633 - RNA, 22 nt, Artificial Sequence
  Synthetic
guggcucgccagcagcgacucg

SEQ ID NO: 53634 - RNA, 23 nt, Artificial Sequence
  Synthetic
aguggcucgccagcagcgacucg

SEQ ID NO: 53635 - RNA, 24 nt, Artificial Sequence
  Synthetic
caguggcucgccagcagcgacucg

SEQ ID NO: 53636 - RNA, 18 nt, Artificial Sequence
  Synthetic
cggaggaggagaccgagg

SEQ ID NO: 53637 - RNA, 19 nt, Artificial Sequence
  Synthetic
ucggaggaggagaccgagg

SEQ ID NO: 53638 - RNA, 20 nt, Artificial Sequence
  Synthetic
cucggaggaggagaccgagg

SEQ ID NO: 53639 - RNA, 21 nt, Artificial Sequence
  Synthetic
acucggaggaggagaccgagg

SEQ ID NO: 53640 - RNA, 22 nt, Artificial Sequence
  Synthetic
gacucggaggaggagaccgagg

SEQ ID NO: 53641 - RNA, 23 nt, Artificial Sequence
  Synthetic
cgacucggaggaggagaccgagg

SEQ ID NO: 53642 - RNA, 24 nt, Artificial Sequence
  Synthetic
gcgacucggaggaggagaccgagg

SEQ ID NO: 53643 - RNA, 18 nt, Artificial Sequence
  Synthetic
ccagcagcgacucggagg

SEQ ID NO: 53644 - RNA, 19 nt, Artificial Sequence
  Synthetic
gccagcagcgacucggagg

SEQ ID NO: 53645 - RNA, 20 nt, Artificial Sequence
  Synthetic
cgccagcagcgacucggagg

SEQ ID NO: 53646 - RNA, 21 nt, Artificial Sequence
  Synthetic
ucgccagcagcgacucggagg

SEQ ID NO: 53647 - RNA, 22 nt, Artificial Sequence
  Synthetic
cucgccagcagcgacucggagg

SEQ ID NO: 53648 - RNA, 23 nt, Artificial Sequence
  Synthetic
gcucgccagcagcgacucggagg

SEQ ID NO: 53649 - RNA, 24 nt, Artificial Sequence
  Synthetic
ggcucgccagcagcgacucggagg

SEQ ID NO: 53650 - RNA, 18 nt, Artificial Sequence
  Synthetic
ggaagcggaagcgggagg

SEQ ID NO: 53651 - RNA, 19 nt, Artificial Sequence
  Synthetic
aggaagcggaagcgggagg

SEQ ID NO: 53652 - RNA, 20 nt, Artificial Sequence
  Synthetic
gaggaagcggaagcgggagg

SEQ ID NO: 53653 - RNA, 21 nt, Artificial Sequence
  Synthetic
ggaggaagcggaagcgggagg

SEQ ID NO: 53654 - RNA, 22 nt, Artificial Sequence
  Synthetic
aggaggaagcggaagcgggagg

SEQ ID NO: 53655 - RNA, 23 nt, Artificial Sequence
  Synthetic
gaggaggaagcggaagcgggagg

SEQ ID NO: 53656 - RNA, 24 nt, Artificial Sequence
  Synthetic
ugaggaggaagcggaagcgggagg

SEQ ID NO: 53657 - RNA, 18 nt, Artificial Sequence
  Synthetic
gugggcccgugggugagg

SEQ ID NO: 53658 - RNA, 19 nt, Artificial Sequence
  Synthetic
ggugggcccgugggugagg

SEQ ID NO: 53659 - RNA, 20 nt, Artificial Sequence
  Synthetic
gggugggcccgugggugagg

SEQ ID NO: 53660 - RNA, 21 nt, Artificial Sequence
  Synthetic
ggggugggcccgugggugagg

SEQ ID NO: 53661 - RNA, 22 nt, Artificial Sequence
  Synthetic
gggggugggcccgugggugagg

SEQ ID NO: 53662 - RNA, 23 nt, Artificial Sequence
  Synthetic
cgggggugggcccgugggugagg

SEQ ID NO: 53663 - RNA, 24 nt, Artificial Sequence
  Synthetic
gcgggggugggcccgugggugagg

SEQ ID NO: 53664 - RNA, 18 nt, Artificial Sequence
  Synthetic
ugugcgccgugugcacgg

SEQ ID NO: 53665 - RNA, 19 nt, Artificial Sequence
  Synthetic
gugugcgccgugugcacgg

SEQ ID NO: 53666 - RNA, 20 nt, Artificial Sequence
  Synthetic
cgugugcgccgugugcacgg

SEQ ID NO: 53667 - RNA, 21 nt, Artificial Sequence
  Synthetic
acgugugcgccgugugcacgg

SEQ ID NO: 53668 - RNA, 22 nt, Artificial Sequence
  Synthetic
gacgugugcgccgugugcacgg

SEQ ID NO: 53669 - RNA, 23 nt, Artificial Sequence
  Synthetic
cgacgugugcgccgugugcacgg

SEQ ID NO: 53670 - RNA, 24 nt, Artificial Sequence
  Synthetic
gcgacgugugcgccgugugcacgg

SEQ ID NO: 53671 - RNA, 18 nt, Artificial Sequence
  Synthetic
ccccggcccggcccccgg

SEQ ID NO: 53672 - RNA, 19 nt, Artificial Sequence
  Synthetic
cccccggcccggcccccgg

SEQ ID NO: 53673 - RNA, 20 nt, Artificial Sequence
  Synthetic
gcccccggcccggcccccgg

SEQ ID NO: 53674 - RNA, 21 nt, Artificial Sequence
  Synthetic
cgcccccggcccggcccccgg

SEQ ID NO: 53675 - RNA, 22 nt, Artificial Sequence
  Synthetic
acgcccccggcccggcccccgg

SEQ ID NO: 53676 - RNA, 23 nt, Artificial Sequence
  Synthetic
cacgcccccggcccggcccccgg

SEQ ID NO: 53677 - RNA, 24 nt, Artificial Sequence
  Synthetic
ccacgcccccggcccggcccccgg

SEQ ID NO: 53678 - RNA, 18 nt, Artificial Sequence
  Synthetic
gagggcggccucggccgg

SEQ ID NO: 53679 - RNA, 19 nt, Artificial Sequence
  Synthetic
cgagggcggccucggccgg

SEQ ID NO: 53680 - RNA, 20 nt, Artificial Sequence
  Synthetic
gcgagggcggccucggccgg

SEQ ID NO: 53681 - RNA, 21 nt, Artificial Sequence
  Synthetic
ggcgagggcggccucggccgg

SEQ ID NO: 53682 - RNA, 22 nt, Artificial Sequence
  Synthetic
cggcgagggcggccucggccgg

SEQ ID NO: 53683 - RNA, 23 nt, Artificial Sequence
  Synthetic
ccggcgagggcggccucggccgg

SEQ ID NO: 53684 - RNA, 24 nt, Artificial Sequence
  Synthetic
accggcgagggcggccucggccgg

SEQ ID NO: 53685 - RNA, 18 nt, Artificial Sequence
  Synthetic
aggaggaagcggaagcgg

SEQ ID NO: 53686 - RNA, 19 nt, Artificial Sequence
  Synthetic
gaggaggaagcggaagcgg

SEQ ID NO: 53687 - RNA, 20 nt, Artificial Sequence
  Synthetic
ugaggaggaagcggaagcgg

SEQ ID NO: 53688 - RNA, 21 nt, Artificial Sequence
  Synthetic
gugaggaggaagcggaagcgg

SEQ ID NO: 53689 - RNA, 22 nt, Artificial Sequence
  Synthetic
ggugaggaggaagcggaagcgg

SEQ ID NO: 53690 - RNA, 23 nt, Artificial Sequence
  Synthetic
gggugaggaggaagcggaagcgg

SEQ ID NO: 53691 - RNA, 24 nt, Artificial Sequence
  Synthetic
ugggugaggaggaagcggaagcgg

SEQ ID NO: 53692 - RNA, 18 nt, Artificial Sequence
  Synthetic
ucgccagcagcgacucgg

SEQ ID NO: 53693 - RNA, 19 nt, Artificial Sequence
  Synthetic
cucgccagcagcgacucgg

SEQ ID NO: 53694 - RNA, 20 nt, Artificial Sequence
  Synthetic
gcucgccagcagcgacucgg

SEQ ID NO: 53695 - RNA, 21 nt, Artificial Sequence
  Synthetic
ggcucgccagcagcgacucgg

SEQ ID NO: 53696 - RNA, 22 nt, Artificial Sequence
  Synthetic
uggcucgccagcagcgacucgg

SEQ ID NO: 53697 - RNA, 23 nt, Artificial Sequence
  Synthetic
guggcucgccagcagcgacucgg

SEQ ID NO: 53698 - RNA, 24 nt, Artificial Sequence
  Synthetic
aguggcucgccagcagcgacucgg

SEQ ID NO: 53699 - RNA, 18 nt, Artificial Sequence
  Synthetic
gaagcggaagcgggaggg

SEQ ID NO: 53700 - RNA, 19 nt, Artificial Sequence
  Synthetic
ggaagcggaagcgggaggg

SEQ ID NO: 53701 - RNA, 20 nt, Artificial Sequence
  Synthetic
aggaagcggaagcgggaggg

SEQ ID NO: 53702 - RNA, 21 nt, Artificial Sequence
  Synthetic
gaggaagcggaagcgggaggg

SEQ ID NO: 53703 - RNA, 22 nt, Artificial Sequence
  Synthetic
ggaggaagcggaagcgggaggg

SEQ ID NO: 53704 - RNA, 23 nt, Artificial Sequence
  Synthetic
aggaggaagcggaagcgggaggg

SEQ ID NO: 53705 - RNA, 24 nt, Artificial Sequence
  Synthetic
gaggaggaagcggaagcgggaggg

SEQ ID NO: 53706 - RNA, 18 nt, Artificial Sequence
  Synthetic
ccgucgggcggucuaggg

SEQ ID NO: 53707 - RNA, 19 nt, Artificial Sequence
  Synthetic
gccgucgggcggucuaggg

SEQ ID NO: 53708 - RNA, 20 nt, Artificial Sequence
  Synthetic
ggccgucgggcggucuaggg

SEQ ID NO: 53709 - RNA, 21 nt, Artificial Sequence
  Synthetic
gggccgucgggcggucuaggg

SEQ ID NO: 53710 - RNA, 22 nt, Artificial Sequence
  Synthetic
cgggccgucgggcggucuaggg

SEQ ID NO: 53711 - RNA, 23 nt, Artificial Sequence
  Synthetic
ccgggccgucgggcggucuaggg

SEQ ID NO: 53712 - RNA, 24 nt, Artificial Sequence
  Synthetic
cccgggccgucgggcggucuaggg

SEQ ID NO: 53713 - RNA, 18 nt, Artificial Sequence
  Synthetic
ggaggaagcggaagcggg

SEQ ID NO: 53714 - RNA, 19 nt, Artificial Sequence
  Synthetic
aggaggaagcggaagcggg

SEQ ID NO: 53715 - RNA, 20 nt, Artificial Sequence
  Synthetic
gaggaggaagcggaagcggg

SEQ ID NO: 53716 - RNA, 21 nt, Artificial Sequence
  Synthetic
ugaggaggaagcggaagcggg

SEQ ID NO: 53717 - RNA, 22 nt, Artificial Sequence
  Synthetic
gugaggaggaagcggaagcggg

SEQ ID NO: 53718 - RNA, 23 nt, Artificial Sequence
  Synthetic
ggugaggaggaagcggaagcggg

SEQ ID NO: 53719 - RNA, 24 nt, Artificial Sequence
  Synthetic
gggugaggaggaagcggaagcggg

SEQ ID NO: 53720 - RNA, 18 nt, Artificial Sequence
  Synthetic
cgcagggauccugcgggg

SEQ ID NO: 53721 - RNA, 19 nt, Artificial Sequence
  Synthetic
gcgcagggauccugcgggg

SEQ ID NO: 53722 - RNA, 20 nt, Artificial Sequence
  Synthetic
cgcgcagggauccugcgggg

SEQ ID NO: 53723 - RNA, 21 nt, Artificial Sequence
  Synthetic
acgcgcagggauccugcgggg

SEQ ID NO: 53724 - RNA, 22 nt, Artificial Sequence
  Synthetic
gacgcgcagggauccugcgggg

SEQ ID NO: 53725 - RNA, 23 nt, Artificial Sequence
  Synthetic
cgacgcgcagggauccugcgggg

SEQ ID NO: 53726 - RNA, 24 nt, Artificial Sequence
  Synthetic
ccgacgcgcagggauccugcgggg

SEQ ID NO: 53727 - RNA, 18 nt, Artificial Sequence
  Synthetic
gcgggggugggcccgugg

SEQ ID NO: 53728 - RNA, 19 nt, Artificial Sequence
  Synthetic
ugcgggggugggcccgugg

SEQ ID NO: 53729 - RNA, 20 nt, Artificial Sequence
  Synthetic
cugcgggggugggcccgugg

SEQ ID NO: 53730 - RNA, 21 nt, Artificial Sequence
  Synthetic
ccugcgggggugggcccgugg

SEQ ID NO: 53731 - RNA, 22 nt, Artificial Sequence
  Synthetic
uccugcgggggugggcccgugg

SEQ ID NO: 53732 - RNA, 23 nt, Artificial Sequence
  Synthetic
auccugcgggggugggcccgugg

SEQ ID NO: 53733 - RNA, 24 nt, Artificial Sequence
  Synthetic
gauccugcgggggugggcccgugg

SEQ ID NO: 53734 - RNA, 18 nt, Artificial Sequence
  Synthetic
auguucgaggcgggccug

SEQ ID NO: 53735 - RNA, 19 nt, Artificial Sequence
  Synthetic
gauguucgaggcgggccug

SEQ ID NO: 53736 - RNA, 20 nt, Artificial Sequence
  Synthetic
agauguucgaggcgggccug

SEQ ID NO: 53737 - RNA, 21 nt, Artificial Sequence
  Synthetic
gagauguucgaggcgggccug

SEQ ID NO: 53738 - RNA, 22 nt, Artificial Sequence
  Synthetic
ggagauguucgaggcgggccug

SEQ ID NO: 53739 - RNA, 23 nt, Artificial Sequence
  Synthetic
cggagauguucgaggcgggccug

SEQ ID NO: 53740 - RNA, 24 nt, Artificial Sequence
  Synthetic
acggagauguucgaggcgggccug

SEQ ID NO: 53741 - RNA, 18 nt, Artificial Sequence
  Synthetic
cgacgcgcagggauccug

SEQ ID NO: 53742 - RNA, 19 nt, Artificial Sequence
  Synthetic
ccgacgcgcagggauccug

SEQ ID NO: 53743 - RNA, 20 nt, Artificial Sequence
  Synthetic
gccgacgcgcagggauccug

SEQ ID NO: 53744 - RNA, 21 nt, Artificial Sequence
  Synthetic
cgccgacgcgcagggauccug

SEQ ID NO: 53745 - RNA, 22 nt, Artificial Sequence
  Synthetic
ccgccgacgcgcagggauccug

SEQ ID NO: 53746 - RNA, 23 nt, Artificial Sequence
  Synthetic
cccgccgacgcgcagggauccug

SEQ ID NO: 53747 - RNA, 24 nt, Artificial Sequence
  Synthetic
gcccgccgacgcgcagggauccug

SEQ ID NO: 53748 - RNA, 18 nt, Artificial Sequence
  Synthetic
ggggugggcccgugggug

SEQ ID NO: 53749 - RNA, 19 nt, Artificial Sequence
  Synthetic
gggggugggcccgugggug

SEQ ID NO: 53750 - RNA, 20 nt, Artificial Sequence
  Synthetic
cgggggugggcccgugggug

SEQ ID NO: 53751 - RNA, 21 nt, Artificial Sequence
  Synthetic
gcgggggugggcccgugggug

SEQ ID NO: 53752 - RNA, 22 nt, Artificial Sequence
  Synthetic
ugcgggggugggcccgugggug

SEQ ID NO: 53753 - RNA, 23 nt, Artificial Sequence
  Synthetic
cugcgggggugggcccgugggug

SEQ ID NO: 53754 - RNA, 24 nt, Artificial Sequence
  Synthetic
ccugcgggggugggcccgugggug

SEQ ID NO: 53755 - RNA, 18 nt, Artificial Sequence
  Synthetic
gcuucccgguaugguaau

SEQ ID NO: 53756 - RNA, 19 nt, Artificial Sequence
  Synthetic
ggcuucccgguaugguaau

SEQ ID NO: 53757 - RNA, 20 nt, Artificial Sequence
  Synthetic
cggcuucccgguaugguaau

SEQ ID NO: 53758 - RNA, 21 nt, Artificial Sequence
  Synthetic
ccggcuucccgguaugguaau

SEQ ID NO: 53759 - RNA, 22 nt, Artificial Sequence
  Synthetic
gccggcuucccgguaugguaau

SEQ ID NO: 53760 - RNA, 23 nt, Artificial Sequence
  Synthetic
cgccggcuucccgguaugguaau

SEQ ID NO: 53761 - RNA, 24 nt, Artificial Sequence
  Synthetic
gcgccggcuucccgguaugguaau

SEQ ID NO: 53762 - RNA, 18 nt, Artificial Sequence
  Synthetic
gcucuccgaagagacgau

SEQ ID NO: 53763 - RNA, 19 nt, Artificial Sequence
  Synthetic
cgcucuccgaagagacgau

SEQ ID NO: 53764 - RNA, 20 nt, Artificial Sequence
  Synthetic
ccgcucuccgaagagacgau

SEQ ID NO: 53765 - RNA, 21 nt, Artificial Sequence
  Synthetic
gccgcucuccgaagagacgau

SEQ ID NO: 53766 - RNA, 22 nt, Artificial Sequence
  Synthetic
ggccgcucuccgaagagacgau

SEQ ID NO: 53767 - RNA, 23 nt, Artificial Sequence
  Synthetic
aggccgcucuccgaagagacgau

SEQ ID NO: 53768 - RNA, 24 nt, Artificial Sequence
  Synthetic
gaggccgcucuccgaagagacgau

SEQ ID NO: 53769 - RNA, 18 nt, Artificial Sequence
  Synthetic
ggcucgccagcagcgacu

SEQ ID NO: 53770 - RNA, 19 nt, Artificial Sequence
  Synthetic
uggcucgccagcagcgacu

SEQ ID NO: 53771 - RNA, 20 nt, Artificial Sequence
  Synthetic
guggcucgccagcagcgacu

SEQ ID NO: 53772 - RNA, 21 nt, Artificial Sequence
  Synthetic
aguggcucgccagcagcgacu

SEQ ID NO: 53773 - RNA, 22 nt, Artificial Sequence
  Synthetic
caguggcucgccagcagcgacu

SEQ ID NO: 53774 - RNA, 23 nt, Artificial Sequence
  Synthetic
gcaguggcucgccagcagcgacu

SEQ ID NO: 53775 - RNA, 24 nt, Artificial Sequence
  Synthetic
ugcaguggcucgccagcagcgacu

SEQ ID NO: 53776 - RNA, 18 nt, Artificial Sequence
  Synthetic
uucaccgcgacuccaccu

SEQ ID NO: 53777 - RNA, 19 nt, Artificial Sequence
  Synthetic
cuucaccgcgacuccaccu

SEQ ID NO: 53778 - RNA, 20 nt, Artificial Sequence
  Synthetic
ccuucaccgcgacuccaccu

SEQ ID NO: 53779 - RNA, 21 nt, Artificial Sequence
  Synthetic
accuucaccgcgacuccaccu

SEQ ID NO: 53780 - RNA, 22 nt, Artificial Sequence
  Synthetic
gaccuucaccgcgacuccaccu

SEQ ID NO: 53781 - RNA, 23 nt, Artificial Sequence
  Synthetic
cgaccuucaccgcgacuccaccu

SEQ ID NO: 53782 - RNA, 24 nt, Artificial Sequence
  Synthetic
acgaccuucaccgcgacuccaccu

SEQ ID NO: 53783 - RNA, 18 nt, Artificial Sequence
  Synthetic
ccgacgcgcagggauccu

SEQ ID NO: 53784 - RNA, 19 nt, Artificial Sequence
  Synthetic
gccgacgcgcagggauccu

SEQ ID NO: 53785 - RNA, 20 nt, Artificial Sequence
  Synthetic
cgccgacgcgcagggauccu

SEQ ID NO: 53786 - RNA, 21 nt, Artificial Sequence
  Synthetic
ccgccgacgcgcagggauccu

SEQ ID NO: 53787 - RNA, 22 nt, Artificial Sequence
  Synthetic
cccgccgacgcgcagggauccu

SEQ ID NO: 53788 - RNA, 23 nt, Artificial Sequence
  Synthetic
gcccgccgacgcgcagggauccu

SEQ ID NO: 53789 - RNA, 24 nt, Artificial Sequence
  Synthetic
cgcccgccgacgcgcagggauccu

SEQ ID NO: 53790 - RNA, 18 nt, Artificial Sequence
  Synthetic
cggcggagccccggagcu

SEQ ID NO: 53791 - RNA, 19 nt, Artificial Sequence
  Synthetic
ccggcggagccccggagcu

SEQ ID NO: 53792 - RNA, 20 nt, Artificial Sequence
  Synthetic
gccggcggagccccggagcu

SEQ ID NO: 53793 - RNA, 21 nt, Artificial Sequence
  Synthetic
ggccggcggagccccggagcu

SEQ ID NO: 53794 - RNA, 22 nt, Artificial Sequence
  Synthetic
cggccggcggagccccggagcu

SEQ ID NO: 53795 - RNA, 23 nt, Artificial Sequence
  Synthetic
ucggccggcggagccccggagcu

SEQ ID NO: 53796 - RNA, 24 nt, Artificial Sequence
  Synthetic
cucggccggcggagccccggagcu

SEQ ID NO: 53797 - RNA, 18 nt, Artificial Sequence
  Synthetic
ucugcgcgaggccgcucu

SEQ ID NO: 53798 - RNA, 19 nt, Artificial Sequence
  Synthetic
gucugcgcgaggccgcucu

SEQ ID NO: 53799 - RNA, 20 nt, Artificial Sequence
  Synthetic
ggucugcgcgaggccgcucu

SEQ ID NO: 53800 - RNA, 21 nt, Artificial Sequence
  Synthetic
aggucugcgcgaggccgcucu

SEQ ID NO: 53801 - RNA, 22 nt, Artificial Sequence
  Synthetic
aaggucugcgcgaggccgcucu

SEQ ID NO: 53802 - RNA, 23 nt, Artificial Sequence
  Synthetic
gaaggucugcgcgaggccgcucu

SEQ ID NO: 53803 - RNA, 24 nt, Artificial Sequence
  Synthetic
cgaaggucugcgcgaggccgcucu

SEQ ID NO: 53804 - RNA, 18 nt, Artificial Sequence
  Synthetic
uaugguaauuaaaaacgu

SEQ ID NO: 53805 - RNA, 19 nt, Artificial Sequence
  Synthetic
uuaugguaauuaaaaacgu

SEQ ID NO: 53806 - RNA, 20 nt, Artificial Sequence
  Synthetic
cuuaugguaauuaaaaacgu

SEQ ID NO: 53807 - RNA, 21 nt, Artificial Sequence
  Synthetic
gcuuaugguaauuaaaaacgu

SEQ ID NO: 53808 - RNA, 22 nt, Artificial Sequence
  Synthetic
cgcuuaugguaauuaaaaacgu

SEQ ID NO: 53809 - RNA, 23 nt, Artificial Sequence
  Synthetic
ccgcuuaugguaauuaaaaacgu

SEQ ID NO: 53810 - RNA, 24 nt, Artificial Sequence
  Synthetic
cccgcuuaugguaauuaaaaacgu

SEQ ID NO: 53811 - RNA, 18 nt, Artificial Sequence
  Synthetic
gggggugggcccgugggu

SEQ ID NO: 53812 - RNA, 19 nt, Artificial Sequence
  Synthetic
cgggggugggcccgugggu

SEQ ID NO: 53813 - RNA, 20 nt, Artificial Sequence
  Synthetic
gcgggggugggcccgugggu

SEQ ID NO: 53814 - RNA, 21 nt, Artificial Sequence
  Synthetic
ugcgggggugggcccgugggu

SEQ ID NO: 53815 - RNA, 22 nt, Artificial Sequence
  Synthetic
cugcgggggugggcccgugggu

SEQ ID NO: 53816 - RNA, 23 nt, Artificial Sequence
  Synthetic
ccugcgggggugggcccgugggu

SEQ ID NO: 53817 - RNA, 24 nt, Artificial Sequence
  Synthetic
uccugcgggggugggcccgugggu

SEQ ID NO: 53818 - RNA, 18 nt, Artificial Sequence
  Synthetic
gcacggacacggagaugu

SEQ ID NO: 53819 - RNA, 19 nt, Artificial Sequence
  Synthetic
agcacggacacggagaugu

SEQ ID NO: 53820 - RNA, 20 nt, Artificial Sequence
  Synthetic
cagcacggacacggagaugu

SEQ ID NO: 53821 - RNA, 21 nt, Artificial Sequence
  Synthetic
gcagcacggacacggagaugu

SEQ ID NO: 53822 - RNA, 22 nt, Artificial Sequence
  Synthetic
ggcagcacggacacggagaugu

SEQ ID NO: 53823 - RNA, 23 nt, Artificial Sequence
  Synthetic
gggcagcacggacacggagaugu

SEQ ID NO: 53824 - RNA, 24 nt, Artificial Sequence
  Synthetic
cgggcagcacggacacggagaugu

SEQ ID NO: 53825 - RNA, 17 nt, Artificial Sequence
  Synthetic
gcccucuaaaucccccc

SEQ ID NO: 53826 - RNA, 17 nt, Artificial Sequence
  Synthetic
gcccacggggguccccc

SEQ ID NO: 53827 - RNA, 17 nt, Artificial Sequence
  Synthetic
gacggggccgacccccg

SEQ ID NO: 53828 - RNA, 17 nt, Artificial Sequence
  Synthetic
ggggccgccccgagagg

SEQ ID NO: 53829 - RNA, 17 nt, Artificial Sequence
  Synthetic
gcuugacaaagcaacgg

SEQ ID NO: 53830 - RNA, 17 nt, Artificial Sequence
  Synthetic
ggugggcucgggggcgg

SEQ ID NO: 53831 - RNA, 20 nt, Artificial Sequence
  Synthetic
gaucggccccuauugguccc

SEQ ID NO: 53832 - RNA, 20 nt, Artificial Sequence
  Synthetic
gacggggccgccccgagagg

SEQ ID NO: 53833 - RNA, 20 nt, Artificial Sequence
  Synthetic
gcugcuugacaaagcaacgg

SEQ ID NO: 53834 - RNA, 20 nt, Artificial Sequence
  Synthetic
ggcggugggcucgggggcgg

SEQ ID NO: 53835 - RNA, 17 nt, Artificial Sequence
  Synthetic
cggccccuauugguccc

SEQ ID NO: 53836 - RNA, 17 nt, Artificial Sequence
  Synthetic
caccccggccccccgcc

SEQ ID NO: 53837 - RNA, 17 nt, Artificial Sequence
  Synthetic
aaagguggucugcgucc

SEQ ID NO: 53838 - RNA, 17 nt, Artificial Sequence
  Synthetic
ccccaaaggggcggcau

SEQ ID NO: 53839 - RNA, 20 nt, Artificial Sequence
  Synthetic
cgcgcccucuaaaucccccc

SEQ ID NO: 53840 - RNA, 20 nt, Artificial Sequence
  Synthetic
acggcccacggggguccccc

SEQ ID NO: 53841 - RNA, 20 nt, Artificial Sequence
  Synthetic
ccucaccccggccccccgcc

SEQ ID NO: 53842 - RNA, 20 nt, Artificial Sequence
  Synthetic
accaaagguggucugcgucc

SEQ ID NO: 53843 - RNA, 20 nt, Artificial Sequence
  Synthetic
cucccccaaaggggcggcau

SEQ ID NO: 53844 - RNA, 17 nt, Artificial Sequence
  Synthetic
caucccgugcaugaaga

SEQ ID NO: 53845 - RNA, 17 nt, Artificial Sequence
  Synthetic
cacacgucgcccccccc

SEQ ID NO: 53846 - RNA, 17 nt, Artificial Sequence
  Synthetic
cccggcgaccgccccgc

SEQ ID NO: 53847 - RNA, 17 nt, Artificial Sequence
  Synthetic
ucgccccccccucccgc

SEQ ID NO: 53848 - RNA, 17 nt, Artificial Sequence
  Synthetic
uuuuaacgggccgccau

SEQ ID NO: 53849 - RNA, 17 nt, Artificial Sequence
  Synthetic
gcggugaaggucgucgu

SEQ ID NO: 53850 - RNA, 17 nt, Artificial Sequence
  Synthetic
ucccgcucgcgguaauu

SEQ ID NO: 53851 - RNA, 20 nt, Artificial Sequence
  Synthetic
cugcaucccgugcaugaaga

SEQ ID NO: 53852 - RNA, 20 nt, Artificial Sequence
  Synthetic
gcgcacacgucgcccccccc

SEQ ID NO: 53853 - RNA, 20 nt, Artificial Sequence
  Synthetic
cgccccggcgaccgccccgc

SEQ ID NO: 53854 - RNA, 20 nt, Artificial Sequence
  Synthetic
acgucgccccccccucccgc

SEQ ID NO: 53855 - RNA, 20 nt, Artificial Sequence
  Synthetic
agcuuuuaacgggccgccau

SEQ ID NO: 53856 - RNA, 20 nt, Artificial Sequence
  Synthetic
gucgcggugaaggucgucgu

SEQ ID NO: 53857 - RNA, 20 nt, Artificial Sequence
  Synthetic
cguucccgcucgcgguaauu

SEQ ID NO: 53858 - RNA, 17 nt, Artificial Sequence
  Synthetic
gcucuccggcggcuuaa

SEQ ID NO: 53859 - RNA, 17 nt, Artificial Sequence
  Synthetic
gaacgcgcggcgccgga

SEQ ID NO: 53860 - RNA, 17 nt, Artificial Sequence
  Synthetic
ggugcgccccggccgga

SEQ ID NO: 53861 - RNA, 17 nt, Artificial Sequence
  Synthetic
gccgcgggccagcagac

SEQ ID NO: 53862 - RNA, 17 nt, Artificial Sequence
  Synthetic
ggcgccgggcggcuacc

SEQ ID NO: 53863 - RNA, 17 nt, Artificial Sequence
  Synthetic
gcgccgggcggcuaccc

SEQ ID NO: 53864 - RNA, 17 nt, Artificial Sequence
  Synthetic
ggcgcgaaaggggcccc

SEQ ID NO: 53865 - RNA, 17 nt, Artificial Sequence
  Synthetic
gguagccgcccggcgcc

SEQ ID NO: 53866 - RNA, 17 nt, Artificial Sequence
  Synthetic
guugcgggcgccgugcc

SEQ ID NO: 53867 - RNA, 17 nt, Artificial Sequence
  Synthetic
gcggcagcaacgaacgc

SEQ ID NO: 53868 - RNA, 17 nt, Artificial Sequence
  Synthetic
ggccgccggaugcccgc

SEQ ID NO: 53869 - RNA, 17 nt, Artificial Sequence
  Synthetic
gagauccauuaagccgc

SEQ ID NO: 53870 - RNA, 17 nt, Artificial Sequence
  Synthetic
gaacgcggaaacgccgc

SEQ ID NO: 53871 - RNA, 17 nt, Artificial Sequence
  Synthetic
guucucuccgccgcggc

SEQ ID NO: 53872 - RNA, 17 nt, Artificial Sequence
  Synthetic
gcggcuuaauggaucuc

SEQ ID NO: 53873 - RNA, 17 nt, Artificial Sequence
  Synthetic
gcccgccgccgaucgag

SEQ ID NO: 53874 - RNA, 17 nt, Artificial Sequence
  Synthetic
gccgcauuaggcccccg

SEQ ID NO: 53875 - RNA, 17 nt, Artificial Sequence
  Synthetic
gcgaaaggggcccccgg

SEQ ID NO: 53876 - RNA, 17 nt, Artificial Sequence
  Synthetic
gcgggggccuaaugcgg

SEQ ID NO: 53877 - RNA, 17 nt, Artificial Sequence
  Synthetic
gagucccucucgaucgg

SEQ ID NO: 53878 - RNA, 17 nt, Artificial Sequence
  Synthetic
gggccuaaugcggcggg

SEQ ID NO: 53879 - RNA, 17 nt, Artificial Sequence
  Synthetic
gcgcccccccccaacgu

SEQ ID NO: 53880 - RNA, 17 nt, Artificial Sequence
  Synthetic
guuuaauggaagggcgu

SEQ ID NO: 53881 - RNA, 20 nt, Artificial Sequence
  Synthetic
gcguucgcgaaaggcgcgaa

SEQ ID NO: 53882 - RNA, 20 nt, Artificial Sequence
  Synthetic
gccacguaaacaaugacaca

SEQ ID NO: 53883 - RNA, 20 nt, Artificial Sequence
  Synthetic
gcgcggcagcaacgaacgca

SEQ ID NO: 53884 - RNA, 20 nt, Artificial Sequence
  Synthetic
gcuuaauggaucuccgggca

SEQ ID NO: 53885 - RNA, 20 nt, Artificial Sequence
  Synthetic
gggcccgccgccgaucgaga

SEQ ID NO: 53886 - RNA, 20 nt, Artificial Sequence
  Synthetic
gucuucuuccgcgccuccga

SEQ ID NO: 53887 - RNA, 20 nt, Artificial Sequence
  Synthetic
ggccacguaaacaaugacac

SEQ ID NO: 53888 - RNA, 20 nt, Artificial Sequence
  Synthetic
guggccgcgggccagcagac

SEQ ID NO: 53889 - RNA, 20 nt, Artificial Sequence
  Synthetic
gggcggcuacccgggacccc

SEQ ID NO: 53890 - RNA, 20 nt, Artificial Sequence
  Synthetic
guucguugcugccgcgcccc

SEQ ID NO: 53891 - RNA, 20 nt, Artificial Sequence
  Synthetic
ggcggaaggcgucccccgcc

SEQ ID NO: 53892 - RNA, 20 nt, Artificial Sequence
  Synthetic
gacgccuuccgcccggcgcc

SEQ ID NO: 53893 - RNA, 20 nt, Artificial Sequence
  Synthetic
gcuuuuuucgauucccggcc

SEQ ID NO: 53894 - RNA, 20 nt, Artificial Sequence
  Synthetic
gcaaccgcagagcacucagc

SEQ ID NO: 53895 - RNA, 20 nt, Artificial Sequence
  Synthetic
gucauuguuuacguggccgc

SEQ ID NO: 53896 - RNA, 20 nt, Artificial Sequence
  Synthetic
ggacgccuuccgcccggcgc

SEQ ID NO: 53897 - RNA, 20 nt, Artificial Sequence
  Synthetic
ggcuacccgggacccccggc

SEQ ID NO: 53898 - RNA, 20 nt, Artificial Sequence
  Synthetic
ggcuuuuuucgauucccggc

SEQ ID NO: 53899 - RNA, 20 nt, Artificial Sequence
  Synthetic
gcccacagcaacacgcgggc

SEQ ID NO: 53900 - RNA, 20 nt, Artificial Sequence
  Synthetic
gcaacacgcgggcggggcuc

SEQ ID NO: 53901 - RNA, 20 nt, Artificial Sequence
  Synthetic
guucgcgaaaggcgcgaaag

SEQ ID NO: 53902 - RNA, 20 nt, Artificial Sequence
  Synthetic
gcgcgcggaaaagcagcaag

SEQ ID NO: 53903 - RNA, 20 nt, Artificial Sequence
  Synthetic
gcgcggaaaagcagcaagag

SEQ ID NO: 53904 - RNA, 20 nt, Artificial Sequence
  Synthetic
ggggcccgccgccgaucgag

SEQ ID NO: 53905 - RNA, 20 nt, Artificial Sequence
  Synthetic
gcgaacgcgcggcgccggag

SEQ ID NO: 53906 - RNA, 20 nt, Artificial Sequence
  Synthetic
gaaaugcccacagcaacacg

SEQ ID NO: 53907 - RNA, 20 nt, Artificial Sequence
  Synthetic
ggggcccccgcgcuccgccg

SEQ ID NO: 53908 - RNA, 20 nt, Artificial Sequence
  Synthetic
gcaacgccccgcgccggccg

SEQ ID NO: 53909 - RNA, 20 nt, Artificial Sequence
  Synthetic
gccuaaugcggcgggaggcg

SEQ ID NO: 53910 - RNA, 20 nt, Artificial Sequence
  Synthetic
gaguguuuaauggaagggcg

SEQ ID NO: 53911 - RNA, 20 nt, Artificial Sequence
  Synthetic
gcgcggaagaagacgggagg

SEQ ID NO: 53912 - RNA, 20 nt, Artificial Sequence
  Synthetic
ggcgcgaaaggggcccccgg

SEQ ID NO: 53913 - RNA, 20 nt, Artificial Sequence
  Synthetic
gaaucgaaaaaagccuccgg

SEQ ID NO: 53914 - RNA, 20 nt, Artificial Sequence
  Synthetic
gagucccucucgaucggcgg

SEQ ID NO: 53915 - RNA, 20 nt, Artificial Sequence
  Synthetic
gccuuccgcccggcgccggg

SEQ ID NO: 53916 - RNA, 20 nt, Artificial Sequence
  Synthetic
ggcgcgcccccccccaacgu

SEQ ID NO: 53917 - RNA, 17 nt, Artificial Sequence
  Synthetic
ucgcgaaaggcgcgaaa

SEQ ID NO: 53918 - RNA, 17 nt, Artificial Sequence
  Synthetic
uucgcgaaaggcgcgaa

SEQ ID NO: 53919 - RNA, 17 nt, Artificial Sequence
  Synthetic
cgccgcgcguucgcgaa

SEQ ID NO: 53920 - RNA, 17 nt, Artificial Sequence
  Synthetic
aacgugggaguguuuaa

SEQ ID NO: 53921 - RNA, 17 nt, Artificial Sequence
  Synthetic
cggcagcaacgaacgca

SEQ ID NO: 53922 - RNA, 17 nt, Artificial Sequence
  Synthetic
uaauggaucuccgggca

SEQ ID NO: 53923 - RNA, 17 nt, Artificial Sequence
  Synthetic
cccgccgccgaucgaga

SEQ ID NO: 53924 - RNA, 17 nt, Artificial Sequence
  Synthetic
uucuuccgcgccuccga

SEQ ID NO: 53925 - RNA, 17 nt, Artificial Sequence
  Synthetic
cacguaaacaaugacac

SEQ ID NO: 53926 - RNA, 17 nt, Artificial Sequence
  Synthetic
aaggcugcuccgcgcac

SEQ ID NO: 53927 - RNA, 17 nt, Artificial Sequence
  Synthetic
uuuuucgauucccggcc

SEQ ID NO: 53928 - RNA, 17 nt, Artificial Sequence
  Synthetic
cgcccggcgguccggcc

SEQ ID NO: 53929 - RNA, 17 nt, Artificial Sequence
  Synthetic
cggcuuaauggaucucc

SEQ ID NO: 53930 - RNA, 17 nt, Artificial Sequence
  Synthetic
ccgcauuaggcccccgc

SEQ ID NO: 53931 - RNA, 17 nt, Artificial Sequence
  Synthetic
ugcucggcugcggccgc

SEQ ID NO: 53932 - RNA, 17 nt, Artificial Sequence
  Synthetic
auuguuuacguggccgc

SEQ ID NO: 53933 - RNA, 17 nt, Artificial Sequence
  Synthetic
ucgcgaacgcgcggcgc

SEQ ID NO: 53934 - RNA, 17 nt, Artificial Sequence
  Synthetic
ccgaggugcgccccggc

SEQ ID NO: 53935 - RNA, 17 nt, Artificial Sequence
  Synthetic
uuuuuucgauucccggc

SEQ ID NO: 53936 - RNA, 17 nt, Artificial Sequence
  Synthetic
cccucucgaucggcggc

SEQ ID NO: 53937 - RNA, 17 nt, Artificial Sequence
  Synthetic
cgggggccuaaugcggc

SEQ ID NO: 53938 - RNA, 17 nt, Artificial Sequence
  Synthetic
cacagcaacacgcgggc

SEQ ID NO: 53939 - RNA, 17 nt, Artificial Sequence
  Synthetic
aggcccccgcgggcauc

SEQ ID NO: 53940 - RNA, 17 nt, Artificial Sequence
  Synthetic
ccgaucgagagggacuc

SEQ ID NO: 53941 - RNA, 17 nt, Artificial Sequence
  Synthetic
cgcgaaaggcgcgaaag

SEQ ID NO: 53942 - RNA, 17 nt, Artificial Sequence
  Synthetic
cgcggaaaagcagcaag

SEQ ID NO: 53943 - RNA, 17 nt, Artificial Sequence
  Synthetic
aacgcgcggcgccggag

SEQ ID NO: 53944 - RNA, 17 nt, Artificial Sequence
  Synthetic
cgcgcccccccccaacg

SEQ ID NO: 53945 - RNA, 17 nt, Artificial Sequence
  Synthetic
agggguucucuccgccg

SEQ ID NO: 53946 - RNA, 17 nt, Artificial Sequence
  Synthetic
uuuucgauucccggccg

SEQ ID NO: 53947 - RNA, 17 nt, Artificial Sequence
  Synthetic
aucgaaaaaagccuccg

SEQ ID NO: 53948 - RNA, 17 nt, Artificial Sequence
  Synthetic
cuucuuccgcgccuccg

SEQ ID NO: 53949 - RNA, 17 nt, Artificial Sequence
  Synthetic
cgccuuucgcgaacgcg

SEQ ID NO: 53950 - RNA, 17 nt, Artificial Sequence
  Synthetic
uaaugcggcgggaggcg

SEQ ID NO: 53951 - RNA, 17 nt, Artificial Sequence
  Synthetic
cggaaacgccgccggcg

SEQ ID NO: 53952 - RNA, 17 nt, Artificial Sequence
  Synthetic
acagcaacacgcgggcg

SEQ ID NO: 53953 - RNA, 17 nt, Artificial Sequence
  Synthetic
aagggcgcgccggugcg

SEQ ID NO: 53954 - RNA, 17 nt, Artificial Sequence
  Synthetic
acgcgcggcgccggagg

SEQ ID NO: 53955 - RNA, 17 nt, Artificial Sequence
  Synthetic
cgaacgcgcggcgccgg

SEQ ID NO: 53956 - RNA, 17 nt, Artificial Sequence
  Synthetic
aggugcgccccggccgg

SEQ ID NO: 53957 - RNA, 17 nt, Artificial Sequence
  Synthetic
uuucgauucccggccgg

SEQ ID NO: 53958 - RNA, 17 nt, Artificial Sequence
  Synthetic
cccccgcgggcauccgg

SEQ ID NO: 53959 - RNA, 17 nt, Artificial Sequence
  Synthetic
ucgaaaaaagccuccgg

SEQ ID NO: 53960 - RNA, 17 nt, Artificial Sequence
  Synthetic
ccgccggaugcccgcgg

SEQ ID NO: 53961 - RNA, 17 nt, Artificial Sequence
  Synthetic
ucccucucgaucggcgg

SEQ ID NO: 53962 - RNA, 17 nt, Artificial Sequence
  Synthetic
aaacacucccacguugg

SEQ ID NO: 53963 - RNA, 17 nt, Artificial Sequence
  Synthetic
cccgcgggggccuaaug

SEQ ID NO: 53964 - RNA, 17 nt, Artificial Sequence
  Synthetic
uaaacacucccacguug

SEQ ID NO: 53965 - RNA, 17 nt, Artificial Sequence
  Synthetic
ccggagucccucucgau

SEQ ID NO: 53966 - RNA, 17 nt, Artificial Sequence
  Synthetic
aacacgcgggcggggcu

SEQ ID NO: 53967 - RNA, 17 nt, Artificial Sequence
  Synthetic
auuaaacacucccacgu

SEQ ID NO: 53968 - RNA, 17 nt, Artificial Sequence
  Synthetic
aaugcggcgggaggcgu

SEQ ID NO: 53969 - RNA, 17 nt, Artificial Sequence
  Synthetic
acgccucccgccgcauu

SEQ ID NO: 53970 - RNA, 17 nt, Artificial Sequence
  Synthetic
uuaaacacucccacguu

SEQ ID NO: 53971 - RNA, 20 nt, Artificial Sequence
  Synthetic
cguucgcgaaaggcgcgaaa

SEQ ID NO: 53972 - RNA, 20 nt, Artificial Sequence
  Synthetic
cggcgccgcgcguucgcgaa

SEQ ID NO: 53973 - RNA, 20 nt, Artificial Sequence
  Synthetic
cgggcucuccggcggcuuaa

SEQ ID NO: 53974 - RNA, 20 nt, Artificial Sequence
  Synthetic
cguggccgcgggccagcaga

SEQ ID NO: 53975 - RNA, 20 nt, Artificial Sequence
  Synthetic
aucgagagggacuccggaga

SEQ ID NO: 53976 - RNA, 20 nt, Artificial Sequence
  Synthetic
cgcgaacgcgcggcgccgga

SEQ ID NO: 53977 - RNA, 20 nt, Artificial Sequence
  Synthetic
acgugggaguguuuaaugga

SEQ ID NO: 53978 - RNA, 20 nt, Artificial Sequence
  Synthetic
aggaaggcugcuccgcgcac

SEQ ID NO: 53979 - RNA, 20 nt, Artificial Sequence
  Synthetic
ucggaggcgcggaagaagac

SEQ ID NO: 53980 - RNA, 20 nt, Artificial Sequence
  Synthetic
cgggcagagugcggagcccc

SEQ ID NO: 53981 - RNA, 20 nt, Artificial Sequence
  Synthetic
aaaggcgcgaaaggggcccc

SEQ ID NO: 53982 - RNA, 20 nt, Artificial Sequence
  Synthetic
uuggccgccgaggugcgccc

SEQ ID NO: 53983 - RNA, 20 nt, Artificial Sequence
  Synthetic
aaacgccgccggcgcggccc

SEQ ID NO: 53984 - RNA, 20 nt, Artificial Sequence
  Synthetic
ccggguagccgcccggcgcc

SEQ ID NO: 53985 - RNA, 20 nt, Artificial Sequence
  Synthetic
cggcggcuuaauggaucucc

SEQ ID NO: 53986 - RNA, 20 nt, Artificial Sequence
  Synthetic
cgauucccggccgggggucc

SEQ ID NO: 53987 - RNA, 20 nt, Artificial Sequence
  Synthetic
ccgccgcauuaggcccccgc

SEQ ID NO: 53988 - RNA, 20 nt, Artificial Sequence
  Synthetic
ccggagauccauuaagccgc

SEQ ID NO: 53989 - RNA, 20 nt, Artificial Sequence
  Synthetic
acggaacgcggaaacgccgc

SEQ ID NO: 53990 - RNA, 20 nt, Artificial Sequence
  Synthetic
ccgcagccgagcagcgccgc

SEQ ID NO: 53991 - RNA, 20 nt, Artificial Sequence
  Synthetic
cuuucgcgaacgcgcggcgc

SEQ ID NO: 53992 - RNA, 20 nt, Artificial Sequence
  Synthetic
cgcggaagaagacgggaggc

SEQ ID NO: 53993 - RNA, 20 nt, Artificial Sequence
  Synthetic
ccgccgaggugcgccccggc

SEQ ID NO: 53994 - RNA, 20 nt, Artificial Sequence
  Synthetic
ccgcgggggccuaaugcggc

SEQ ID NO: 53995 - RNA, 20 nt, Artificial Sequence
  Synthetic
uuaauggaagggcguggggc

SEQ ID NO: 53996 - RNA, 20 nt, Artificial Sequence
  Synthetic
cggccggcgcggggcguugc

SEQ ID NO: 53997 - RNA, 20 nt, Artificial Sequence
  Synthetic
auuaggcccccgcgggcauc

SEQ ID NO: 53998 - RNA, 20 nt, Artificial Sequence
  Synthetic
ccgccgaucgagagggacuc

SEQ ID NO: 53999 - RNA, 20 nt, Artificial Sequence
  Synthetic
cgggaaucgaaaaaagccuc

SEQ ID NO: 54000 - RNA, 20 nt, Artificial Sequence
  Synthetic
ccggcggcuuaauggaucuc

SEQ ID NO: 54001 - RNA, 20 nt, Artificial Sequence
  Synthetic
uggcgcgcccccccccaacg

SEQ ID NO: 54002 - RNA, 20 nt, Artificial Sequence
  Synthetic
ccccugugucauuguuuacg

SEQ ID NO: 54003 - RNA, 20 nt, Artificial Sequence
  Synthetic
cccgccgcauuaggcccccg

SEQ ID NO: 54004 - RNA, 20 nt, Artificial Sequence
  Synthetic
cacagggguucucuccgccg

SEQ ID NO: 54005 - RNA, 20 nt, Artificial Sequence
  Synthetic
cuuuuuucgauucccggccg

SEQ ID NO: 54006 - RNA, 20 nt, Artificial Sequence
  Synthetic
ugcgggggccccuccggccg

SEQ ID NO: 54007 - RNA, 20 nt, Artificial Sequence
  Synthetic
ugucauuguuuacguggccg

SEQ ID NO: 54008 - RNA, 20 nt, Artificial Sequence
  Synthetic
cgucuucuuccgcgccuccg

SEQ ID NO: 54009 - RNA, 20 nt, Artificial Sequence
  Synthetic
ucgcgccuuucgcgaacgcg

SEQ ID NO: 54010 - RNA, 20 nt, Artificial Sequence
  Synthetic
ucuccgccgcggccggcgcg

SEQ ID NO: 54011 - RNA, 20 nt, Artificial Sequence
  Synthetic
acgcggaaacgccgccggcg

SEQ ID NO: 54012 - RNA, 20 nt, Artificial Sequence
  Synthetic
cccacagcaacacgcgggcg

SEQ ID NO: 54013 - RNA, 20 nt, Artificial Sequence
  Synthetic
uuuuuucgauucccggccgg

SEQ ID NO: 54014 - RNA, 20 nt, Artificial Sequence
  Synthetic
aggcccccgcgggcauccgg

SEQ ID NO: 54015 - RNA, 20 nt, Artificial Sequence
  Synthetic
cccgcgggggccuaaugcgg

SEQ ID NO: 54016 - RNA, 20 nt, Artificial Sequence
  Synthetic
ccggagucccucucgaucgg

SEQ ID NO: 54017 - RNA, 20 nt, Artificial Sequence
  Synthetic
ccggccggggcgcaccucgg

SEQ ID NO: 54018 - RNA, 20 nt, Artificial Sequence
  Synthetic
cugccucggggacccccggg

SEQ ID NO: 54019 - RNA, 20 nt, Artificial Sequence
  Synthetic
cgggggccuaaugcggcggg

SEQ ID NO: 54020 - RNA, 20 nt, Artificial Sequence
  Synthetic
uaaacacucccacguugggg

SEQ ID NO: 54021 - RNA, 20 nt, Artificial Sequence
  Synthetic
auuaaacacucccacguugg

SEQ ID NO: 54022 - RNA, 20 nt, Artificial Sequence
  Synthetic
augcccgcgggggccuaaug

SEQ ID NO: 54023 - RNA, 20 nt, Artificial Sequence
  Synthetic
cgcgccagcugagugcucug

SEQ ID NO: 54024 - RNA, 20 nt, Artificial Sequence
  Synthetic
ucuccggagucccucucgau

SEQ ID NO: 54025 - RNA, 20 nt, Artificial Sequence
  Synthetic
ccggaggggcccccgcaccu

SEQ ID NO: 54026 - RNA, 20 nt, Artificial Sequence
  Synthetic
ccgaggguccgccucugccu

SEQ ID NO: 54027 - RNA, 20 nt, Artificial Sequence
  Synthetic
uccauuaaacacucccacgu

SEQ ID NO: 54028 - RNA, 20 nt, Artificial Sequence
  Synthetic
ccuaaugcggcgggaggcgu

SEQ ID NO: 54029 - RNA, 20 nt, Artificial Sequence
  Synthetic
aguguuuaauggaagggcgu

SEQ ID NO: 54030 - RNA, 20 nt, Artificial Sequence
  Synthetic
cccacgccucccgccgcauu

SEQ ID NO: 54031 - RNA, 17 nt, Artificial Sequence
  Synthetic
ggaggcgggggaaaaaa

SEQ ID NO: 54032 - RNA, 17 nt, Artificial Sequence
  Synthetic
gggaggcgggggaaaaa

SEQ ID NO: 54033 - RNA, 17 nt, Artificial Sequence
  Synthetic
ggggagagggaaagcaa

SEQ ID NO: 54034 - RNA, 17 nt, Artificial Sequence
  Synthetic
gggaggggagaggagaa

SEQ ID NO: 54035 - RNA, 17 nt, Artificial Sequence
  Synthetic
gggaguguuuaauggaa

SEQ ID NO: 54036 - RNA, 17 nt, Artificial Sequence
  Synthetic
gcggaaaagcagcaaga

SEQ ID NO: 54037 - RNA, 17 nt, Artificial Sequence
  Synthetic
ggaggcgcggaagaaga

SEQ ID NO: 54038 - RNA, 17 nt, Artificial Sequence
  Synthetic
ggccgcgggccagcaga

SEQ ID NO: 54039 - RNA, 17 nt, Artificial Sequence
  Synthetic
gagagggacuccggaga

SEQ ID NO: 54040 - RNA, 17 nt, Artificial Sequence
  Synthetic
gggacuccggagaagga

SEQ ID NO: 54041 - RNA, 17 nt, Artificial Sequence
  Synthetic
gcccggcgccgggcgga

SEQ ID NO: 54042 - RNA, 17 nt, Artificial Sequence
  Synthetic
gagcggggcggccggga

SEQ ID NO: 54043 - RNA, 17 nt, Artificial Sequence
  Synthetic
gaagagagggggaggua

SEQ ID NO: 54044 - RNA, 17 nt, Artificial Sequence
  Synthetic
gggagagggaaagcaac

SEQ ID NO: 54045 - RNA, 17 nt, Artificial Sequence
  Synthetic
gaggcgcggaagaagac

SEQ ID NO: 54046 - RNA, 17 nt, Artificial Sequence
  Synthetic
gcagcaagaggggggac

SEQ ID NO: 54047 - RNA, 17 nt, Artificial Sequence
  Synthetic
gcagagugcggagcccc

SEQ ID NO: 54048 - RNA, 17 nt, Artificial Sequence
  Synthetic
gguccggcccgggcccc

SEQ ID NO: 54049 - RNA, 17 nt, Artificial Sequence
  Synthetic
gggggccccggggcccc

SEQ ID NO: 54050 - RNA, 17 nt, Artificial Sequence
  Synthetic
gcgcggcccggggcccc

SEQ ID NO: 54051 - RNA, 17 nt, Artificial Sequence
  Synthetic
gccgccgaggugcgccc

SEQ ID NO: 54052 - RNA, 17 nt, Artificial Sequence
  Synthetic
gcccggcgguccggccc

SEQ ID NO: 54053 - RNA, 17 nt, Artificial Sequence
  Synthetic
ggcgcggcccggggccc

SEQ ID NO: 54054 - RNA, 17 nt, Artificial Sequence
  Synthetic
gcggagcgcgggggccc

SEQ ID NO: 54055 - RNA, 17 nt, Artificial Sequence
  Synthetic
gggggacggggcgagcc

SEQ ID NO: 54056 - RNA, 17 nt, Artificial Sequence
  Synthetic
gcccgggccggaccgcc

SEQ ID NO: 54057 - RNA, 17 nt, Artificial Sequence
  Synthetic
ggaaggcgucccccgcc

SEQ ID NO: 54058 - RNA, 17 nt, Artificial Sequence
  Synthetic
ggucccggguagccgcc

SEQ ID NO: 54059 - RNA, 17 nt, Artificial Sequence
  Synthetic
ggcccccgcgcuccgcc

SEQ ID NO: 54060 - RNA, 17 nt, Artificial Sequence
  Synthetic
gggggacgccuuccgcc

SEQ ID NO: 54061 - RNA, 17 nt, Artificial Sequence
  Synthetic
gccuuccgcccggcgcc

SEQ ID NO: 54062 - RNA, 17 nt, Artificial Sequence
  Synthetic
gcguugccggcccggcc

SEQ ID NO: 54063 - RNA, 17 nt, Artificial Sequence
  Synthetic
gcggggcguugccggcc

SEQ ID NO: 54064 - RNA, 17 nt, Artificial Sequence
  Synthetic
ggcuccggggccgggcc

SEQ ID NO: 54065 - RNA, 17 nt, Artificial Sequence
  Synthetic
ggacccccgggcgggcc

SEQ ID NO: 54066 - RNA, 17 nt, Artificial Sequence
  Synthetic
gcgcuccgccgggggcc

SEQ ID NO: 54067 - RNA, 17 nt, Artificial Sequence
  Synthetic
gggcuccgcacucugcc

SEQ ID NO: 54068 - RNA, 17 nt, Artificial Sequence
  Synthetic
gcagcgccgcgggcucc

SEQ ID NO: 54069 - RNA, 17 nt, Artificial Sequence
  Synthetic
ggggggacggggcgagc

SEQ ID NO: 54070 - RNA, 17 nt, Artificial Sequence
  Synthetic
ggcccgggccggaccgc

SEQ ID NO: 54071 - RNA, 17 nt, Artificial Sequence
  Synthetic
ggcguggggccggccgc

SEQ ID NO: 54072 - RNA, 17 nt, Artificial Sequence
  Synthetic
gccagcagacgggccgc

SEQ ID NO: 54073 - RNA, 17 nt, Artificial Sequence
  Synthetic
gggcccccgcgcuccgc

SEQ ID NO: 54074 - RNA, 17 nt, Artificial Sequence
  Synthetic
ggcccccggcggagcgc

SEQ ID NO: 54075 - RNA, 17 nt, Artificial Sequence
  Synthetic
ggggccccgggccgcgc

SEQ ID NO: 54076 - RNA, 17 nt, Artificial Sequence
  Synthetic
ggguagccgcccggcgc

SEQ ID NO: 54077 - RNA, 17 nt, Artificial Sequence
  Synthetic
ggaagaagacgggaggc

SEQ ID NO: 54078 - RNA, 17 nt, Artificial Sequence
  Synthetic
gcgggggccccuccggc

SEQ ID NO: 54079 - RNA, 17 nt, Artificial Sequence
  Synthetic
gggccggaccgccgggc

SEQ ID NO: 54080 - RNA, 17 nt, Artificial Sequence
  Synthetic
gggcuccggggccgggc

SEQ ID NO: 54081 - RNA, 17 nt, Artificial Sequence
  Synthetic
gggacccccgggcgggc

SEQ ID NO: 54082 - RNA, 17 nt, Artificial Sequence
  Synthetic
gccgcgggcuccggggc

SEQ ID NO: 54083 - RNA, 17 nt, Artificial Sequence
  Synthetic
gcccgcggcccgucugc

SEQ ID NO: 54084 - RNA, 17 nt, Artificial Sequence
  Synthetic
ggcggccgccgaggugc

SEQ ID NO: 54085 - RNA, 17 nt, Artificial Sequence
  Synthetic
gagugcucugcgguugc

SEQ ID NO: 54086 - RNA, 17 nt, Artificial Sequence
  Synthetic
gaaucgaaaaaagccuc

SEQ ID NO: 54087 - RNA, 17 nt, Artificial Sequence
  Synthetic
ggguccgccucugccuc

SEQ ID NO: 54088 - RNA, 17 nt, Artificial Sequence
  Synthetic
gcugcggccgcgggcuc

SEQ ID NO: 54089 - RNA, 17 nt, Artificial Sequence
  Synthetic
gcggggcucgggcucuc

SEQ ID NO: 54090 - RNA, 17 nt, Artificial Sequence
  Synthetic
gagcagccuuccuucuc

SEQ ID NO: 54091 - RNA, 17 nt, Artificial Sequence
  Synthetic
gaggcgggggaaaaaag

SEQ ID NO: 54092 - RNA, 17 nt, Artificial Sequence
  Synthetic
ggcagcaacgaacgcag

SEQ ID NO: 54093 - RNA, 17 nt, Artificial Sequence
  Synthetic
ggggguccccgaggcag

SEQ ID NO: 54094 - RNA, 17 nt, Artificial Sequence
  Synthetic
gaaaaaagggggaagag

SEQ ID NO: 54095 - RNA, 17 nt, Artificial Sequence
  Synthetic
gagagagagagagagag

SEQ ID NO: 54096 - RNA, 17 nt, Artificial Sequence
  Synthetic
gugcgccccggccggag

SEQ ID NO: 54097 - RNA, 17 nt, Artificial Sequence
  Synthetic
gagggggagguagggag

SEQ ID NO: 54098 - RNA, 17 nt, Artificial Sequence
  Synthetic
ggagguagggaggggag

SEQ ID NO: 54099 - RNA, 17 nt, Artificial Sequence
  Synthetic
gagggggggggggggag

SEQ ID NO: 54100 - RNA, 17 nt, Artificial Sequence
  Synthetic
ggagaagaaacggaacg

SEQ ID NO: 54101 - RNA, 17 nt, Artificial Sequence
  Synthetic
ggagcgcgggggccccg

SEQ ID NO: 54102 - RNA, 17 nt, Artificial Sequence
  Synthetic
ggagcccccggagcccg

SEQ ID NO: 54103 - RNA, 17 nt, Artificial Sequence
  Synthetic
gccgccggcgcggcccg

SEQ ID NO: 54104 - RNA, 17 nt, Artificial Sequence
  Synthetic
gcccgucugcuggcccg

SEQ ID NO: 54105 - RNA, 17 nt, Artificial Sequence
  Synthetic
ggagggggcggccgccg

SEQ ID NO: 54106 - RNA, 17 nt, Artificial Sequence
  Synthetic
gcccccgcgcuccgccg

SEQ ID NO: 54107 - RNA, 17 nt, Artificial Sequence
  Synthetic
gcagccgagcagcgccg

SEQ ID NO: 54108 - RNA, 17 nt, Artificial Sequence
  Synthetic
gugggccgcuggcgccg

SEQ ID NO: 54109 - RNA, 17 nt, Artificial Sequence
  Synthetic
gggggccccuccggccg

SEQ ID NO: 54110 - RNA, 17 nt, Artificial Sequence
  Synthetic
ggccagcagacgggccg

SEQ ID NO: 54111 - RNA, 17 nt, Artificial Sequence
  Synthetic
gacccccgggcgggccg

SEQ ID NO: 54112 - RNA, 17 nt, Artificial Sequence
  Synthetic
gggcccccggcggagcg

SEQ ID NO: 54113 - RNA, 17 nt, Artificial Sequence
  Synthetic
gccgccggaugcccgcg

SEQ ID NO: 54114 - RNA, 17 nt, Artificial Sequence
  Synthetic
gcccccggcggagcgcg

SEQ ID NO: 54115 - RNA, 17 nt, Artificial Sequence
  Synthetic
gcggacccucggaggcg

SEQ ID NO: 54116 - RNA, 17 nt, Artificial Sequence
  Synthetic
gaagaagacgggaggcg

SEQ ID NO: 54117 - RNA, 17 nt, Artificial Sequence
  Synthetic
ggccggaccgccgggcg

SEQ ID NO: 54118 - RNA, 17 nt, Artificial Sequence
  Synthetic
gcggccgccgaggugcg

SEQ ID NO: 54119 - RNA, 17 nt, Artificial Sequence
  Synthetic
gguccgccucugccucg

SEQ ID NO: 54120 - RNA, 17 nt, Artificial Sequence
  Synthetic
ggaaaagcagcaagagg

SEQ ID NO: 54121 - RNA, 17 nt, Artificial Sequence
  Synthetic
gguccccgaggcagagg

SEQ ID NO: 54122 - RNA, 17 nt, Artificial Sequence
  Synthetic
gccccgggccgcgccgg

SEQ ID NO: 54123 - RNA, 17 nt, Artificial Sequence
  Synthetic
gcggccgcgggcuccgg

SEQ ID NO: 54124 - RNA, 17 nt, Artificial Sequence
  Synthetic
gggcucgggcucuccgg

SEQ ID NO: 54125 - RNA, 17 nt, Artificial Sequence
  Synthetic
gccggaccgccgggcgg

SEQ ID NO: 54126 - RNA, 17 nt, Artificial Sequence
  Synthetic
gggcccccgcaccucgg

SEQ ID NO: 54127 - RNA, 17 nt, Artificial Sequence
  Synthetic
gccggggcgcaccucgg

SEQ ID NO: 54128 - RNA, 17 nt, Artificial Sequence
  Synthetic
gaaaagcagcaagaggg

SEQ ID NO: 54129 - RNA, 17 nt, Artificial Sequence
  Synthetic
gagagagagagagaggg

SEQ ID NO: 54130 - RNA, 17 nt, Artificial Sequence
  Synthetic
gagagggggagguaggg

SEQ ID NO: 54131 - RNA, 17 nt, Artificial Sequence
  Synthetic
gcgcggaagaagacggg

SEQ ID NO: 54132 - RNA, 17 nt, Artificial Sequence
  Synthetic
ggagcggggcggccggg

SEQ ID NO: 54133 - RNA, 17 nt, Artificial Sequence
  Synthetic
gagagagagagaggggg

SEQ ID NO: 54134 - RNA, 17 nt, Artificial Sequence
  Synthetic
gagagagagaggggggg

SEQ ID NO: 54135 - RNA, 17 nt, Artificial Sequence
  Synthetic
gagagagaggggggggg

SEQ ID NO: 54136 - RNA, 17 nt, Artificial Sequence
  Synthetic
gcggcgcugcucggcug

SEQ ID NO: 54137 - RNA, 17 nt, Artificial Sequence
  Synthetic
gccagcugagugcucug

SEQ ID NO: 54138 - RNA, 17 nt, Artificial Sequence
  Synthetic
gcgagccgggcagagug

SEQ ID NO: 54139 - RNA, 17 nt, Artificial Sequence
  Synthetic
gggcggccgccgaggug

SEQ ID NO: 54140 - RNA, 17 nt, Artificial Sequence
  Synthetic
gaggggcccccgcaccu

SEQ ID NO: 54141 - RNA, 17 nt, Artificial Sequence
  Synthetic
gagcccgcggcgcugcu

SEQ ID NO: 54142 - RNA, 17 nt, Artificial Sequence
  Synthetic
ggaagagagggggaggu

SEQ ID NO: 54143 - RNA, 20 nt, Artificial Sequence
  Synthetic
gacgggaggcgggggaaaaa

SEQ ID NO: 54144 - RNA, 20 nt, Artificial Sequence
  Synthetic
gggggggagagggaaagcaa

SEQ ID NO: 54145 - RNA, 20 nt, Artificial Sequence
  Synthetic
guagggaggggagaggagaa

SEQ ID NO: 54146 - RNA, 20 nt, Artificial Sequence
  Synthetic
gggaaaaaagggggaagaga

SEQ ID NO: 54147 - RNA, 20 nt, Artificial Sequence
  Synthetic
gagagagagagagagagaga

SEQ ID NO: 54148 - RNA, 20 nt, Artificial Sequence
  Synthetic
gguagggaggggagaggaga

SEQ ID NO: 54149 - RNA, 20 nt, Artificial Sequence
  Synthetic
gagagggggggggggggaga

SEQ ID NO: 54150 - RNA, 20 nt, Artificial Sequence
  Synthetic
gccgcccggcgccgggcgga

SEQ ID NO: 54151 - RNA, 20 nt, Artificial Sequence
  Synthetic
ggggaagagagggggaggua

SEQ ID NO: 54152 - RNA, 20 nt, Artificial Sequence
  Synthetic
ggggggagagggaaagcaac

SEQ ID NO: 54153 - RNA, 20 nt, Artificial Sequence
  Synthetic
gccucugccucggggacccc

SEQ ID NO: 54154 - RNA, 20 nt, Artificial Sequence
  Synthetic
ggcgguccggcccgggcccc

SEQ ID NO: 54155 - RNA, 20 nt, Artificial Sequence
  Synthetic
gcaccucggcggccaagccc

SEQ ID NO: 54156 - RNA, 20 nt, Artificial Sequence
  Synthetic
ggccaagccccggcccgccc

SEQ ID NO: 54157 - RNA, 20 nt, Artificial Sequence
  Synthetic
gcgcgggggccccggggccc

SEQ ID NO: 54158 - RNA, 20 nt, Artificial Sequence
  Synthetic
gccggcgcggcccggggccc

SEQ ID NO: 54159 - RNA, 20 nt, Artificial Sequence
  Synthetic
gauucccggccggggguccc

SEQ ID NO: 54160 - RNA, 20 nt, Artificial Sequence
  Synthetic
gaggggggacggggcgagcc

SEQ ID NO: 54161 - RNA, 20 nt, Artificial Sequence
  Synthetic
ggggcccgggccggaccgcc

SEQ ID NO: 54162 - RNA, 20 nt, Artificial Sequence
  Synthetic
gggggucccggguagccgcc

SEQ ID NO: 54163 - RNA, 20 nt, Artificial Sequence
  Synthetic
ggcgggggacgccuuccgcc

SEQ ID NO: 54164 - RNA, 20 nt, Artificial Sequence
  Synthetic
gcuacccgggacccccggcc

SEQ ID NO: 54165 - RNA, 20 nt, Artificial Sequence
  Synthetic
ggggcguugccggcccggcc

SEQ ID NO: 54166 - RNA, 20 nt, Artificial Sequence
  Synthetic
ggcgcggggcguugccggcc

SEQ ID NO: 54167 - RNA, 20 nt, Artificial Sequence
  Synthetic
gugcgggggccccuccggcc

SEQ ID NO: 54168 - RNA, 20 nt, Artificial Sequence
  Synthetic
gaaacgccgccggcgcggcc

SEQ ID NO: 54169 - RNA, 20 nt, Artificial Sequence
  Synthetic
ggcccgggagcggggcggcc

SEQ ID NO: 54170 - RNA, 20 nt, Artificial Sequence
  Synthetic
gcgggcuccggggccgggcc

SEQ ID NO: 54171 - RNA, 20 nt, Artificial Sequence
  Synthetic
gcgccgcgggcuccggggcc

SEQ ID NO: 54172 - RNA, 20 nt, Artificial Sequence
  Synthetic
gcgguugcgggcgccgugcc

SEQ ID NO: 54173 - RNA, 20 nt, Artificial Sequence
  Synthetic
guuccguuucuucucccucc

SEQ ID NO: 54174 - RNA, 20 nt, Artificial Sequence
  Synthetic
gggaaucgaaaaaagccucc

SEQ ID NO: 54175 - RNA, 20 nt, Artificial Sequence
  Synthetic
ggcgcggcagcaacgaacgc

SEQ ID NO: 54176 - RNA, 20 nt, Artificial Sequence
  Synthetic
gggggcccgggccggaccgc

SEQ ID NO: 54177 - RNA, 20 nt, Artificial Sequence
  Synthetic
gccggccgccggaugcccgc

SEQ ID NO: 54178 - RNA, 20 nt, Artificial Sequence
  Synthetic
gggccggcaacgccccgcgc

SEQ ID NO: 54179 - RNA, 20 nt, Artificial Sequence
  Synthetic
gggagaggagaagggcgcgc

SEQ ID NO: 54180 - RNA, 20 nt, Artificial Sequence
  Synthetic
ggugcgggggccccuccggc

SEQ ID NO: 54181 - RNA, 20 nt, Artificial Sequence
  Synthetic
gggguucucuccgccgcggc

SEQ ID NO: 54182 - RNA, 20 nt, Artificial Sequence
  Synthetic
gggcccgggagcggggcggc

SEQ ID NO: 54183 - RNA, 20 nt, Artificial Sequence
  Synthetic
gcuccgccgggggcccgggc

SEQ ID NO: 54184 - RNA, 20 nt, Artificial Sequence
  Synthetic
gcuccggggccgggccgggc

SEQ ID NO: 54185 - RNA, 20 nt, Artificial Sequence
  Synthetic
gggggcggccgccgaggugc

SEQ ID NO: 54186 - RNA, 20 nt, Artificial Sequence
  Synthetic
gcugagugcucugcgguugc

SEQ ID NO: 54187 - RNA, 20 nt, Artificial Sequence
  Synthetic
gcggagcagccuuccuucuc

SEQ ID NO: 54188 - RNA, 20 nt, Artificial Sequence
  Synthetic
gcgucccccgcccggcgguc

SEQ ID NO: 54189 - RNA, 20 nt, Artificial Sequence
  Synthetic
gggaaagcaacgggaaagag

SEQ ID NO: 54190 - RNA, 20 nt, Artificial Sequence
  Synthetic
ggggaaaaaagggggaagag

SEQ ID NO: 54191 - RNA, 20 nt, Artificial Sequence
  Synthetic
ggaaaaaagggggaagagag

SEQ ID NO: 54192 - RNA, 20 nt, Artificial Sequence
  Synthetic
gaggugcgccccggccggag

SEQ ID NO: 54193 - RNA, 20 nt, Artificial Sequence
  Synthetic
gggggagguagggaggggag

SEQ ID NO: 54194 - RNA, 20 nt, Artificial Sequence
  Synthetic
gagggagaagaaacggaacg

SEQ ID NO: 54195 - RNA, 20 nt, Artificial Sequence
  Synthetic
ggcggagcgcgggggccccg

SEQ ID NO: 54196 - RNA, 20 nt, Artificial Sequence
  Synthetic
ggcccgcccggggguccccg

SEQ ID NO: 54197 - RNA, 20 nt, Artificial Sequence
  Synthetic
gccaagccccggcccgcccg

SEQ ID NO: 54198 - RNA, 20 nt, Artificial Sequence
  Synthetic
gcggcccgucugcuggcccg

SEQ ID NO: 54199 - RNA, 20 nt, Artificial Sequence
  Synthetic
ggccggccgccggaugcccg

SEQ ID NO: 54200 - RNA, 20 nt, Artificial Sequence
  Synthetic
gccggagggggcggccgccg

SEQ ID NO: 54201 - RNA, 20 nt, Artificial Sequence
  Synthetic
gggccggggcuuggccgccg

SEQ ID NO: 54202 - RNA, 20 nt, Artificial Sequence
  Synthetic
gccgcagccgagcagcgccg

SEQ ID NO: 54203 - RNA, 20 nt, Artificial Sequence
  Synthetic
ggcgugggccgcuggcgccg

SEQ ID NO: 54204 - RNA, 20 nt, Artificial Sequence
  Synthetic
gcgcugcucggcugcggccg

SEQ ID NO: 54205 - RNA, 20 nt, Artificial Sequence
  Synthetic
gcgggccagcagacgggccg

SEQ ID NO: 54206 - RNA, 20 nt, Artificial Sequence
  Synthetic
ggggacccccgggcgggccg

SEQ ID NO: 54207 - RNA, 20 nt, Artificial Sequence
  Synthetic
ggaaucgaaaaaagccuccg

SEQ ID NO: 54208 - RNA, 20 nt, Artificial Sequence
  Synthetic
gagcagcgccgcgggcuccg

SEQ ID NO: 54209 - RNA, 20 nt, Artificial Sequence
  Synthetic
ggcugcggccgcgggcuccg

SEQ ID NO: 54210 - RNA, 20 nt, Artificial Sequence
  Synthetic
gaggcggacccucggaggcg

SEQ ID NO: 54211 - RNA, 20 nt, Artificial Sequence
  Synthetic
gcggaagaagacgggaggcg

SEQ ID NO: 54212 - RNA, 20 nt, Artificial Sequence
  Synthetic
ggggcggccgccgaggugcg

SEQ ID NO: 54213 - RNA, 20 nt, Artificial Sequence
  Synthetic
gagaagggcgcgccggugcg

SEQ ID NO: 54214 - RNA, 20 nt, Artificial Sequence
  Synthetic
gaggguccgccucugccucg

SEQ ID NO: 54215 - RNA, 20 nt, Artificial Sequence
  Synthetic
gggaggcgggggaaaaaagg

SEQ ID NO: 54216 - RNA, 20 nt, Artificial Sequence
  Synthetic
ggggguccccgaggcagagg

SEQ ID NO: 54217 - RNA, 20 nt, Artificial Sequence
  Synthetic
gaaaaaagggggaagagagg

SEQ ID NO: 54218 - RNA, 20 nt, Artificial Sequence
  Synthetic
gagagagagagagagagagg

SEQ ID NO: 54219 - RNA, 20 nt, Artificial Sequence
  Synthetic
gguccggcccgggcccccgg

SEQ ID NO: 54220 - RNA, 20 nt, Artificial Sequence
  Synthetic
ggaaggcgucccccgcccgg

SEQ ID NO: 54221 - RNA, 20 nt, Artificial Sequence
  Synthetic
gggcccccgcgcuccgccgg

SEQ ID NO: 54222 - RNA, 20 nt, Artificial Sequence
  Synthetic
ggggccccgggccgcgccgg

SEQ ID NO: 54223 - RNA, 20 nt, Artificial Sequence
  Synthetic
gcugcggccgcgggcuccgg

SEQ ID NO: 54224 - RNA, 20 nt, Artificial Sequence
  Synthetic
gcggggcucgggcucuccgg

SEQ ID NO: 54225 - RNA, 20 nt, Artificial Sequence
  Synthetic
gggcccccggcggagcgcgg

SEQ ID NO: 54226 - RNA, 20 nt, Artificial Sequence
  Synthetic
gggcggccgccgaggugcgg

SEQ ID NO: 54227 - RNA, 20 nt, Artificial Sequence
  Synthetic
gaggggcccccgcaccucgg

SEQ ID NO: 54228 - RNA, 20 nt, Artificial Sequence
  Synthetic
gcggaaaagcagcaagaggg

SEQ ID NO: 54229 - RNA, 20 nt, Artificial Sequence
  Synthetic
gaagagagggggagguaggg

SEQ ID NO: 54230 - RNA, 20 nt, Artificial Sequence
  Synthetic
gaggcgcggaagaagacggg

SEQ ID NO: 54231 - RNA, 20 nt, Artificial Sequence
  Synthetic
gcccgggccggaccgccggg

SEQ ID NO: 54232 - RNA, 20 nt, Artificial Sequence
  Synthetic
gguagccgcccggcgccggg

SEQ ID NO: 54233 - RNA, 20 nt, Artificial Sequence
  Synthetic
gagagagagagagagagggg

SEQ ID NO: 54234 - RNA, 20 nt, Artificial Sequence
  Synthetic
gagagagagagagagggggg

SEQ ID NO: 54235 - RNA, 20 nt, Artificial Sequence
  Synthetic
gagagagagagagggggggg

SEQ ID NO: 54236 - RNA, 20 nt, Artificial Sequence
  Synthetic
gagagagagagggggggggg

SEQ ID NO: 54237 - RNA, 20 nt, Artificial Sequence
  Synthetic
gccccgcccgcguguugcug

SEQ ID NO: 54238 - RNA, 20 nt, Artificial Sequence
  Synthetic
ggggcgagccgggcagagug

SEQ ID NO: 54239 - RNA, 20 nt, Artificial Sequence
  Synthetic
guguuuaauggaagggcgug

SEQ ID NO: 54240 - RNA, 20 nt, Artificial Sequence
  Synthetic
gggggaagagagggggaggu

SEQ ID NO: 54241 - RNA, 17 nt, Artificial Sequence
  Synthetic
ccgggagggagaagaaa

SEQ ID NO: 54242 - RNA, 17 nt, Artificial Sequence
  Synthetic
acguaaacaaugacaca

SEQ ID NO: 54243 - RNA, 17 nt, Artificial Sequence
  Synthetic
aaaaaagggggaagaga

SEQ ID NO: 54244 - RNA, 17 nt, Artificial Sequence
  Synthetic
agagagagagagagaga

SEQ ID NO: 54245 - RNA, 17 nt, Artificial Sequence
  Synthetic
agggaggggagaggaga

SEQ ID NO: 54246 - RNA, 17 nt, Artificial Sequence
  Synthetic
agggggggggggggaga

SEQ ID NO: 54247 - RNA, 17 nt, Artificial Sequence
  Synthetic
agagggggagguaggga

SEQ ID NO: 54248 - RNA, 17 nt, Artificial Sequence
  Synthetic
agcagcaagagggggga

SEQ ID NO: 54249 - RNA, 17 nt, Artificial Sequence
  Synthetic
ugggaguguuuaaugga

SEQ ID NO: 54250 - RNA, 17 nt, Artificial Sequence
  Synthetic
cggcuacccgggacccc

SEQ ID NO: 54251 - RNA, 17 nt, Artificial Sequence
  Synthetic
ucugccucggggacccc

SEQ ID NO: 54252 - RNA, 17 nt, Artificial Sequence
  Synthetic
cugccucggggaccccc

SEQ ID NO: 54253 - RNA, 17 nt, Artificial Sequence
  Synthetic
cguugcugccgcgcccc

SEQ ID NO: 54254 - RNA, 17 nt, Artificial Sequence
  Synthetic
cggagcgcgggggcccc

SEQ ID NO: 54255 - RNA, 17 nt, Artificial Sequence
  Synthetic
ccucggcggccaagccc

SEQ ID NO: 54256 - RNA, 17 nt, Artificial Sequence
  Synthetic
caagccccggcccgccc

SEQ ID NO: 54257 - RNA, 17 nt, Artificial Sequence
  Synthetic
ccggcccggcccggccc

SEQ ID NO: 54258 - RNA, 17 nt, Artificial Sequence
  Synthetic
cgccgccggcgcggccc

SEQ ID NO: 54259 - RNA, 17 nt, Artificial Sequence
  Synthetic
cgggggccccggggccc

SEQ ID NO: 54260 - RNA, 17 nt, Artificial Sequence
  Synthetic
cgcuccgccgggggccc

SEQ ID NO: 54261 - RNA, 17 nt, Artificial Sequence
  Synthetic
ccggccgccccgcuccc

SEQ ID NO: 54262 - RNA, 17 nt, Artificial Sequence
  Synthetic
ucccggccggggguccc

SEQ ID NO: 54263 - RNA, 17 nt, Artificial Sequence
  Synthetic
ccaagccccggcccgcc

SEQ ID NO: 54264 - RNA, 17 nt, Artificial Sequence
  Synthetic
acccgggacccccggcc

SEQ ID NO: 54265 - RNA, 17 nt, Artificial Sequence
  Synthetic
cgggggccccuccggcc

SEQ ID NO: 54266 - RNA, 17 nt, Artificial Sequence
  Synthetic
acgccgccggcgcggcc

SEQ ID NO: 54267 - RNA, 17 nt, Artificial Sequence
  Synthetic
ccgggagcggggcggcc

SEQ ID NO: 54268 - RNA, 17 nt, Artificial Sequence
  Synthetic
ccgcgggcuccggggcc

SEQ ID NO: 54269 - RNA, 17 nt, Artificial Sequence
  Synthetic
ccguuucuucucccucc

SEQ ID NO: 54270 - RNA, 17 nt, Artificial Sequence
  Synthetic
aaucgaaaaaagccucc

SEQ ID NO: 54271 - RNA, 17 nt, Artificial Sequence
  Synthetic
cccggccgccccgcucc

SEQ ID NO: 54272 - RNA, 17 nt, Artificial Sequence
  Synthetic
cugcggccgcgggcucc

SEQ ID NO: 54273 - RNA, 17 nt, Artificial Sequence
  Synthetic
uucccggccgggggucc

SEQ ID NO: 54274 - RNA, 17 nt, Artificial Sequence
  Synthetic
aggcuuuuuucgauucc

SEQ ID NO: 54275 - RNA, 17 nt, Artificial Sequence
  Synthetic
accgcagagcacucagc

SEQ ID NO: 54276 - RNA, 17 nt, Artificial Sequence
  Synthetic
ugcccacagcaacacgc

SEQ ID NO: 54277 - RNA, 17 nt, Artificial Sequence
  Synthetic
cagccgagcagcgccgc

SEQ ID NO: 54278 - RNA, 17 nt, Artificial Sequence
  Synthetic
cgggaggcgugggccgc

SEQ ID NO: 54279 - RNA, 17 nt, Artificial Sequence
  Synthetic
ccggcaacgccccgcgc

SEQ ID NO: 54280 - RNA, 17 nt, Artificial Sequence
  Synthetic
agaggagaagggcgcgc

SEQ ID NO: 54281 - RNA, 17 nt, Artificial Sequence
  Synthetic
cgccuuccgcccggcgc

SEQ ID NO: 54282 - RNA, 17 nt, Artificial Sequence
  Synthetic
uccgccgcggccggcgc

SEQ ID NO: 54283 - RNA, 17 nt, Artificial Sequence
  Synthetic
uacccgggacccccggc

SEQ ID NO: 54284 - RNA, 17 nt, Artificial Sequence
  Synthetic
cgcgggcauccggcggc

SEQ ID NO: 54285 - RNA, 17 nt, Artificial Sequence
  Synthetic
cccgggagcggggcggc

SEQ ID NO: 54286 - RNA, 17 nt, Artificial Sequence
  Synthetic
cucggggacccccgggc

SEQ ID NO: 54287 - RNA, 17 nt, Artificial Sequence
  Synthetic
ccgccgggggcccgggc

SEQ ID NO: 54288 - RNA, 17 nt, Artificial Sequence
  Synthetic
ccggggccgggccgggc

SEQ ID NO: 54289 - RNA, 17 nt, Artificial Sequence
  Synthetic
auggaagggcguggggc

SEQ ID NO: 54290 - RNA, 17 nt, Artificial Sequence
  Synthetic
cgccgcggcccgucugc

SEQ ID NO: 54291 - RNA, 17 nt, Artificial Sequence
  Synthetic
ccggcgcggggcguugc

SEQ ID NO: 54292 - RNA, 17 nt, Artificial Sequence
  Synthetic
ucggcggccgcccccuc

SEQ ID NO: 54293 - RNA, 17 nt, Artificial Sequence
  Synthetic
aggugcgggggccccuc

SEQ ID NO: 54294 - RNA, 17 nt, Artificial Sequence
  Synthetic
agcagcgccgcgggcuc

SEQ ID NO: 54295 - RNA, 17 nt, Artificial Sequence
  Synthetic
acacgcgggcggggcuc

SEQ ID NO: 54296 - RNA, 17 nt, Artificial Sequence
  Synthetic
ucccccgcccggcgguc

SEQ ID NO: 54297 - RNA, 17 nt, Artificial Sequence
  Synthetic
cguaaacaaugacacag

SEQ ID NO: 54298 - RNA, 17 nt, Artificial Sequence
  Synthetic
acgggccgcggcgccag

SEQ ID NO: 54299 - RNA, 17 nt, Artificial Sequence
  Synthetic
aaagcaacgggaaagag

SEQ ID NO: 54300 - RNA, 17 nt, Artificial Sequence
  Synthetic
cggaaaagcagcaagag

SEQ ID NO: 54301 - RNA, 17 nt, Artificial Sequence
  Synthetic
aaaaagggggaagagag

SEQ ID NO: 54302 - RNA, 17 nt, Artificial Sequence
  Synthetic
augcccacagcaacacg

SEQ ID NO: 54303 - RNA, 17 nt, Artificial Sequence
  Synthetic
cagcaagaggggggacg

SEQ ID NO: 54304 - RNA, 17 nt, Artificial Sequence
  Synthetic
cugugucauuguuuacg

SEQ ID NO: 54305 - RNA, 17 nt, Artificial Sequence
  Synthetic
cgcggcccggggccccg

SEQ ID NO: 54306 - RNA, 17 nt, Artificial Sequence
  Synthetic
ccgcccggggguccccg

SEQ ID NO: 54307 - RNA, 17 nt, Artificial Sequence
  Synthetic
cccggccccggagcccg

SEQ ID NO: 54308 - RNA, 17 nt, Artificial Sequence
  Synthetic
aagccccggcccgcccg

SEQ ID NO: 54309 - RNA, 17 nt, Artificial Sequence
  Synthetic
cggccgccggaugcccg

SEQ ID NO: 54310 - RNA, 17 nt, Artificial Sequence
  Synthetic
ccggggcuuggccgccg

SEQ ID NO: 54311 - RNA, 17 nt, Artificial Sequence
  Synthetic
acgccccgcgccggccg

SEQ ID NO: 54312 - RNA, 17 nt, Artificial Sequence
  Synthetic
cugcucggcugcggccg

SEQ ID NO: 54313 - RNA, 17 nt, Artificial Sequence
  Synthetic
cauuguuuacguggccg

SEQ ID NO: 54314 - RNA, 17 nt, Artificial Sequence
  Synthetic
cagcgccgcgggcuccg

SEQ ID NO: 54315 - RNA, 17 nt, Artificial Sequence
  Synthetic
ugcggccgcgggcuccg

SEQ ID NO: 54316 - RNA, 17 nt, Artificial Sequence
  Synthetic
cgggaaagagaggcgcg

SEQ ID NO: 54317 - RNA, 17 nt, Artificial Sequence
  Synthetic
ccgccgcggccggcgcg

SEQ ID NO: 54318 - RNA, 17 nt, Artificial Sequence
  Synthetic
cuccgccgcggccggcg

SEQ ID NO: 54319 - RNA, 17 nt, Artificial Sequence
  Synthetic
uguuuaauggaagggcg

SEQ ID NO: 54320 - RNA, 17 nt, Artificial Sequence
  Synthetic
aggcgggggaaaaaagg

SEQ ID NO: 54321 - RNA, 17 nt, Artificial Sequence
  Synthetic
aaaagggggaagagagg

SEQ ID NO: 54322 - RNA, 17 nt, Artificial Sequence
  Synthetic
agagagagagagagagg

SEQ ID NO: 54323 - RNA, 17 nt, Artificial Sequence
  Synthetic
cggaagaagacgggagg

SEQ ID NO: 54324 - RNA, 17 nt, Artificial Sequence
  Synthetic
ccggcccgggcccccgg

SEQ ID NO: 54325 - RNA, 17 nt, Artificial Sequence
  Synthetic
aggcgucccccgcccgg

SEQ ID NO: 54326 - RNA, 17 nt, Artificial Sequence
  Synthetic
agccccggcccgcccgg

SEQ ID NO: 54327 - RNA, 17 nt, Artificial Sequence
  Synthetic
cccccgcgcuccgccgg

SEQ ID NO: 54328 - RNA, 17 nt, Artificial Sequence
  Synthetic
ccccgcgccggccgcgg

SEQ ID NO: 54329 - RNA, 17 nt, Artificial Sequence
  Synthetic
cccccggcggagcgcgg

SEQ ID NO: 54330 - RNA, 17 nt, Artificial Sequence
  Synthetic
aagaagacgggaggcgg

SEQ ID NO: 54331 - RNA, 17 nt, Artificial Sequence
  Synthetic
cggccgccgaggugcgg

SEQ ID NO: 54332 - RNA, 17 nt, Artificial Sequence
  Synthetic
cagaggcggacccucgg

SEQ ID NO: 54333 - RNA, 17 nt, Artificial Sequence
  Synthetic
ccucggggacccccggg

SEQ ID NO: 54334 - RNA, 17 nt, Artificial Sequence
  Synthetic
cgggccggaccgccggg

SEQ ID NO: 54335 - RNA, 17 nt, Artificial Sequence
  Synthetic
agccgcccggcgccggg

SEQ ID NO: 54336 - RNA, 17 nt, Artificial Sequence
  Synthetic
uuccgcccggcgccggg

SEQ ID NO: 54337 - RNA, 17 nt, Artificial Sequence
  Synthetic
ccacagcaacacgcggg

SEQ ID NO: 54338 - RNA, 17 nt, Artificial Sequence
  Synthetic
agagagagagagagggg

SEQ ID NO: 54339 - RNA, 17 nt, Artificial Sequence
  Synthetic
cgggcccgggagcgggg

SEQ ID NO: 54340 - RNA, 17 nt, Artificial Sequence
  Synthetic
agggggaagagaggggg

SEQ ID NO: 54341 - RNA, 17 nt, Artificial Sequence
  Synthetic
cgcggcgccggaggggg

SEQ ID NO: 54342 - RNA, 17 nt, Artificial Sequence
  Synthetic
agagagagagagggggg

SEQ ID NO: 54343 - RNA, 17 nt, Artificial Sequence
  Synthetic
agagagagagggggggg

SEQ ID NO: 54344 - RNA, 17 nt, Artificial Sequence
  Synthetic
agagagagggggggggg

SEQ ID NO: 54345 - RNA, 17 nt, Artificial Sequence
  Synthetic
acucccacguugggggg

SEQ ID NO: 54346 - RNA, 17 nt, Artificial Sequence
  Synthetic
cacucccacguuggggg

SEQ ID NO: 54347 - RNA, 17 nt, Artificial Sequence
  Synthetic
acacucccacguugggg

SEQ ID NO: 54348 - RNA, 17 nt, Artificial Sequence
  Synthetic
aacacucccacguuggg

SEQ ID NO: 54349 - RNA, 17 nt, Artificial Sequence
  Synthetic
ccgcccgcguguugcug

SEQ ID NO: 54350 - RNA, 17 nt, Artificial Sequence
  Synthetic
uuuaauggaagggcgug

SEQ ID NO: 54351 - RNA, 17 nt, Artificial Sequence
  Synthetic
ugagugcucugcgguug

SEQ ID NO: 54352 - RNA, 17 nt, Artificial Sequence
  Synthetic
ccggccggggcgcaccu

SEQ ID NO: 54353 - RNA, 17 nt, Artificial Sequence
  Synthetic
aggcagaggcggacccu

SEQ ID NO: 54354 - RNA, 17 nt, Artificial Sequence
  Synthetic
aggguccgccucugccu

SEQ ID NO: 54355 - RNA, 17 nt, Artificial Sequence
  Synthetic
ccgggcgggccggggcu

SEQ ID NO: 54356 - RNA, 17 nt, Artificial Sequence
  Synthetic
cgcccgcguguugcugu

SEQ ID NO: 54357 - RNA, 20 nt, Artificial Sequence
  Synthetic
acgggaggcgggggaaaaaa

SEQ ID NO: 54358 - RNA, 20 nt, Artificial Sequence
  Synthetic
cggccgggagggagaagaaa

SEQ ID NO: 54359 - RNA, 20 nt, Artificial Sequence
  Synthetic
cgugggaguguuuaauggaa

SEQ ID NO: 54360 - RNA, 20 nt, Artificial Sequence
  Synthetic
cccaacgugggaguguuuaa

SEQ ID NO: 54361 - RNA, 20 nt, Artificial Sequence
  Synthetic
cgcgcggaaaagcagcaaga

SEQ ID NO: 54362 - RNA, 20 nt, Artificial Sequence
  Synthetic
cucggaggcgcggaagaaga

SEQ ID NO: 54363 - RNA, 20 nt, Artificial Sequence
  Synthetic
acgggccgcgggccagcaga

SEQ ID NO: 54364 - RNA, 20 nt, Artificial Sequence
  Synthetic
agagggacuccggagaagga

SEQ ID NO: 54365 - RNA, 20 nt, Artificial Sequence
  Synthetic
cgaggugcgccccggccgga

SEQ ID NO: 54366 - RNA, 20 nt, Artificial Sequence
  Synthetic
aagagagggggagguaggga

SEQ ID NO: 54367 - RNA, 20 nt, Artificial Sequence
  Synthetic
cgggagcggggcggccggga

SEQ ID NO: 54368 - RNA, 20 nt, Artificial Sequence
  Synthetic
aaaagcagcaagagggggga

SEQ ID NO: 54369 - RNA, 20 nt, Artificial Sequence
  Synthetic
cgggccgcgggccagcagac

SEQ ID NO: 54370 - RNA, 20 nt, Artificial Sequence
  Synthetic
aaagcagcaagaggggggac

SEQ ID NO: 54371 - RNA, 20 nt, Artificial Sequence
  Synthetic
cccggcgccgggcggcuacc

SEQ ID NO: 54372 - RNA, 20 nt, Artificial Sequence
  Synthetic
ccggcgccgggcggcuaccc

SEQ ID NO: 54373 - RNA, 20 nt, Artificial Sequence
  Synthetic
ccucugccucggggaccccc

SEQ ID NO: 54374 - RNA, 20 nt, Artificial Sequence
  Synthetic
cgcgggggccccggggcccc

SEQ ID NO: 54375 - RNA, 20 nt, Artificial Sequence
  Synthetic
ccggcgcggcccggggcccc

SEQ ID NO: 54376 - RNA, 20 nt, Artificial Sequence
  Synthetic
cggcggagcgcgggggcccc

SEQ ID NO: 54377 - RNA, 20 nt, Artificial Sequence
  Synthetic
uugccggcccggcccggccc

SEQ ID NO: 54378 - RNA, 20 nt, Artificial Sequence
  Synthetic
cccgcccggcgguccggccc

SEQ ID NO: 54379 - RNA, 20 nt, Artificial Sequence
  Synthetic
ccgcgcuccgccgggggccc

SEQ ID NO: 54380 - RNA, 20 nt, Artificial Sequence
  Synthetic
ccggcggagcgcgggggccc

SEQ ID NO: 54381 - RNA, 20 nt, Artificial Sequence
  Synthetic
cucccggccgccccgcuccc

SEQ ID NO: 54382 - RNA, 20 nt, Artificial Sequence
  Synthetic
cggccaagccccggcccgcc

SEQ ID NO: 54383 - RNA, 20 nt, Artificial Sequence
  Synthetic
cggggcccccgcgcuccgcc

SEQ ID NO: 54384 - RNA, 20 nt, Artificial Sequence
  Synthetic
ccccgcccggcgguccggcc

SEQ ID NO: 54385 - RNA, 20 nt, Artificial Sequence
  Synthetic
cggggacccccgggcgggcc

SEQ ID NO: 54386 - RNA, 20 nt, Artificial Sequence
  Synthetic
cccgcgcuccgccgggggcc

SEQ ID NO: 54387 - RNA, 20 nt, Artificial Sequence
  Synthetic
cgggggcuccgcacucugcc

SEQ ID NO: 54388 - RNA, 20 nt, Artificial Sequence
  Synthetic
ccucccggccgccccgcucc

SEQ ID NO: 54389 - RNA, 20 nt, Artificial Sequence
  Synthetic
cgagcagcgccgcgggcucc

SEQ ID NO: 54390 - RNA, 20 nt, Artificial Sequence
  Synthetic
cggcugcggccgcgggcucc

SEQ ID NO: 54391 - RNA, 20 nt, Artificial Sequence
  Synthetic
cggaggcuuuuuucgauucc

SEQ ID NO: 54392 - RNA, 20 nt, Artificial Sequence
  Synthetic
agaggggggacggggcgagc

SEQ ID NO: 54393 - RNA, 20 nt, Artificial Sequence
  Synthetic
aaaugcccacagcaacacgc

SEQ ID NO: 54394 - RNA, 20 nt, Artificial Sequence
  Synthetic
aagggcguggggccggccgc

SEQ ID NO: 54395 - RNA, 20 nt, Artificial Sequence
  Synthetic
cgcugcucggcugcggccgc

SEQ ID NO: 54396 - RNA, 20 nt, Artificial Sequence
  Synthetic
cgggccagcagacgggccgc

SEQ ID NO: 54397 - RNA, 20 nt, Artificial Sequence
  Synthetic
cggcgggaggcgugggccgc

SEQ ID NO: 54398 - RNA, 20 nt, Artificial Sequence
  Synthetic
ccggggcccccgcgcuccgc

SEQ ID NO: 54399 - RNA, 20 nt, Artificial Sequence
  Synthetic
ccgggcccccggcggagcgc

SEQ ID NO: 54400 - RNA, 20 nt, Artificial Sequence
  Synthetic
cccggggccccgggccgcgc

SEQ ID NO: 54401 - RNA, 20 nt, Artificial Sequence
  Synthetic
cccggguagccgcccggcgc

SEQ ID NO: 54402 - RNA, 20 nt, Artificial Sequence
  Synthetic
cucuccgccgcggccggcgc

SEQ ID NO: 54403 - RNA, 20 nt, Artificial Sequence
  Synthetic
ccccgcgggcauccggcggc

SEQ ID NO: 54404 - RNA, 20 nt, Artificial Sequence
  Synthetic
agucccucucgaucggcggc

SEQ ID NO: 54405 - RNA, 20 nt, Artificial Sequence
  Synthetic
ugccucggggacccccgggc

SEQ ID NO: 54406 - RNA, 20 nt, Artificial Sequence
  Synthetic
cccgggccggaccgccgggc

SEQ ID NO: 54407 - RNA, 20 nt, Artificial Sequence
  Synthetic
cgcgggcuccggggccgggc

SEQ ID NO: 54408 - RNA, 20 nt, Artificial Sequence
  Synthetic
ucggggacccccgggcgggc

SEQ ID NO: 54409 - RNA, 20 nt, Artificial Sequence
  Synthetic
agcgccgcgggcuccggggc

SEQ ID NO: 54410 - RNA, 20 nt, Artificial Sequence
  Synthetic
cuggcccgcggcccgucugc

SEQ ID NO: 54411 - RNA, 20 nt, Artificial Sequence
  Synthetic
uggcgccgcggcccgucugc

SEQ ID NO: 54412 - RNA, 20 nt, Artificial Sequence
  Synthetic
accucggcggccgcccccuc

SEQ ID NO: 54413 - RNA, 20 nt, Artificial Sequence
  Synthetic
ccgaggugcgggggccccuc

SEQ ID NO: 54414 - RNA, 20 nt, Artificial Sequence
  Synthetic
cgaggguccgccucugccuc

SEQ ID NO: 54415 - RNA, 20 nt, Artificial Sequence
  Synthetic
ccgagcagcgccgcgggcuc

SEQ ID NO: 54416 - RNA, 20 nt, Artificial Sequence
  Synthetic
ucggcugcggccgcgggcuc

SEQ ID NO: 54417 - RNA, 20 nt, Artificial Sequence
  Synthetic
cgggcggggcucgggcucuc

SEQ ID NO: 54418 - RNA, 20 nt, Artificial Sequence
  Synthetic
cgggaggcgggggaaaaaag

SEQ ID NO: 54419 - RNA, 20 nt, Artificial Sequence
  Synthetic
ccacguaaacaaugacacag

SEQ ID NO: 54420 - RNA, 20 nt, Artificial Sequence
  Synthetic
cagacgggccgcggcgccag

SEQ ID NO: 54421 - RNA, 20 nt, Artificial Sequence
  Synthetic
cgcggcagcaacgaacgcag

SEQ ID NO: 54422 - RNA, 20 nt, Artificial Sequence
  Synthetic
cccggggguccccgaggcag

SEQ ID NO: 54423 - RNA, 20 nt, Artificial Sequence
  Synthetic
agagagagagagagagagag

SEQ ID NO: 54424 - RNA, 20 nt, Artificial Sequence
  Synthetic
agagagggggagguagggag

SEQ ID NO: 54425 - RNA, 20 nt, Artificial Sequence
  Synthetic
agagagggggggggggggag

SEQ ID NO: 54426 - RNA, 20 nt, Artificial Sequence
  Synthetic
aagcagcaagaggggggacg

SEQ ID NO: 54427 - RNA, 20 nt, Artificial Sequence
  Synthetic
cggcgcggcccggggccccg

SEQ ID NO: 54428 - RNA, 20 nt, Artificial Sequence
  Synthetic
ugcggagcccccggagcccg

SEQ ID NO: 54429 - RNA, 20 nt, Artificial Sequence
  Synthetic
cggcccggccccggagcccg

SEQ ID NO: 54430 - RNA, 20 nt, Artificial Sequence
  Synthetic
aacgccgccggcgcggcccg

SEQ ID NO: 54431 - RNA, 20 nt, Artificial Sequence
  Synthetic
cccgggcccccggcggagcg

SEQ ID NO: 54432 - RNA, 20 nt, Artificial Sequence
  Synthetic
ccggccgccggaugcccgcg

SEQ ID NO: 54433 - RNA, 20 nt, Artificial Sequence
  Synthetic
cgggcccccggcggagcgcg

SEQ ID NO: 54434 - RNA, 20 nt, Artificial Sequence
  Synthetic
caacgggaaagagaggcgcg

SEQ ID NO: 54435 - RNA, 20 nt, Artificial Sequence
  Synthetic
ucucuccgccgcggccggcg

SEQ ID NO: 54436 - RNA, 20 nt, Artificial Sequence
  Synthetic
ccgggccggaccgccgggcg

SEQ ID NO: 54437 - RNA, 20 nt, Artificial Sequence
  Synthetic
cgcggaaaagcagcaagagg

SEQ ID NO: 54438 - RNA, 20 nt, Artificial Sequence
  Synthetic
cgaacgcgcggcgccggagg

SEQ ID NO: 54439 - RNA, 20 nt, Artificial Sequence
  Synthetic
ccaagccccggcccgcccgg

SEQ ID NO: 54440 - RNA, 20 nt, Artificial Sequence
  Synthetic
ucgcgaacgcgcggcgccgg

SEQ ID NO: 54441 - RNA, 20 nt, Artificial Sequence
  Synthetic
ccgaggugcgccccggccgg

SEQ ID NO: 54442 - RNA, 20 nt, Artificial Sequence
  Synthetic
cggccgccggaugcccgcgg

SEQ ID NO: 54443 - RNA, 20 nt, Artificial Sequence
  Synthetic
acgccccgcgccggccgcgg

SEQ ID NO: 54444 - RNA, 20 nt, Artificial Sequence
  Synthetic
cggaagaagacgggaggcgg

SEQ ID NO: 54445 - RNA, 20 nt, Artificial Sequence
  Synthetic
cgggccggaccgccgggcgg

SEQ ID NO: 54446 - RNA, 20 nt, Artificial Sequence
  Synthetic
aggcagaggcggacccucgg

SEQ ID NO: 54447 - RNA, 20 nt, Artificial Sequence
  Synthetic
agagagagagagagagaggg

SEQ ID NO: 54448 - RNA, 20 nt, Artificial Sequence
  Synthetic
ccgggagcggggcggccggg

SEQ ID NO: 54449 - RNA, 20 nt, Artificial Sequence
  Synthetic
ugcccacagcaacacgcggg

SEQ ID NO: 54450 - RNA, 20 nt, Artificial Sequence
  Synthetic
aaaagggggaagagaggggg

SEQ ID NO: 54451 - RNA, 20 nt, Artificial Sequence
  Synthetic
agagagagagagagaggggg

SEQ ID NO: 54452 - RNA, 20 nt, Artificial Sequence
  Synthetic
acgcgcggcgccggaggggg

SEQ ID NO: 54453 - RNA, 20 nt, Artificial Sequence
  Synthetic
agagagagagagaggggggg

SEQ ID NO: 54454 - RNA, 20 nt, Artificial Sequence
  Synthetic
agagagagagaggggggggg

SEQ ID NO: 54455 - RNA, 20 nt, Artificial Sequence
  Synthetic
aacacucccacguugggggg

SEQ ID NO: 54456 - RNA, 20 nt, Artificial Sequence
  Synthetic
aaacacucccacguuggggg

SEQ ID NO: 54457 - RNA, 20 nt, Artificial Sequence
  Synthetic
uuaaacacucccacguuggg

SEQ ID NO: 54458 - RNA, 20 nt, Artificial Sequence
  Synthetic
cccgcggcgcugcucggcug

SEQ ID NO: 54459 - RNA, 20 nt, Artificial Sequence
  Synthetic
agggggcggccgccgaggug

SEQ ID NO: 54460 - RNA, 20 nt, Artificial Sequence
  Synthetic
cauuaaacacucccacguug

SEQ ID NO: 54461 - RNA, 20 nt, Artificial Sequence
  Synthetic
agcugagugcucugcgguug

SEQ ID NO: 54462 - RNA, 20 nt, Artificial Sequence
  Synthetic
ccuccggccggggcgcaccu

SEQ ID NO: 54463 - RNA, 20 nt, Artificial Sequence
  Synthetic
ccgaggcagaggcggacccu

SEQ ID NO: 54464 - RNA, 20 nt, Artificial Sequence
  Synthetic
cccccgggcgggccggggcu

SEQ ID NO: 54465 - RNA, 20 nt, Artificial Sequence
  Synthetic
agcaacacgcgggcggggcu

SEQ ID NO: 54466 - RNA, 20 nt, Artificial Sequence
  Synthetic
ccggagcccgcggcgcugcu

SEQ ID NO: 54467 - RNA, 20 nt, Artificial Sequence
  Synthetic
ccccgcccgcguguugcugu

SEQ ID NO: 54468 - RNA, 20 nt, Artificial Sequence
  Synthetic
ccauuaaacacucccacguu

SEQ ID NO: 54469 - RNA, 17 nt, Artificial Sequence
  Synthetic
aaaacaccuagaaaaaa

SEQ ID NO: 54470 - RNA, 17 nt, Artificial Sequence
  Synthetic
gguggaaagcggaaaaa

SEQ ID NO: 54471 - RNA, 17 nt, Artificial Sequence
  Synthetic
ggcgggggucccagaaa

SEQ ID NO: 54472 - RNA, 17 nt, Artificial Sequence
  Synthetic
ccucguguuucuugaaa

SEQ ID NO: 54473 - RNA, 17 nt, Artificial Sequence
  Synthetic
aggcgggggucccagaa

SEQ ID NO: 54474 - RNA, 17 nt, Artificial Sequence
  Synthetic
ggggaagacgaggagaa

SEQ ID NO: 54475 - RNA, 17 nt, Artificial Sequence
  Synthetic
cgcggagggccggagaa

SEQ ID NO: 54476 - RNA, 17 nt, Artificial Sequence
  Synthetic
gcgggcgggcgaaggaa

SEQ ID NO: 54477 - RNA, 17 nt, Artificial Sequence
  Synthetic
agacgaggagaagggaa

SEQ ID NO: 54478 - RNA, 17 nt, Artificial Sequence
  Synthetic
agagaaggaagagggaa

SEQ ID NO: 54479 - RNA, 17 nt, Artificial Sequence
  Synthetic
aaaaacggaggauggaa

SEQ ID NO: 54480 - RNA, 17 nt, Artificial Sequence
  Synthetic
gccucguguuucuugaa

SEQ ID NO: 54481 - RNA, 17 nt, Artificial Sequence
  Synthetic
gaacgauggggggaaca

SEQ ID NO: 54482 - RNA, 17 nt, Artificial Sequence
  Synthetic
caccccccaaacagcca

SEQ ID NO: 54483 - RNA, 17 nt, Artificial Sequence
  Synthetic
gaagagagaagagagca

SEQ ID NO: 54484 - RNA, 17 nt, Artificial Sequence
  Synthetic
gauggaagggcagaaga

SEQ ID NO: 54485 - RNA, 17 nt, Artificial Sequence
  Synthetic
gagagagagaaggaaga

SEQ ID NO: 54486 - RNA, 17 nt, Artificial Sequence
  Synthetic
ggugggacgcgggcaga

SEQ ID NO: 54487 - RNA, 17 nt, Artificial Sequence
  Synthetic
cgagacagagagagaga

SEQ ID NO: 54488 - RNA, 17 nt, Artificial Sequence
  Synthetic
gggggaagacgaggaga

SEQ ID NO: 54489 - RNA, 17 nt, Artificial Sequence
  Synthetic
gcugaggcggcgggaga

SEQ ID NO: 54490 - RNA, 17 nt, Artificial Sequence
  Synthetic
ggcgugguggugaacga

SEQ ID NO: 54491 - RNA, 17 nt, Artificial Sequence
  Synthetic
cccccgccgcccgacga

SEQ ID NO: 54492 - RNA, 17 nt, Artificial Sequence
  Synthetic
cggagaauggaaggcga

SEQ ID NO: 54493 - RNA, 17 nt, Artificial Sequence
  Synthetic
gcgaggcgggcgggcga

SEQ ID NO: 54494 - RNA, 17 nt, Artificial Sequence
  Synthetic
gagaagggaaggggcga

SEQ ID NO: 54495 - RNA, 17 nt, Artificial Sequence
  Synthetic
gaacgcgcggcguucga

SEQ ID NO: 54496 - RNA, 17 nt, Artificial Sequence
  Synthetic
ggcgggcgggcgaagga

SEQ ID NO: 54497 - RNA, 17 nt, Artificial Sequence
  Synthetic
agcggaaaaacggagga

SEQ ID NO: 54498 - RNA, 17 nt, Artificial Sequence
  Synthetic
gcgucgggacucgcgga

SEQ ID NO: 54499 - RNA, 17 nt, Artificial Sequence
  Synthetic
cugggucccccggcgga

SEQ ID NO: 54500 - RNA, 17 nt, Artificial Sequence
  Synthetic
aagacgaggagaaggga

SEQ ID NO: 54501 - RNA, 17 nt, Artificial Sequence
  Synthetic
gagagaaggaagaggga

SEQ ID NO: 54502 - RNA, 17 nt, Artificial Sequence
  Synthetic
gaaggggcgcggcggga

SEQ ID NO: 54503 - RNA, 17 nt, Artificial Sequence
  Synthetic
ggggaacacggggggga

SEQ ID NO: 54504 - RNA, 17 nt, Artificial Sequence
  Synthetic
gagggccggagaaugga

SEQ ID NO: 54505 - RNA, 17 nt, Artificial Sequence
  Synthetic
gaaaaacggaggaugga

SEQ ID NO: 54506 - RNA, 17 nt, Artificial Sequence
  Synthetic
ccuagaaaaaaaggaua

SEQ ID NO: 54507 - RNA, 17 nt, Artificial Sequence
  Synthetic
ucucgcagguagguuua

SEQ ID NO: 54508 - RNA, 17 nt, Artificial Sequence
  Synthetic
aacgauggggggaacac

SEQ ID NO: 54509 - RNA, 17 nt, Artificial Sequence
  Synthetic
ccgccgccgcgccccac

SEQ ID NO: 54510 - RNA, 17 nt, Artificial Sequence
  Synthetic
aaggggcgcggcgggac

SEQ ID NO: 54511 - RNA, 17 nt, Artificial Sequence
  Synthetic
cuagaaaaaaaggauac

SEQ ID NO: 54512 - RNA, 17 nt, Artificial Sequence
  Synthetic
uagguuuagggucguac

SEQ ID NO: 54513 - RNA, 17 nt, Artificial Sequence
  Synthetic
cguccgccgggggaccc

SEQ ID NO: 54514 - RNA, 17 nt, Artificial Sequence
  Synthetic
caggcgccccccccccc

SEQ ID NO: 54515 - RNA, 17 nt, Artificial Sequence
  Synthetic
ccggagccugggucccc

SEQ ID NO: 54516 - RNA, 17 nt, Artificial Sequence
  Synthetic
gcccgcccgccucgccc

SEQ ID NO: 54517 - RNA, 17 nt, Artificial Sequence
  Synthetic
cgcggcgagacgcagcc

SEQ ID NO: 54518 - RNA, 17 nt, Artificial Sequence
  Synthetic
cccccccccccggagcc

SEQ ID NO: 54519 - RNA, 17 nt, Artificial Sequence
  Synthetic
cgcgugagccguccgcc

SEQ ID NO: 54520 - RNA, 17 nt, Artificial Sequence
  Synthetic
gcggggagugggcggcc

SEQ ID NO: 54521 - RNA, 17 nt, Artificial Sequence
  Synthetic
gguggugggggggggcc

SEQ ID NO: 54522 - RNA, 17 nt, Artificial Sequence
  Synthetic
cgggggacccaggcucc

SEQ ID NO: 54523 - RNA, 17 nt, Artificial Sequence
  Synthetic
acgggggggaggggucc

SEQ ID NO: 54524 - RNA, 17 nt, Artificial Sequence
  Synthetic
ucgcggcgagacgcagc

SEQ ID NO: 54525 - RNA, 17 nt, Artificial Sequence
  Synthetic
gacccaagcaccgcagc

SEQ ID NO: 54526 - RNA, 17 nt, Artificial Sequence
  Synthetic
ggaagagagaagagagc

SEQ ID NO: 54527 - RNA, 17 nt, Artificial Sequence
  Synthetic
agccggagaggccgagc

SEQ ID NO: 54528 - RNA, 17 nt, Artificial Sequence
  Synthetic
ucacacgagacacacgc

SEQ ID NO: 54529 - RNA, 17 nt, Artificial Sequence
  Synthetic
gcgucucggugggacgc

SEQ ID NO: 54530 - RNA, 17 nt, Artificial Sequence
  Synthetic
ucucgccgcgaucccgc

SEQ ID NO: 54531 - RNA, 17 nt, Artificial Sequence
  Synthetic
ccgcgugagccguccgc

SEQ ID NO: 54532 - RNA, 17 nt, Artificial Sequence
  Synthetic
ccggaggcugcgggcgc

SEQ ID NO: 54533 - RNA, 17 nt, Artificial Sequence
  Synthetic
gauacggguuggcucgc

SEQ ID NO: 54534 - RNA, 17 nt, Artificial Sequence
  Synthetic
acgccgcgcguucucgc

SEQ ID NO: 54535 - RNA, 17 nt, Artificial Sequence
  Synthetic
ucccagaaagggcaggc

SEQ ID NO: 54536 - RNA, 17 nt, Artificial Sequence
  Synthetic
uucaagaaacacgaggc

SEQ ID NO: 54537 - RNA, 17 nt, Artificial Sequence
  Synthetic
gggguccggggcgaggc

SEQ ID NO: 54538 - RNA, 17 nt, Artificial Sequence
  Synthetic
cgccgcgccccaccggc

SEQ ID NO: 54539 - RNA, 17 nt, Artificial Sequence
  Synthetic
gagggaaggggcgcggc

SEQ ID NO: 54540 - RNA, 17 nt, Artificial Sequence
  Synthetic
gcuucugcugaggcggc

SEQ ID NO: 54541 - RNA, 17 nt, Artificial Sequence
  Synthetic
cagagggcggcggcggc

SEQ ID NO: 54542 - RNA, 17 nt, Artificial Sequence
  Synthetic
cuccuucgucgggcggc

SEQ ID NO: 54543 - RNA, 17 nt, Artificial Sequence
  Synthetic
agcggggagugggcggc

SEQ ID NO: 54544 - RNA, 17 nt, Artificial Sequence
  Synthetic
ggggucccagaaagggc

SEQ ID NO: 54545 - RNA, 17 nt, Artificial Sequence
  Synthetic
cgggacucgcggagggc

SEQ ID NO: 54546 - RNA, 17 nt, Artificial Sequence
  Synthetic
ggagugggcggccgggc

SEQ ID NO: 54547 - RNA, 17 nt, Artificial Sequence
  Synthetic
uccggggcgaggcgggc

SEQ ID NO: 54548 - RNA, 17 nt, Artificial Sequence
  Synthetic
ggagagggggggggggc

SEQ ID NO: 54549 - RNA, 17 nt, Artificial Sequence
  Synthetic
gggguaggugggugggc

SEQ ID NO: 54550 - RNA, 17 nt, Artificial Sequence
  Synthetic
ggaaggcgaggggaugc

SEQ ID NO: 54551 - RNA, 17 nt, Artificial Sequence
  Synthetic
gugcugccggaggcugc

SEQ ID NO: 54552 - RNA, 17 nt, Artificial Sequence
  Synthetic
gguggucggcgugcugc

SEQ ID NO: 54553 - RNA, 17 nt, Artificial Sequence
  Synthetic
gaugcaggaggaggauc

SEQ ID NO: 54554 - RNA, 17 nt, Artificial Sequence
  Synthetic
cccgcgcccgcagccuc

SEQ ID NO: 54555 - RNA, 17 nt, Artificial Sequence
  Synthetic
ccgggggacccaggcuc

SEQ ID NO: 54556 - RNA, 17 nt, Artificial Sequence
  Synthetic
uccccgcucggccucuc

SEQ ID NO: 54557 - RNA, 17 nt, Artificial Sequence
  Synthetic
ccucgccuuccauucuc

SEQ ID NO: 54558 - RNA, 17 nt, Artificial Sequence
  Synthetic
ggcggggggggggcguc

SEQ ID NO: 54559 - RNA, 17 nt, Artificial Sequence
  Synthetic
cuugggucuccuucguc

SEQ ID NO: 54560 - RNA, 17 nt, Artificial Sequence
  Synthetic
ggggcgcggcggcgguc

SEQ ID NO: 54561 - RNA, 17 nt, Artificial Sequence
  Synthetic
cacgggggggagggguc

SEQ ID NO: 54562 - RNA, 17 nt, Artificial Sequence
  Synthetic
gaccugccugcccuuuc

SEQ ID NO: 54563 - RNA, 17 nt, Artificial Sequence
  Synthetic
gcggcggcgguggaaag

SEQ ID NO: 54564 - RNA, 17 nt, Artificial Sequence
  Synthetic
cucguguuucuugaaag

SEQ ID NO: 54565 - RNA, 17 nt, Artificial Sequence
  Synthetic
agagagagagaaggaag

SEQ ID NO: 54566 - RNA, 17 nt, Artificial Sequence
  Synthetic
cgggcgggcgaaggaag

SEQ ID NO: 54567 - RNA, 17 nt, Artificial Sequence
  Synthetic
gacgaggagaagggaag

SEQ ID NO: 54568 - RNA, 17 nt, Artificial Sequence
  Synthetic
gagaaggaagagggaag

SEQ ID NO: 54569 - RNA, 17 nt, Artificial Sequence
  Synthetic
aagagagaagagagcag

SEQ ID NO: 54570 - RNA, 17 nt, Artificial Sequence
  Synthetic
cggugggacgcgggcag

SEQ ID NO: 54571 - RNA, 17 nt, Artificial Sequence
  Synthetic
cugaggcggcgggagag

SEQ ID NO: 54572 - RNA, 17 nt, Artificial Sequence
  Synthetic
cagccggagaggccgag

SEQ ID NO: 54573 - RNA, 17 nt, Artificial Sequence
  Synthetic
ggagaauggaaggcgag

SEQ ID NO: 54574 - RNA, 17 nt, Artificial Sequence
  Synthetic
aacgcgcggcguucgag

SEQ ID NO: 54575 - RNA, 17 nt, Artificial Sequence
  Synthetic
aagcaccgcagccggag

SEQ ID NO: 54576 - RNA, 17 nt, Artificial Sequence
  Synthetic
ugcugaggcggcgggag

SEQ ID NO: 54577 - RNA, 17 nt, Artificial Sequence
  Synthetic
agaggccgagcggggag

SEQ ID NO: 54578 - RNA, 17 nt, Artificial Sequence
  Synthetic
gggaacacgggggggag

SEQ ID NO: 54579 - RNA, 17 nt, Artificial Sequence
  Synthetic
ggcggucggggugggag

SEQ ID NO: 54580 - RNA, 17 nt, Artificial Sequence
  Synthetic
cccuuucaagaaacacg

SEQ ID NO: 54581 - RNA, 17 nt, Artificial Sequence
  Synthetic
acgauggggggaacacg

SEQ ID NO: 54582 - RNA, 17 nt, Artificial Sequence
  Synthetic
ccggcggacggcucacg

SEQ ID NO: 54583 - RNA, 17 nt, Artificial Sequence
  Synthetic
cgggacgggggaagacg

SEQ ID NO: 54584 - RNA, 17 nt, Artificial Sequence
  Synthetic
aggggcgcggcgggacg

SEQ ID NO: 54585 - RNA, 17 nt, Artificial Sequence
  Synthetic
ggcgucucggugggacg

SEQ ID NO: 54586 - RNA, 17 nt, Artificial Sequence
  Synthetic
gcgugagccguccgccg

SEQ ID NO: 54587 - RNA, 17 nt, Artificial Sequence
  Synthetic
gggggacccaggcuccg

SEQ ID NO: 54588 - RNA, 17 nt, Artificial Sequence
  Synthetic
cgggggggagggguccg

SEQ ID NO: 54589 - RNA, 17 nt, Artificial Sequence
  Synthetic
gccggagaggccgagcg

SEQ ID NO: 54590 - RNA, 17 nt, Artificial Sequence
  Synthetic
cuaccugcgagaacgcg

SEQ ID NO: 54591 - RNA, 17 nt, Artificial Sequence
  Synthetic
cggaggcugcgggcgcg

SEQ ID NO: 54592 - RNA, 17 nt, Artificial Sequence
  Synthetic
cccaaacagccaaggcg

SEQ ID NO: 54593 - RNA, 17 nt, Artificial Sequence
  Synthetic
ccggagaauggaaggcg

SEQ ID NO: 54594 - RNA, 17 nt, Artificial Sequence
  Synthetic
ucaagaaacacgaggcg

SEQ ID NO: 54595 - RNA, 17 nt, Artificial Sequence
  Synthetic
ggacggcucacgcggcg

SEQ ID NO: 54596 - RNA, 17 nt, Artificial Sequence
  Synthetic
agagggcggcggcggcg

SEQ ID NO: 54597 - RNA, 17 nt, Artificial Sequence
  Synthetic
uccuucgucgggcggcg

SEQ ID NO: 54598 - RNA, 17 nt, Artificial Sequence
  Synthetic
gccggaggcugcgggcg

SEQ ID NO: 54599 - RNA, 17 nt, Artificial Sequence
  Synthetic
ggagaagggaaggggcg

SEQ ID NO: 54600 - RNA, 17 nt, Artificial Sequence
  Synthetic
ggaagagggaaggggcg

SEQ ID NO: 54601 - RNA, 17 nt, Artificial Sequence
  Synthetic
gggagggguccggggcg

SEQ ID NO: 54602 - RNA, 17 nt, Artificial Sequence
  Synthetic
aggcgcgguggggggcg

SEQ ID NO: 54603 - RNA, 17 nt, Artificial Sequence
  Synthetic
aucccgccgguggggcg

SEQ ID NO: 54604 - RNA, 17 nt, Artificial Sequence
  Synthetic
ccccaccggcgggaucg

SEQ ID NO: 54605 - RNA, 17 nt, Artificial Sequence
  Synthetic
gggggcgucgggacucg

SEQ ID NO: 54606 - RNA, 17 nt, Artificial Sequence
  Synthetic
ggauacggguuggcucg

SEQ ID NO: 54607 - RNA, 17 nt, Artificial Sequence
  Synthetic
gggcgcggcggcggucg

SEQ ID NO: 54608 - RNA, 17 nt, Artificial Sequence
  Synthetic
guggggggagagugucg

SEQ ID NO: 54609 - RNA, 17 nt, Artificial Sequence
  Synthetic
agaacgcgcggcguucg

SEQ ID NO: 54610 - RNA, 17 nt, Artificial Sequence
  Synthetic
uuuuguuauuauuuucg

SEQ ID NO: 54611 - RNA, 17 nt, Artificial Sequence
  Synthetic
ucguguuucuugaaagg

SEQ ID NO: 54612 - RNA, 17 nt, Artificial Sequence
  Synthetic
gggcgggcgaaggaagg

SEQ ID NO: 54613 - RNA, 17 nt, Artificial Sequence
  Synthetic
aggcgaggggaugcagg

SEQ ID NO: 54614 - RNA, 17 nt, Artificial Sequence
  Synthetic
ugaggcggcgggagagg

SEQ ID NO: 54615 - RNA, 17 nt, Artificial Sequence
  Synthetic
uuucaagaaacacgagg

SEQ ID NO: 54616 - RNA, 17 nt, Artificial Sequence
  Synthetic
agggguccggggcgagg

SEQ ID NO: 54617 - RNA, 17 nt, Artificial Sequence
  Synthetic
cgaggggaugcaggagg

SEQ ID NO: 54618 - RNA, 17 nt, Artificial Sequence
  Synthetic
gugagcuucugcugagg

SEQ ID NO: 54619 - RNA, 17 nt, Artificial Sequence
  Synthetic
ugcgggcgcgggguagg

SEQ ID NO: 54620 - RNA, 17 nt, Artificial Sequence
  Synthetic
ggaaagcggaaaaacgg

SEQ ID NO: 54621 - RNA, 17 nt, Artificial Sequence
  Synthetic
cgauggggggaacacgg

SEQ ID NO: 54622 - RNA, 17 nt, Artificial Sequence
  Synthetic
ggggcgcggcgggacgg

SEQ ID NO: 54623 - RNA, 17 nt, Artificial Sequence
  Synthetic
ccgccgcgccccaccgg

SEQ ID NO: 54624 - RNA, 17 nt, Artificial Sequence
  Synthetic
gagccugggucccccgg

SEQ ID NO: 54625 - RNA, 17 nt, Artificial Sequence
  Synthetic
cgccgcgaucccgccgg

SEQ ID NO: 54626 - RNA, 17 nt, Artificial Sequence
  Synthetic
cgugagccguccgccgg

SEQ ID NO: 54627 - RNA, 17 nt, Artificial Sequence
  Synthetic
ggucggcgugcugccgg

SEQ ID NO: 54628 - RNA, 17 nt, Artificial Sequence
  Synthetic
ggggacccaggcuccgg

SEQ ID NO: 54629 - RNA, 17 nt, Artificial Sequence
  Synthetic
aaacagccaaggcgcgg

SEQ ID NO: 54630 - RNA, 17 nt, Artificial Sequence
  Synthetic
agagggaaggggcgcgg

SEQ ID NO: 54631 - RNA, 17 nt, Artificial Sequence
  Synthetic
ccgccgguggggcgcgg

SEQ ID NO: 54632 - RNA, 17 nt, Artificial Sequence
  Synthetic
ggcgucgggacucgcgg

SEQ ID NO: 54633 - RNA, 17 nt, Artificial Sequence
  Synthetic
caagaaacacgaggcgg

SEQ ID NO: 54634 - RNA, 17 nt, Artificial Sequence
  Synthetic
agcuucugcugaggcgg

SEQ ID NO: 54635 - RNA, 17 nt, Artificial Sequence
  Synthetic
ccgguggggcgcggcgg

SEQ ID NO: 54636 - RNA, 17 nt, Artificial Sequence
  Synthetic
gagggcggcggcggcgg

SEQ ID NO: 54637 - RNA, 17 nt, Artificial Sequence
  Synthetic
gcagagggcggcggcgg

SEQ ID NO: 54638 - RNA, 17 nt, Artificial Sequence
  Synthetic
ggugguggcggcggcgg

SEQ ID NO: 54639 - RNA, 17 nt, Artificial Sequence
  Synthetic
cgggcagagggcggcgg

SEQ ID NO: 54640 - RNA, 17 nt, Artificial Sequence
  Synthetic
ccuucgucgggcggcgg

SEQ ID NO: 54641 - RNA, 17 nt, Artificial Sequence
  Synthetic
uugggggguggcggcgg

SEQ ID NO: 54642 - RNA, 17 nt, Artificial Sequence
  Synthetic
gggggugguggcggcgg

SEQ ID NO: 54643 - RNA, 17 nt, Artificial Sequence
  Synthetic
acgcgggcagagggcgg

SEQ ID NO: 54644 - RNA, 17 nt, Artificial Sequence
  Synthetic
ucuccuucgucgggcgg

SEQ ID NO: 54645 - RNA, 17 nt, Artificial Sequence
  Synthetic
uguuugggggguggcgg

SEQ ID NO: 54646 - RNA, 17 nt, Artificial Sequence
  Synthetic
agggggggugguggcgg

SEQ ID NO: 54647 - RNA, 17 nt, Artificial Sequence
  Synthetic
gcggcgcggcgucucgg

SEQ ID NO: 54648 - RNA, 17 nt, Artificial Sequence
  Synthetic
ggcgggcgaaggaaggg

SEQ ID NO: 54649 - RNA, 17 nt, Artificial Sequence
  Synthetic
gggacgcgggcagaggg

SEQ ID NO: 54650 - RNA, 17 nt, Artificial Sequence
  Synthetic
gaggcggcgggagaggg

SEQ ID NO: 54651 - RNA, 17 nt, Artificial Sequence
  Synthetic
gauggggggaacacggg

SEQ ID NO: 54652 - RNA, 17 nt, Artificial Sequence
  Synthetic
gggagugggcggccggg

SEQ ID NO: 54653 - RNA, 17 nt, Artificial Sequence
  Synthetic
gggacccaggcuccggg

SEQ ID NO: 54654 - RNA, 17 nt, Artificial Sequence
  Synthetic
acggguuggcucgcggg

SEQ ID NO: 54655 - RNA, 17 nt, Artificial Sequence
  Synthetic
guccggggcgaggcggg

SEQ ID NO: 54656 - RNA, 17 nt, Artificial Sequence
  Synthetic
agggcggcggcggcggg

SEQ ID NO: 54657 - RNA, 17 nt, Artificial Sequence
  Synthetic
cuucgucgggcggcggg

SEQ ID NO: 54658 - RNA, 17 nt, Artificial Sequence
  Synthetic
gagggggggggggcggg

SEQ ID NO: 54659 - RNA, 17 nt, Artificial Sequence
  Synthetic
guaggugggugggcggg

SEQ ID NO: 54660 - RNA, 17 nt, Artificial Sequence
  Synthetic
gggucuccuucgucggg

SEQ ID NO: 54661 - RNA, 17 nt, Artificial Sequence
  Synthetic
gcgggcgaaggaagggg

SEQ ID NO: 54662 - RNA, 17 nt, Artificial Sequence
  Synthetic
aggcggcgggagagggg

SEQ ID NO: 54663 - RNA, 17 nt, Artificial Sequence
  Synthetic
auggggggaacacgggg

SEQ ID NO: 54664 - RNA, 17 nt, Artificial Sequence
  Synthetic
ggacccaggcuccgggg

SEQ ID NO: 54665 - RNA, 17 nt, Artificial Sequence
  Synthetic
gggcggcggcggcgggg

SEQ ID NO: 54666 - RNA, 17 nt, Artificial Sequence
  Synthetic
uucgucgggcggcgggg

SEQ ID NO: 54667 - RNA, 17 nt, Artificial Sequence
  Synthetic
cgcggcggcggucgggg

SEQ ID NO: 54668 - RNA, 17 nt, Artificial Sequence
  Synthetic
uguuucuugaaaggggg

SEQ ID NO: 54669 - RNA, 17 nt, Artificial Sequence
  Synthetic
ggcggcgggagaggggg

SEQ ID NO: 54670 - RNA, 17 nt, Artificial Sequence
  Synthetic
gacccaggcuccggggg

SEQ ID NO: 54671 - RNA, 17 nt, Artificial Sequence
  Synthetic
ggcggcggcggcggggg

SEQ ID NO: 54672 - RNA, 17 nt, Artificial Sequence
  Synthetic
ucgucgggcggcggggg

SEQ ID NO: 54673 - RNA, 17 nt, Artificial Sequence
  Synthetic
gcggcgggagagggggg

SEQ ID NO: 54674 - RNA, 17 nt, Artificial Sequence
  Synthetic
acccaggcuccgggggg

SEQ ID NO: 54675 - RNA, 17 nt, Artificial Sequence
  Synthetic
gcggcggcggcgggggg

SEQ ID NO: 54676 - RNA, 17 nt, Artificial Sequence
  Synthetic
cgucgggcggcgggggg

SEQ ID NO: 54677 - RNA, 17 nt, Artificial Sequence
  Synthetic
ggcgaaggaaggggggg

SEQ ID NO: 54678 - RNA, 17 nt, Artificial Sequence
  Synthetic
cggcgggagaggggggg

SEQ ID NO: 54679 - RNA, 17 nt, Artificial Sequence
  Synthetic
gggggaacacggggggg

SEQ ID NO: 54680 - RNA, 17 nt, Artificial Sequence
  Synthetic
cccaggcuccggggggg

SEQ ID NO: 54681 - RNA, 17 nt, Artificial Sequence
  Synthetic
cggcggcggcggggggg

SEQ ID NO: 54682 - RNA, 17 nt, Artificial Sequence
  Synthetic
gucgggcggcggggggg

SEQ ID NO: 54683 - RNA, 17 nt, Artificial Sequence
  Synthetic
ggcgggagagggggggg

SEQ ID NO: 54684 - RNA, 17 nt, Artificial Sequence
  Synthetic
ccaggcuccgggggggg

SEQ ID NO: 54685 - RNA, 17 nt, Artificial Sequence
  Synthetic
ggcggcggcgggggggg

SEQ ID NO: 54686 - RNA, 17 nt, Artificial Sequence
  Synthetic
caggcuccggggggggg

SEQ ID NO: 54687 - RNA, 17 nt, Artificial Sequence
  Synthetic
gcggcggcggggggggg

SEQ ID NO: 54688 - RNA, 17 nt, Artificial Sequence
  Synthetic
cggcggcgggggggggg

SEQ ID NO: 54689 - RNA, 17 nt, Artificial Sequence
  Synthetic
gggagaggggggggggg

SEQ ID NO: 54690 - RNA, 17 nt, Artificial Sequence
  Synthetic
gggcggguggugggggg

SEQ ID NO: 54691 - RNA, 17 nt, Artificial Sequence
  Synthetic
cuuggcuguuugggggg

SEQ ID NO: 54692 - RNA, 17 nt, Artificial Sequence
  Synthetic
ugggcgggugguggggg

SEQ ID NO: 54693 - RNA, 17 nt, Artificial Sequence
  Synthetic
gugggcggguggugggg

SEQ ID NO: 54694 - RNA, 17 nt, Artificial Sequence
  Synthetic
ugguggugaacgauggg

SEQ ID NO: 54695 - RNA, 17 nt, Artificial Sequence
  Synthetic
gccgagcggggaguggg

SEQ ID NO: 54696 - RNA, 17 nt, Artificial Sequence
  Synthetic
ggcgcgggguagguggg

SEQ ID NO: 54697 - RNA, 17 nt, Artificial Sequence
  Synthetic
agccaaggcgcgguggg

SEQ ID NO: 54698 - RNA, 17 nt, Artificial Sequence
  Synthetic
gcggcggucgggguggg

SEQ ID NO: 54699 - RNA, 17 nt, Artificial Sequence
  Synthetic
cgggguagguggguggg

SEQ ID NO: 54700 - RNA, 17 nt, Artificial Sequence
  Synthetic
ggugggcgggugguggg

SEQ ID NO: 54701 - RNA, 17 nt, Artificial Sequence
  Synthetic
cgccuuggcuguuuggg

SEQ ID NO: 54702 - RNA, 17 nt, Artificial Sequence
  Synthetic
gugguggugaacgaugg

SEQ ID NO: 54703 - RNA, 17 nt, Artificial Sequence
  Synthetic
ggucggggugggagugg

SEQ ID NO: 54704 - RNA, 17 nt, Artificial Sequence
  Synthetic
cgcgguggggggcgugg

SEQ ID NO: 54705 - RNA, 17 nt, Artificial Sequence
  Synthetic
cagccaaggcgcggugg

SEQ ID NO: 54706 - RNA, 17 nt, Artificial Sequence
  Synthetic
ggugggugggcgggugg

SEQ ID NO: 54707 - RNA, 17 nt, Artificial Sequence
  Synthetic
ggcggcggucggggugg

SEQ ID NO: 54708 - RNA, 17 nt, Artificial Sequence
  Synthetic
gaaggaagggggggugg

SEQ ID NO: 54709 - RNA, 17 nt, Artificial Sequence
  Synthetic
ggcuguuuggggggugg

SEQ ID NO: 54710 - RNA, 17 nt, Artificial Sequence
  Synthetic
cggggugggaguggugg

SEQ ID NO: 54711 - RNA, 17 nt, Artificial Sequence
  Synthetic
gggugggcggguggugg

SEQ ID NO: 54712 - RNA, 17 nt, Artificial Sequence
  Synthetic
ggaaggggggguggugg

SEQ ID NO: 54713 - RNA, 17 nt, Artificial Sequence
  Synthetic
ggugggagugguggugg

SEQ ID NO: 54714 - RNA, 17 nt, Artificial Sequence
  Synthetic
aagagagcagggguugg

SEQ ID NO: 54715 - RNA, 17 nt, Artificial Sequence
  Synthetic
gcgccuuggcuguuugg

SEQ ID NO: 54716 - RNA, 17 nt, Artificial Sequence
  Synthetic
uggaagggcagaagaug

SEQ ID NO: 54717 - RNA, 17 nt, Artificial Sequence
  Synthetic
cgugguggugaacgaug

SEQ ID NO: 54718 - RNA, 17 nt, Artificial Sequence
  Synthetic
cgugcugccggaggcug

SEQ ID NO: 54719 - RNA, 17 nt, Artificial Sequence
  Synthetic
cucggccucuccggcug

SEQ ID NO: 54720 - RNA, 17 nt, Artificial Sequence
  Synthetic
caggugagcuucugcug

SEQ ID NO: 54721 - RNA, 17 nt, Artificial Sequence
  Synthetic
ccgcgaucccgccggug

SEQ ID NO: 54722 - RNA, 17 nt, Artificial Sequence
  Synthetic
acagccaaggcgcggug

SEQ ID NO: 54723 - RNA, 17 nt, Artificial Sequence
  Synthetic
uuggcucgcgggcggug

SEQ ID NO: 54724 - RNA, 17 nt, Artificial Sequence
  Synthetic
cggcggcggucggggug

SEQ ID NO: 54725 - RNA, 17 nt, Artificial Sequence
  Synthetic
ugggugggcggguggug

SEQ ID NO: 54726 - RNA, 17 nt, Artificial Sequence
  Synthetic
gggugggagugguggug

SEQ ID NO: 54727 - RNA, 17 nt, Artificial Sequence
  Synthetic
ggggggggggaaaugug

SEQ ID NO: 54728 - RNA, 17 nt, Artificial Sequence
  Synthetic
gaagagagcagggguug

SEQ ID NO: 54729 - RNA, 17 nt, Artificial Sequence
  Synthetic
cgcgccuuggcuguuug

SEQ ID NO: 54730 - RNA, 17 nt, Artificial Sequence
  Synthetic
auggaagggcagaagau

SEQ ID NO: 54731 - RNA, 17 nt, Artificial Sequence
  Synthetic
gcgugguggugaacgau

SEQ ID NO: 54732 - RNA, 17 nt, Artificial Sequence
  Synthetic
ggaugcaggaggaggau

SEQ ID NO: 54733 - RNA, 17 nt, Artificial Sequence
  Synthetic
ccccccccccggagccu

SEQ ID NO: 54734 - RNA, 17 nt, Artificial Sequence
  Synthetic
cgccccccaccgcgccu

SEQ ID NO: 54735 - RNA, 17 nt, Artificial Sequence
  Synthetic
gccgcccacuccccgcu

SEQ ID NO: 54736 - RNA, 17 nt, Artificial Sequence
  Synthetic
ucuccggcugcggugcu

SEQ ID NO: 54737 - RNA, 17 nt, Artificial Sequence
  Synthetic
cacgcggcgcggcgucu

SEQ ID NO: 54738 - RNA, 17 nt, Artificial Sequence
  Synthetic
accugccugcccuuucu

SEQ ID NO: 54739 - RNA, 17 nt, Artificial Sequence
  Synthetic
ccguauccuuuuuuucu

SEQ ID NO: 54740 - RNA, 17 nt, Artificial Sequence
  Synthetic
gaggccgagcggggagu

SEQ ID NO: 54741 - RNA, 17 nt, Artificial Sequence
  Synthetic
cggcggggggggggcgu

SEQ ID NO: 54742 - RNA, 17 nt, Artificial Sequence
  Synthetic
uggggggagagugucgu

SEQ ID NO: 54743 - RNA, 17 nt, Artificial Sequence
  Synthetic
gcuugggucuccuucgu

SEQ ID NO: 54744 - RNA, 17 nt, Artificial Sequence
  Synthetic
cgcgcguucucgcaggu

SEQ ID NO: 54745 - RNA, 17 nt, Artificial Sequence
  Synthetic
gcgggcgcgggguaggu

SEQ ID NO: 54746 - RNA, 17 nt, Artificial Sequence
  Synthetic
gccgcgaucccgccggu

SEQ ID NO: 54747 - RNA, 17 nt, Artificial Sequence
  Synthetic
aacagccaaggcgcggu

SEQ ID NO: 54748 - RNA, 17 nt, Artificial Sequence
  Synthetic
uggggcgcggcggcggu

SEQ ID NO: 54749 - RNA, 17 nt, Artificial Sequence
  Synthetic
cggcgcggcgucucggu

SEQ ID NO: 54750 - RNA, 17 nt, Artificial Sequence
  Synthetic
aaaaaaaggauacgggu

SEQ ID NO: 54751 - RNA, 17 nt, Artificial Sequence
  Synthetic
gagaagagagcaggggu

SEQ ID NO: 54752 - RNA, 17 nt, Artificial Sequence
  Synthetic
ggcugcgggcgcggggu

SEQ ID NO: 54753 - RNA, 17 nt, Artificial Sequence
  Synthetic
gcggcggcggucggggu

SEQ ID NO: 54754 - RNA, 17 nt, Artificial Sequence
  Synthetic
gcgcgggguaggugggu

SEQ ID NO: 54755 - RNA, 17 nt, Artificial Sequence
  Synthetic
gggguggcggcgguggu

SEQ ID NO: 54756 - RNA, 17 nt, Artificial Sequence
  Synthetic
gugggugggcggguggu

SEQ ID NO: 54757 - RNA, 17 nt, Artificial Sequence
  Synthetic
ggggugggagugguggu

SEQ ID NO: 54758 - RNA, 17 nt, Artificial Sequence
  Synthetic
cuccggcugcggugcuu

SEQ ID NO: 54759 - RNA, 17 nt, Artificial Sequence
  Synthetic
agaagagagcagggguu

SEQ ID NO: 54760 - RNA, 17 nt, Artificial Sequence
  Synthetic
accgcgccuuggcuguu

SEQ ID NO: 54761 - RNA, 17 nt, Artificial Sequence
  Synthetic
uucucgcagguagguuu

SEQ ID NO: 54762 - RNA, 17 nt, Artificial Sequence
  Synthetic
ccgcgccuuggcuguuu

SEQ ID NO: 54763 - RNA, 20 nt, Artificial Sequence
  Synthetic
acaaaaacaccuagaaaaaa

SEQ ID NO: 54764 - RNA, 20 nt, Artificial Sequence
  Synthetic
ggcgguggaaagcggaaaaa

SEQ ID NO: 54765 - RNA, 20 nt, Artificial Sequence
  Synthetic
cgaggcgggggucccagaaa

SEQ ID NO: 54766 - RNA, 20 nt, Artificial Sequence
  Synthetic
ccgccucguguuucuugaaa

SEQ ID NO: 54767 - RNA, 20 nt, Artificial Sequence
  Synthetic
acgaggcgggggucccagaa

SEQ ID NO: 54768 - RNA, 20 nt, Artificial Sequence
  Synthetic
acgggggaagacgaggagaa

SEQ ID NO: 54769 - RNA, 20 nt, Artificial Sequence
  Synthetic
acucgcggagggccggagaa

SEQ ID NO: 54770 - RNA, 20 nt, Artificial Sequence
  Synthetic
gaggcgggcgggcgaaggaa

SEQ ID NO: 54771 - RNA, 20 nt, Artificial Sequence
  Synthetic
ggaagacgaggagaagggaa

SEQ ID NO: 54772 - RNA, 20 nt, Artificial Sequence
  Synthetic
gagagagaaggaagagggaa

SEQ ID NO: 54773 - RNA, 20 nt, Artificial Sequence
  Synthetic
cggaaaaacggaggauggaa

SEQ ID NO: 54774 - RNA, 20 nt, Artificial Sequence
  Synthetic
cccgccucguguuucuugaa

SEQ ID NO: 54775 - RNA, 20 nt, Artificial Sequence
  Synthetic
ggugaacgauggggggaaca

SEQ ID NO: 54776 - RNA, 20 nt, Artificial Sequence
  Synthetic
cgccaccccccaaacagcca

SEQ ID NO: 54777 - RNA, 20 nt, Artificial Sequence
  Synthetic
gcggaagagagaagagagca

SEQ ID NO: 54778 - RNA, 20 nt, Artificial Sequence
  Synthetic
gaggauggaagggcagaaga

SEQ ID NO: 54779 - RNA, 20 nt, Artificial Sequence
  Synthetic
acagagagagagaaggaaga

SEQ ID NO: 54780 - RNA, 20 nt, Artificial Sequence
  Synthetic
cucggugggacgcgggcaga

SEQ ID NO: 54781 - RNA, 20 nt, Artificial Sequence
  Synthetic
gagcgagacagagagagaga

SEQ ID NO: 54782 - RNA, 20 nt, Artificial Sequence
  Synthetic
gacgggggaagacgaggaga

SEQ ID NO: 54783 - RNA, 20 nt, Artificial Sequence
  Synthetic
ucugcugaggcggcgggaga

SEQ ID NO: 54784 - RNA, 20 nt, Artificial Sequence
  Synthetic
gggggcgugguggugaacga

SEQ ID NO: 54785 - RNA, 20 nt, Artificial Sequence
  Synthetic
ccccccccgccgcccgacga

SEQ ID NO: 54786 - RNA, 20 nt, Artificial Sequence
  Synthetic
ggccggagaauggaaggcga

SEQ ID NO: 54787 - RNA, 20 nt, Artificial Sequence
  Synthetic
ggggcgaggcgggcgggcga

SEQ ID NO: 54788 - RNA, 20 nt, Artificial Sequence
  Synthetic
gaggagaagggaaggggcga

SEQ ID NO: 54789 - RNA, 20 nt, Artificial Sequence
  Synthetic
cgagaacgcgcggcguucga

SEQ ID NO: 54790 - RNA, 20 nt, Artificial Sequence
  Synthetic
cgaggcgggcgggcgaagga

SEQ ID NO: 54791 - RNA, 20 nt, Artificial Sequence
  Synthetic
gaaagcggaaaaacggagga

SEQ ID NO: 54792 - RNA, 20 nt, Artificial Sequence
  Synthetic
ggggcgucgggacucgcgga

SEQ ID NO: 54793 - RNA, 20 nt, Artificial Sequence
  Synthetic
agccugggucccccggcgga

SEQ ID NO: 54794 - RNA, 20 nt, Artificial Sequence
  Synthetic
gggaagacgaggagaaggga

SEQ ID NO: 54795 - RNA, 20 nt, Artificial Sequence
  Synthetic
agagagagaaggaagaggga

SEQ ID NO: 54796 - RNA, 20 nt, Artificial Sequence
  Synthetic
agggaaggggcgcggcggga

SEQ ID NO: 54797 - RNA, 20 nt, Artificial Sequence
  Synthetic
uggggggaacacggggggga

SEQ ID NO: 54798 - RNA, 20 nt, Artificial Sequence
  Synthetic
gcggagggccggagaaugga

SEQ ID NO: 54799 - RNA, 20 nt, Artificial Sequence
  Synthetic
gcggaaaaacggaggaugga

SEQ ID NO: 54800 - RNA, 20 nt, Artificial Sequence
  Synthetic
acaccuagaaaaaaaggaua

SEQ ID NO: 54801 - RNA, 20 nt, Artificial Sequence
  Synthetic
cguucucgcagguagguuua

SEQ ID NO: 54802 - RNA, 20 nt, Artificial Sequence
  Synthetic
gugaacgauggggggaacac

SEQ ID NO: 54803 - RNA, 20 nt, Artificial Sequence
  Synthetic
cgaccgccgccgcgccccac

SEQ ID NO: 54804 - RNA, 20 nt, Artificial Sequence
  Synthetic
gggaaggggcgcggcgggac

SEQ ID NO: 54805 - RNA, 20 nt, Artificial Sequence
  Synthetic
caccuagaaaaaaaggauac

SEQ ID NO: 54806 - RNA, 20 nt, Artificial Sequence
  Synthetic
agguagguuuagggucguac

SEQ ID NO: 54807 - RNA, 20 nt, Artificial Sequence
  Synthetic
agccguccgccgggggaccc

SEQ ID NO: 54808 - RNA, 20 nt, Artificial Sequence
  Synthetic
acgcaggcgccccccccccc

SEQ ID NO: 54809 - RNA, 20 nt, Artificial Sequence
  Synthetic
cccccggagccugggucccc

SEQ ID NO: 54810 - RNA, 20 nt, Artificial Sequence
  Synthetic
uucgcccgcccgccucgccc

SEQ ID NO: 54811 - RNA, 20 nt, Artificial Sequence
  Synthetic
gaucgcggcgagacgcagcc

SEQ ID NO: 54812 - RNA, 20 nt, Artificial Sequence
  Synthetic
cgccccccccccccggagcc

SEQ ID NO: 54813 - RNA, 20 nt, Artificial Sequence
  Synthetic
cgccgcgugagccguccgcc

SEQ ID NO: 54814 - RNA, 20 nt, Artificial Sequence
  Synthetic
cgagcggggagugggcggcc

SEQ ID NO: 54815 - RNA, 20 nt, Artificial Sequence
  Synthetic
gcggguggugggggggggcc

SEQ ID NO: 54816 - RNA, 20 nt, Artificial Sequence
  Synthetic
cgccgggggacccaggcucc

SEQ ID NO: 54817 - RNA, 20 nt, Artificial Sequence
  Synthetic
aacacgggggggaggggucc

SEQ ID NO: 54818 - RNA, 20 nt, Artificial Sequence
  Synthetic
ggaucgcggcgagacgcagc

SEQ ID NO: 54819 - RNA, 20 nt, Artificial Sequence
  Synthetic
ggagacccaagcaccgcagc

SEQ ID NO: 54820 - RNA, 20 nt, Artificial Sequence
  Synthetic
ggcggaagagagaagagagc

SEQ ID NO: 54821 - RNA, 20 nt, Artificial Sequence
  Synthetic
cgcagccggagaggccgagc

SEQ ID NO: 54822 - RNA, 20 nt, Artificial Sequence
  Synthetic
cucucacacgagacacacgc

SEQ ID NO: 54823 - RNA, 20 nt, Artificial Sequence
  Synthetic
gcggcgucucggugggacgc

SEQ ID NO: 54824 - RNA, 20 nt, Artificial Sequence
  Synthetic
gcgucucgccgcgaucccgc

SEQ ID NO: 54825 - RNA, 20 nt, Artificial Sequence
  Synthetic
gcgccgcgugagccguccgc

SEQ ID NO: 54826 - RNA, 20 nt, Artificial Sequence
  Synthetic
cugccggaggcugcgggcgc

SEQ ID NO: 54827 - RNA, 20 nt, Artificial Sequence
  Synthetic
aaggauacggguuggcucgc

SEQ ID NO: 54828 - RNA, 20 nt, Artificial Sequence
  Synthetic
cgaacgccgcgcguucucgc

SEQ ID NO: 54829 - RNA, 20 nt, Artificial Sequence
  Synthetic
gggucccagaaagggcaggc

SEQ ID NO: 54830 - RNA, 20 nt, Artificial Sequence
  Synthetic
ccuuucaagaaacacgaggc

SEQ ID NO: 54831 - RNA, 20 nt, Artificial Sequence
  Synthetic
ggagggguccggggcgaggc

SEQ ID NO: 54832 - RNA, 20 nt, Artificial Sequence
  Synthetic
cgccgccgcgccccaccggc

SEQ ID NO: 54833 - RNA, 20 nt, Artificial Sequence
  Synthetic
gaagagggaaggggcgcggc

SEQ ID NO: 54834 - RNA, 20 nt, Artificial Sequence
  Synthetic
ugagcuucugcugaggcggc

SEQ ID NO: 54835 - RNA, 20 nt, Artificial Sequence
  Synthetic
gggcagagggcggcggcggc

SEQ ID NO: 54836 - RNA, 20 nt, Artificial Sequence
  Synthetic
ggucuccuucgucgggcggc

SEQ ID NO: 54837 - RNA, 20 nt, Artificial Sequence
  Synthetic
ccgagcggggagugggcggc

SEQ ID NO: 54838 - RNA, 20 nt, Artificial Sequence
  Synthetic
gcgggggucccagaaagggc

SEQ ID NO: 54839 - RNA, 20 nt, Artificial Sequence
  Synthetic
cgucgggacucgcggagggc

SEQ ID NO: 54840 - RNA, 20 nt, Artificial Sequence
  Synthetic
cggggagugggcggccgggc

SEQ ID NO: 54841 - RNA, 20 nt, Artificial Sequence
  Synthetic
ggguccggggcgaggcgggc

SEQ ID NO: 54842 - RNA, 20 nt, Artificial Sequence
  Synthetic
gcgggagagggggggggggc

SEQ ID NO: 54843 - RNA, 20 nt, Artificial Sequence
  Synthetic
cgcgggguaggugggugggc

SEQ ID NO: 54844 - RNA, 20 nt, Artificial Sequence
  Synthetic
aauggaaggcgaggggaugc

SEQ ID NO: 54845 - RNA, 20 nt, Artificial Sequence
  Synthetic
ggcgugcugccggaggcugc

SEQ ID NO: 54846 - RNA, 20 nt, Artificial Sequence
  Synthetic
ggcgguggucggcgugcugc

SEQ ID NO: 54847 - RNA, 20 nt, Artificial Sequence
  Synthetic
ggggaugcaggaggaggauc

SEQ ID NO: 54848 - RNA, 20 nt, Artificial Sequence
  Synthetic
uaccccgcgcccgcagccuc

SEQ ID NO: 54849 - RNA, 20 nt, Artificial Sequence
  Synthetic
ccgccgggggacccaggcuc

SEQ ID NO: 54850 - RNA, 20 nt, Artificial Sequence
  Synthetic
cacuccccgcucggccucuc

SEQ ID NO: 54851 - RNA, 20 nt, Artificial Sequence
  Synthetic
uccccucgccuuccauucuc

SEQ ID NO: 54852 - RNA, 20 nt, Artificial Sequence
  Synthetic
ggcggcggggggggggcguc

SEQ ID NO: 54853 - RNA, 20 nt, Artificial Sequence
  Synthetic
gugcuugggucuccuucguc

SEQ ID NO: 54854 - RNA, 20 nt, Artificial Sequence
  Synthetic
gguggggcgcggcggcgguc

SEQ ID NO: 54855 - RNA, 20 nt, Artificial Sequence
  Synthetic
gaacacgggggggagggguc

SEQ ID NO: 54856 - RNA, 20 nt, Artificial Sequence
  Synthetic
gcugaccugccugcccuuuc

SEQ ID NO: 54857 - RNA, 20 nt, Artificial Sequence
  Synthetic
guggcggcggcgguggaaag

SEQ ID NO: 54858 - RNA, 20 nt, Artificial Sequence
  Synthetic
cgccucguguuucuugaaag

SEQ ID NO: 54859 - RNA, 20 nt, Artificial Sequence
  Synthetic
gacagagagagagaaggaag

SEQ ID NO: 54860 - RNA, 20 nt, Artificial Sequence
  Synthetic
aggcgggcgggcgaaggaag

SEQ ID NO: 54861 - RNA, 20 nt, Artificial Sequence
  Synthetic
gaagacgaggagaagggaag

SEQ ID NO: 54862 - RNA, 20 nt, Artificial Sequence
  Synthetic
agagagaaggaagagggaag

SEQ ID NO: 54863 - RNA, 20 nt, Artificial Sequence
  Synthetic
cggaagagagaagagagcag

SEQ ID NO: 54864 - RNA, 20 nt, Artificial Sequence
  Synthetic
ucucggugggacgcgggcag

SEQ ID NO: 54865 - RNA, 20 nt, Artificial Sequence
  Synthetic
cugcugaggcggcgggagag

SEQ ID NO: 54866 - RNA, 20 nt, Artificial Sequence
  Synthetic
ccgcagccggagaggccgag

SEQ ID NO: 54867 - RNA, 20 nt, Artificial Sequence
  Synthetic
gccggagaauggaaggcgag

SEQ ID NO: 54868 - RNA, 20 nt, Artificial Sequence
  Synthetic
gagaacgcgcggcguucgag

SEQ ID NO: 54869 - RNA, 20 nt, Artificial Sequence
  Synthetic
cccaagcaccgcagccggag

SEQ ID NO: 54870 - RNA, 20 nt, Artificial Sequence
  Synthetic
uucugcugaggcggcgggag

SEQ ID NO: 54871 - RNA, 20 nt, Artificial Sequence
  Synthetic
cggagaggccgagcggggag

SEQ ID NO: 54872 - RNA, 20 nt, Artificial Sequence
  Synthetic
ggggggaacacgggggggag

SEQ ID NO: 54873 - RNA, 20 nt, Artificial Sequence
  Synthetic
ggcggcggucggggugggag

SEQ ID NO: 54874 - RNA, 20 nt, Artificial Sequence
  Synthetic
ucccccuuucaagaaacacg

SEQ ID NO: 54875 - RNA, 20 nt, Artificial Sequence
  Synthetic
ugaacgauggggggaacacg

SEQ ID NO: 54876 - RNA, 20 nt, Artificial Sequence
  Synthetic
cccccggcggacggcucacg

SEQ ID NO: 54877 - RNA, 20 nt, Artificial Sequence
  Synthetic
cggcgggacgggggaagacg

SEQ ID NO: 54878 - RNA, 20 nt, Artificial Sequence
  Synthetic
ggaaggggcgcggcgggacg

SEQ ID NO: 54879 - RNA, 20 nt, Artificial Sequence
  Synthetic
cgcggcgucucggugggacg

SEQ ID NO: 54880 - RNA, 20 nt, Artificial Sequence
  Synthetic
gccgcgugagccguccgccg

SEQ ID NO: 54881 - RNA, 20 nt, Artificial Sequence
  Synthetic
gccgggggacccaggcuccg

SEQ ID NO: 54882 - RNA, 20 nt, Artificial Sequence
  Synthetic
acacgggggggagggguccg

SEQ ID NO: 54883 - RNA, 20 nt, Artificial Sequence
  Synthetic
gcagccggagaggccgagcg

SEQ ID NO: 54884 - RNA, 20 nt, Artificial Sequence
  Synthetic
aaccuaccugcgagaacgcg

SEQ ID NO: 54885 - RNA, 20 nt, Artificial Sequence
  Synthetic
ugccggaggcugcgggcgcg

SEQ ID NO: 54886 - RNA, 20 nt, Artificial Sequence
  Synthetic
ccccccaaacagccaaggcg

SEQ ID NO: 54887 - RNA, 20 nt, Artificial Sequence
  Synthetic
gggccggagaauggaaggcg

SEQ ID NO: 54888 - RNA, 20 nt, Artificial Sequence
  Synthetic
cuuucaagaaacacgaggcg

SEQ ID NO: 54889 - RNA, 20 nt, Artificial Sequence
  Synthetic
ggcggacggcucacgcggcg

SEQ ID NO: 54890 - RNA, 20 nt, Artificial Sequence
  Synthetic
ggcagagggcggcggcggcg

SEQ ID NO: 54891 - RNA, 20 nt, Artificial Sequence
  Synthetic
gucuccuucgucgggcggcg

SEQ ID NO: 54892 - RNA, 20 nt, Artificial Sequence
  Synthetic
gcugccggaggcugcgggcg

SEQ ID NO: 54893 - RNA, 20 nt, Artificial Sequence
  Synthetic
cgaggagaagggaaggggcg

SEQ ID NO: 54894 - RNA, 20 nt, Artificial Sequence
  Synthetic
gaaggaagagggaaggggcg

SEQ ID NO: 54895 - RNA, 20 nt, Artificial Sequence
  Synthetic
ggggggagggguccggggcg

SEQ ID NO: 54896 - RNA, 20 nt, Artificial Sequence
  Synthetic
ccaaggcgcgguggggggcg

SEQ ID NO: 54897 - RNA, 20 nt, Artificial Sequence
  Synthetic
gcgaucccgccgguggggcg

SEQ ID NO: 54898 - RNA, 20 nt, Artificial Sequence
  Synthetic
gcgccccaccggcgggaucg

SEQ ID NO: 54899 - RNA, 20 nt, Artificial Sequence
  Synthetic
ggggggggcgucgggacucg

SEQ ID NO: 54900 - RNA, 20 nt, Artificial Sequence
  Synthetic
aaaggauacggguuggcucg

SEQ ID NO: 54901 - RNA, 20 nt, Artificial Sequence
  Synthetic
guggggcgcggcggcggucg

SEQ ID NO: 54902 - RNA, 20 nt, Artificial Sequence
  Synthetic
gggguggggggagagugucg

SEQ ID NO: 54903 - RNA, 20 nt, Artificial Sequence
  Synthetic
gcgagaacgcgcggcguucg

SEQ ID NO: 54904 - RNA, 20 nt, Artificial Sequence
  Synthetic
uuguuuuguuauuauuuucg

SEQ ID NO: 54905 - RNA, 20 nt, Artificial Sequence
  Synthetic
gccucguguuucuugaaagg

SEQ ID NO: 54906 - RNA, 20 nt, Artificial Sequence
  Synthetic
ggcgggcgggcgaaggaagg

SEQ ID NO: 54907 - RNA, 20 nt, Artificial Sequence
  Synthetic
ggaaggcgaggggaugcagg

SEQ ID NO: 54908 - RNA, 20 nt, Artificial Sequence
  Synthetic
ugcugaggcggcgggagagg

SEQ ID NO: 54909 - RNA, 20 nt, Artificial Sequence
  Synthetic
cccuuucaagaaacacgagg

SEQ ID NO: 54910 - RNA, 20 nt, Artificial Sequence
  Synthetic
gggagggguccggggcgagg

SEQ ID NO: 54911 - RNA, 20 nt, Artificial Sequence
  Synthetic
aggcgaggggaugcaggagg

SEQ ID NO: 54912 - RNA, 20 nt, Artificial Sequence
  Synthetic
caggugagcuucugcugagg

SEQ ID NO: 54913 - RNA, 20 nt, Artificial Sequence
  Synthetic
ggcugcgggcgcgggguagg

SEQ ID NO: 54914 - RNA, 20 nt, Artificial Sequence
  Synthetic
gguggaaagcggaaaaacgg

SEQ ID NO: 54915 - RNA, 20 nt, Artificial Sequence
  Synthetic
gaacgauggggggaacacgg

SEQ ID NO: 54916 - RNA, 20 nt, Artificial Sequence
  Synthetic
gaaggggcgcggcgggacgg

SEQ ID NO: 54917 - RNA, 20 nt, Artificial Sequence
  Synthetic
ccgccgccgcgccccaccgg

SEQ ID NO: 54918 - RNA, 20 nt, Artificial Sequence
  Synthetic
ccggagccugggucccccgg

SEQ ID NO: 54919 - RNA, 20 nt, Artificial Sequence
  Synthetic
ucucgccgcgaucccgccgg

SEQ ID NO: 54920 - RNA, 20 nt, Artificial Sequence
  Synthetic
ccgcgugagccguccgccgg

SEQ ID NO: 54921 - RNA, 20 nt, Artificial Sequence
  Synthetic
gguggucggcgugcugccgg

SEQ ID NO: 54922 - RNA, 20 nt, Artificial Sequence
  Synthetic
ccgggggacccaggcuccgg

SEQ ID NO: 54923 - RNA, 20 nt, Artificial Sequence
  Synthetic
cccaaacagccaaggcgcgg

SEQ ID NO: 54924 - RNA, 20 nt, Artificial Sequence
  Synthetic
ggaagagggaaggggcgcgg

SEQ ID NO: 54925 - RNA, 20 nt, Artificial Sequence
  Synthetic
aucccgccgguggggcgcgg

SEQ ID NO: 54926 - RNA, 20 nt, Artificial Sequence
  Synthetic
gggggcgucgggacucgcgg

SEQ ID NO: 54927 - RNA, 20 nt, Artificial Sequence
  Synthetic
uuucaagaaacacgaggcgg

SEQ ID NO: 54928 - RNA, 20 nt, Artificial Sequence
  Synthetic
gugagcuucugcugaggcgg

SEQ ID NO: 54929 - RNA, 20 nt, Artificial Sequence
  Synthetic
ccgccgguggggcgcggcgg

SEQ ID NO: 54930 - RNA, 20 nt, Artificial Sequence
  Synthetic
gcagagggcggcggcggcgg

SEQ ID NO: 54931 - RNA, 20 nt, Artificial Sequence
  Synthetic
cgggcagagggcggcggcgg

SEQ ID NO: 54932 - RNA, 20 nt, Artificial Sequence
  Synthetic
gggggugguggcggcggcgg

SEQ ID NO: 54933 - RNA, 20 nt, Artificial Sequence
  Synthetic
acgcgggcagagggcggcgg

SEQ ID NO: 54934 - RNA, 20 nt, Artificial Sequence
  Synthetic
ucuccuucgucgggcggcgg

SEQ ID NO: 54935 - RNA, 20 nt, Artificial Sequence
  Synthetic
uguuugggggguggcggcgg

SEQ ID NO: 54936 - RNA, 20 nt, Artificial Sequence
  Synthetic
agggggggugguggcggcgg

SEQ ID NO: 54937 - RNA, 20 nt, Artificial Sequence
  Synthetic
gggacgcgggcagagggcgg

SEQ ID NO: 54938 - RNA, 20 nt, Artificial Sequence
  Synthetic
gggucuccuucgucgggcgg

SEQ ID NO: 54939 - RNA, 20 nt, Artificial Sequence
  Synthetic
ggcuguuugggggguggcgg

SEQ ID NO: 54940 - RNA, 20 nt, Artificial Sequence
  Synthetic
ggaagggggggugguggcgg

SEQ ID NO: 54941 - RNA, 20 nt, Artificial Sequence
  Synthetic
cacgcggcgcggcgucucgg

SEQ ID NO: 54942 - RNA, 20 nt, Artificial Sequence
  Synthetic
gcgggcgggcgaaggaaggg

SEQ ID NO: 54943 - RNA, 20 nt, Artificial Sequence
  Synthetic
ggugggacgcgggcagaggg

SEQ ID NO: 54944 - RNA, 20 nt, Artificial Sequence
  Synthetic
gcugaggcggcgggagaggg

SEQ ID NO: 54945 - RNA, 20 nt, Artificial Sequence
  Synthetic
aacgauggggggaacacggg

SEQ ID NO: 54946 - RNA, 20 nt, Artificial Sequence
  Synthetic
gcggggagugggcggccggg

SEQ ID NO: 54947 - RNA, 20 nt, Artificial Sequence
  Synthetic
cgggggacccaggcuccggg

SEQ ID NO: 54948 - RNA, 20 nt, Artificial Sequence
  Synthetic
gauacggguuggcucgcggg

SEQ ID NO: 54949 - RNA, 20 nt, Artificial Sequence
  Synthetic
gggguccggggcgaggcggg

SEQ ID NO: 54950 - RNA, 20 nt, Artificial Sequence
  Synthetic
cagagggcggcggcggcggg

SEQ ID NO: 54951 - RNA, 20 nt, Artificial Sequence
  Synthetic
cuccuucgucgggcggcggg

SEQ ID NO: 54952 - RNA, 20 nt, Artificial Sequence
  Synthetic
ggagagggggggggggcggg

SEQ ID NO: 54953 - RNA, 20 nt, Artificial Sequence
  Synthetic
gggguaggugggugggcggg

SEQ ID NO: 54954 - RNA, 20 nt, Artificial Sequence
  Synthetic
cuugggucuccuucgucggg

SEQ ID NO: 54955 - RNA, 20 nt, Artificial Sequence
  Synthetic
cgggcgggcgaaggaagggg

SEQ ID NO: 54956 - RNA, 20 nt, Artificial Sequence
  Synthetic
cugaggcggcgggagagggg

SEQ ID NO: 54957 - RNA, 20 nt, Artificial Sequence
  Synthetic
acgauggggggaacacgggg

SEQ ID NO: 54958 - RNA, 20 nt, Artificial Sequence
  Synthetic
gggggacccaggcuccgggg

SEQ ID NO: 54959 - RNA, 20 nt, Artificial Sequence
  Synthetic
agagggcggcggcggcgggg

SEQ ID NO: 54960 - RNA, 20 nt, Artificial Sequence
  Synthetic
uccuucgucgggcggcgggg

SEQ ID NO: 54961 - RNA, 20 nt, Artificial Sequence
  Synthetic
gggcgcggcggcggucgggg

SEQ ID NO: 54962 - RNA, 20 nt, Artificial Sequence
  Synthetic
ucguguuucuugaaaggggg

SEQ ID NO: 54963 - RNA, 20 nt, Artificial Sequence
  Synthetic
ugaggcggcgggagaggggg

SEQ ID NO: 54964 - RNA, 20 nt, Artificial Sequence
  Synthetic
ggggacccaggcuccggggg

SEQ ID NO: 54965 - RNA, 20 nt, Artificial Sequence
  Synthetic
gagggcggcggcggcggggg

SEQ ID NO: 54966 - RNA, 20 nt, Artificial Sequence
  Synthetic
ccuucgucgggcggcggggg

SEQ ID NO: 54967 - RNA, 20 nt, Artificial Sequence
  Synthetic
gaggcggcgggagagggggg

SEQ ID NO: 54968 - RNA, 20 nt, Artificial Sequence
  Synthetic
gggacccaggcuccgggggg

SEQ ID NO: 54969 - RNA, 20 nt, Artificial Sequence
  Synthetic
agggcggcggcggcgggggg

SEQ ID NO: 54970 - RNA, 20 nt, Artificial Sequence
  Synthetic
cuucgucgggcggcgggggg

SEQ ID NO: 54971 - RNA, 20 nt, Artificial Sequence
  Synthetic
gcgggcgaaggaaggggggg

SEQ ID NO: 54972 - RNA, 20 nt, Artificial Sequence
  Synthetic
aggcggcgggagaggggggg

SEQ ID NO: 54973 - RNA, 20 nt, Artificial Sequence
  Synthetic
auggggggaacacggggggg

SEQ ID NO: 54974 - RNA, 20 nt, Artificial Sequence
  Synthetic
ggacccaggcuccggggggg

SEQ ID NO: 54975 - RNA, 20 nt, Artificial Sequence
  Synthetic
gggcggcggcggcggggggg

SEQ ID NO: 54976 - RNA, 20 nt, Artificial Sequence
  Synthetic
uucgucgggcggcggggggg

SEQ ID NO: 54977 - RNA, 20 nt, Artificial Sequence
  Synthetic
ggcggcgggagagggggggg

SEQ ID NO: 54978 - RNA, 20 nt, Artificial Sequence
  Synthetic
gacccaggcuccgggggggg

SEQ ID NO: 54979 - RNA, 20 nt, Artificial Sequence
  Synthetic
ggcggcggcggcgggggggg

SEQ ID NO: 54980 - RNA, 20 nt, Artificial Sequence
  Synthetic
acccaggcuccggggggggg

SEQ ID NO: 54981 - RNA, 20 nt, Artificial Sequence
  Synthetic
gcggcggcggcggggggggg

SEQ ID NO: 54982 - RNA, 20 nt, Artificial Sequence
  Synthetic
cggcggcggcgggggggggg

SEQ ID NO: 54983 - RNA, 20 nt, Artificial Sequence
  Synthetic
ggcgggagaggggggggggg

SEQ ID NO: 54984 - RNA, 20 nt, Artificial Sequence
  Synthetic
ggugggcggguggugggggg

SEQ ID NO: 54985 - RNA, 20 nt, Artificial Sequence
  Synthetic
cgccuuggcuguuugggggg

SEQ ID NO: 54986 - RNA, 20 nt, Artificial Sequence
  Synthetic
gggugggcgggugguggggg

SEQ ID NO: 54987 - RNA, 20 nt, Artificial Sequence
  Synthetic
ugggugggcggguggugggg

SEQ ID NO: 54988 - RNA, 20 nt, Artificial Sequence
  Synthetic
gcgugguggugaacgauggg

SEQ ID NO: 54989 - RNA, 20 nt, Artificial Sequence
  Synthetic
gaggccgagcggggaguggg

SEQ ID NO: 54990 - RNA, 20 nt, Artificial Sequence
  Synthetic
gcgggcgcgggguagguggg

SEQ ID NO: 54991 - RNA, 20 nt, Artificial Sequence
  Synthetic
aacagccaaggcgcgguggg

SEQ ID NO: 54992 - RNA, 20 nt, Artificial Sequence
  Synthetic
gcggcggcggucgggguggg

SEQ ID NO: 54993 - RNA, 20 nt, Artificial Sequence
  Synthetic
gcgcgggguagguggguggg

SEQ ID NO: 54994 - RNA, 20 nt, Artificial Sequence
  Synthetic
gugggugggcgggugguggg

SEQ ID NO: 54995 - RNA, 20 nt, Artificial Sequence
  Synthetic
ccgcgccuuggcuguuuggg

SEQ ID NO: 54996 - RNA, 20 nt, Artificial Sequence
  Synthetic
ggcgugguggugaacgaugg

SEQ ID NO: 54997 - RNA, 20 nt, Artificial Sequence
  Synthetic
ggcggucggggugggagugg

SEQ ID NO: 54998 - RNA, 20 nt, Artificial Sequence
  Synthetic
aggcgcgguggggggcgugg

SEQ ID NO: 54999 - RNA, 20 nt, Artificial Sequence
  Synthetic
aaacagccaaggcgcggugg

SEQ ID NO: 55000 - RNA, 20 nt, Artificial Sequence
  Synthetic
guaggugggugggcgggugg

SEQ ID NO: 55001 - RNA, 20 nt, Artificial Sequence
  Synthetic
cgcggcggcggucggggugg

SEQ ID NO: 55002 - RNA, 20 nt, Artificial Sequence
  Synthetic
ggcgaaggaagggggggugg

SEQ ID NO: 55003 - RNA, 20 nt, Artificial Sequence
  Synthetic
cuuggcuguuuggggggugg

SEQ ID NO: 55004 - RNA, 20 nt, Artificial Sequence
  Synthetic
ggucggggugggaguggugg

SEQ ID NO: 55005 - RNA, 20 nt, Artificial Sequence
  Synthetic
ggugggugggcggguggugg

SEQ ID NO: 55006 - RNA, 20 nt, Artificial Sequence
  Synthetic
gaaggaaggggggguggugg

SEQ ID NO: 55007 - RNA, 20 nt, Artificial Sequence
  Synthetic
cggggugggagugguggugg

SEQ ID NO: 55008 - RNA, 20 nt, Artificial Sequence
  Synthetic
gagaagagagcagggguugg

SEQ ID NO: 55009 - RNA, 20 nt, Artificial Sequence
  Synthetic
accgcgccuuggcuguuugg

SEQ ID NO: 55010 - RNA, 20 nt, Artificial Sequence
  Synthetic
ggauggaagggcagaagaug

SEQ ID NO: 55011 - RNA, 20 nt, Artificial Sequence
  Synthetic
gggcgugguggugaacgaug

SEQ ID NO: 55012 - RNA, 20 nt, Artificial Sequence
  Synthetic
cggcgugcugccggaggcug

SEQ ID NO: 55013 - RNA, 20 nt, Artificial Sequence
  Synthetic
ccgcucggccucuccggcug

SEQ ID NO: 55014 - RNA, 20 nt, Artificial Sequence
  Synthetic
guacaggugagcuucugcug

SEQ ID NO: 55015 - RNA, 20 nt, Artificial Sequence
  Synthetic
ucgccgcgaucccgccggug

SEQ ID NO: 55016 - RNA, 20 nt, Artificial Sequence
  Synthetic
caaacagccaaggcgcggug

SEQ ID NO: 55017 - RNA, 20 nt, Artificial Sequence
  Synthetic
ggguuggcucgcgggcggug

SEQ ID NO: 55018 - RNA, 20 nt, Artificial Sequence
  Synthetic
gcgcggcggcggucggggug

SEQ ID NO: 55019 - RNA, 20 nt, Artificial Sequence
  Synthetic
aggugggugggcggguggug

SEQ ID NO: 55020 - RNA, 20 nt, Artificial Sequence
  Synthetic
ucggggugggagugguggug

SEQ ID NO: 55021 - RNA, 20 nt, Artificial Sequence
  Synthetic
gggggggggggggaaaugug

SEQ ID NO: 55022 - RNA, 20 nt, Artificial Sequence
  Synthetic
agagaagagagcagggguug

SEQ ID NO: 55023 - RNA, 20 nt, Artificial Sequence
  Synthetic
caccgcgccuuggcuguuug

SEQ ID NO: 55024 - RNA, 20 nt, Artificial Sequence
  Synthetic
aggauggaagggcagaagau

SEQ ID NO: 55025 - RNA, 20 nt, Artificial Sequence
  Synthetic
ggggcgugguggugaacgau

SEQ ID NO: 55026 - RNA, 20 nt, Artificial Sequence
  Synthetic
aggggaugcaggaggaggau

SEQ ID NO: 55027 - RNA, 20 nt, Artificial Sequence
  Synthetic
gccccccccccccggagccu

SEQ ID NO: 55028 - RNA, 20 nt, Artificial Sequence
  Synthetic
ccacgccccccaccgcgccu

SEQ ID NO: 55029 - RNA, 20 nt, Artificial Sequence
  Synthetic
ccggccgcccacuccccgcu

SEQ ID NO: 55030 - RNA, 20 nt, Artificial Sequence
  Synthetic
gccucuccggcugcggugcu

SEQ ID NO: 55031 - RNA, 20 nt, Artificial Sequence
  Synthetic
gcucacgcggcgcggcgucu

SEQ ID NO: 55032 - RNA, 20 nt, Artificial Sequence
  Synthetic
cugaccugccugcccuuucu

SEQ ID NO: 55033 - RNA, 20 nt, Artificial Sequence
  Synthetic
aacccguauccuuuuuuucu

SEQ ID NO: 55034 - RNA, 20 nt, Artificial Sequence
  Synthetic
ggagaggccgagcggggagu

SEQ ID NO: 55035 - RNA, 20 nt, Artificial Sequence
  Synthetic
gggcggcggggggggggcgu

SEQ ID NO: 55036 - RNA, 20 nt, Artificial Sequence
  Synthetic
ggguggggggagagugucgu

SEQ ID NO: 55037 - RNA, 20 nt, Artificial Sequence
  Synthetic
ggugcuugggucuccuucgu

SEQ ID NO: 55038 - RNA, 20 nt, Artificial Sequence
  Synthetic
cgccgcgcguucucgcaggu

SEQ ID NO: 55039 - RNA, 20 nt, Artificial Sequence
  Synthetic
gcugcgggcgcgggguaggu

SEQ ID NO: 55040 - RNA, 20 nt, Artificial Sequence
  Synthetic
cucgccgcgaucccgccggu

SEQ ID NO: 55041 - RNA, 20 nt, Artificial Sequence
  Synthetic
ccaaacagccaaggcgcggu

SEQ ID NO: 55042 - RNA, 20 nt, Artificial Sequence
  Synthetic
cgguggggcgcggcggcggu

SEQ ID NO: 55043 - RNA, 20 nt, Artificial Sequence
  Synthetic
acgcggcgcggcgucucggu

SEQ ID NO: 55044 - RNA, 20 nt, Artificial Sequence
  Synthetic
uagaaaaaaaggauacgggu

SEQ ID NO: 55045 - RNA, 20 nt, Artificial Sequence
  Synthetic
agagagaagagagcaggggu

SEQ ID NO: 55046 - RNA, 20 nt, Artificial Sequence
  Synthetic
ggaggcugcgggcgcggggu

SEQ ID NO: 55047 - RNA, 20 nt, Artificial Sequence
  Synthetic
ggcgcggcggcggucggggu

SEQ ID NO: 55048 - RNA, 20 nt, Artificial Sequence
  Synthetic
cgggcgcgggguaggugggu

SEQ ID NO: 55049 - RNA, 20 nt, Artificial Sequence
  Synthetic
ugggggguggcggcgguggu

SEQ ID NO: 55050 - RNA, 20 nt, Artificial Sequence
  Synthetic
uaggugggugggcggguggu

SEQ ID NO: 55051 - RNA, 20 nt, Artificial Sequence
  Synthetic
gucggggugggagugguggu

SEQ ID NO: 55052 - RNA, 20 nt, Artificial Sequence
  Synthetic
ccucuccggcugcggugcuu

SEQ ID NO: 55053 - RNA, 20 nt, Artificial Sequence
  Synthetic
gagagaagagagcagggguu

SEQ ID NO: 55054 - RNA, 20 nt, Artificial Sequence
  Synthetic
cccaccgcgccuuggcuguu

SEQ ID NO: 55055 - RNA, 20 nt, Artificial Sequence
  Synthetic
gcguucucgcagguagguuu

SEQ ID NO: 55056 - RNA, 20 nt, Artificial Sequence
  Synthetic
ccaccgcgccuuggcuguuu

SEQ ID NO: 55057 - RNA, 18 nt, Artificial Sequence
  Synthetic
gggcucuccggcggcuua

SEQ ID NO: 55058 - RNA, 22 nt, Artificial Sequence
  Synthetic
gcucgggcucuccggcggcuua

SEQ ID NO: 55059 - RNA, 23 nt, Artificial Sequence
  Synthetic
ggcucgggcucuccggcggcuua

SEQ ID NO: 55060 - RNA, 24 nt, Artificial Sequence
  Synthetic
gggcucgggcucuccggcggcuua

SEQ ID NO: 55061 - RNA, 22 nt, Artificial Sequence
  Synthetic
gcggccacguaaacaaugacac

SEQ ID NO: 55062 - RNA, 22 nt, Artificial Sequence
  Synthetic
gcggccaagccccggcccgccc

SEQ ID NO: 55063 - RNA, 23 nt, Artificial Sequence
  Synthetic
ggcggccaagccccggcccgccc

SEQ ID NO: 55064 - RNA, 21 nt, Artificial Sequence
  Synthetic
ggcuacccgggacccccggcc

SEQ ID NO: 55065 - RNA, 23 nt, Artificial Sequence
  Synthetic
gcggcuacccgggacccccggcc

SEQ ID NO: 55066 - RNA, 24 nt, Artificial Sequence
  Synthetic
ggcggcuacccgggacccccggcc

SEQ ID NO: 55067 - RNA, 22 nt, Artificial Sequence
  Synthetic
gcgcggagcagccuuccuucuc

SEQ ID NO: 55068 - RNA, 24 nt, Artificial Sequence
  Synthetic
gugcgcggagcagccuuccuucuc

SEQ ID NO: 55069 - RNA, 21 nt, Artificial Sequence
  Synthetic
ggaagggcguggggccggccg

SEQ ID NO: 55070 - RNA, 19 nt, Artificial Sequence
  Synthetic
gcgcgcccccccccaacgu

SEQ ID NO: 55071 - RNA, 20 nt, Artificial Sequence
  Synthetic
ggcgcgcccccccccaacgu

SEQ ID NO: 55072 - RNA, 23 nt, Artificial Sequence
  Synthetic
gcuggcgcgcccccccccaacgu

SEQ ID NO: 55073 - RNA, 20 nt, Artificial Sequence
  Synthetic
gcuuuuuucgauucccggcc

SEQ ID NO: 55074 - RNA, 21 nt, Artificial Sequence
  Synthetic
ggcuuuuuucgauucccggcc

SEQ ID NO: 55075 - RNA, 23 nt, Artificial Sequence
  Synthetic
gaggcuuuuuucgauucccggcc

SEQ ID NO: 55076 - RNA, 24 nt, Artificial Sequence
  Synthetic
ggaggcuuuuuucgauucccggcc

SEQ ID NO: 55077 - RNA, 18 nt, Artificial Sequence
  Synthetic
gucuucuuccgcgccucc

SEQ ID NO: 55078 - RNA, 18 nt, Artificial Sequence
  Synthetic
gauucccggccggggguc

SEQ ID NO: 55079 - RNA, 21 nt, Artificial Sequence
  Synthetic
ggggggacggggcgagccggg

SEQ ID NO: 55080 - RNA, 23 nt, Artificial Sequence
  Synthetic
gaggggggacggggcgagccggg

SEQ ID NO: 55081 - RNA, 19 nt, Artificial Sequence
  Synthetic
cgggcucuccggcggcuua

SEQ ID NO: 55082 - RNA, 20 nt, Artificial Sequence
  Synthetic
ucgggcucuccggcggcuua

SEQ ID NO: 55083 - RNA, 21 nt, Artificial Sequence
  Synthetic
cucgggcucuccggcggcuua

SEQ ID NO: 55084 - RNA, 21 nt, Artificial Sequence
  Synthetic
cggccacguaaacaaugacac

SEQ ID NO: 55085 - RNA, 23 nt, Artificial Sequence
  Synthetic
cgcggccacguaaacaaugacac

SEQ ID NO: 55086 - RNA, 24 nt, Artificial Sequence
  Synthetic
ccgcggccacguaaacaaugacac

SEQ ID NO: 55087 - RNA, 21 nt, Artificial Sequence
  Synthetic
cggccaagccccggcccgccc

SEQ ID NO: 55088 - RNA, 24 nt, Artificial Sequence
  Synthetic
cggcggccaagccccggcccgccc

SEQ ID NO: 55089 - RNA, 22 nt, Artificial Sequence
  Synthetic
cggcuacccgggacccccggcc

SEQ ID NO: 55090 - RNA, 21 nt, Artificial Sequence
  Synthetic
cgcggagcagccuuccuucuc

SEQ ID NO: 55091 - RNA, 23 nt, Artificial Sequence
  Synthetic
ugcgcggagcagccuuccuucuc

SEQ ID NO: 55092 - RNA, 22 nt, Artificial Sequence
  Synthetic
uggaagggcguggggccggccg

SEQ ID NO: 55093 - RNA, 23 nt, Artificial Sequence
  Synthetic
auggaagggcguggggccggccg

SEQ ID NO: 55094 - RNA, 24 nt, Artificial Sequence
  Synthetic
aauggaagggcguggggccggccg

SEQ ID NO: 55095 - RNA, 18 nt, Artificial Sequence
  Synthetic
cgcgcccccccccaacgu

SEQ ID NO: 55096 - RNA, 21 nt, Artificial Sequence
  Synthetic
uggcgcgcccccccccaacgu

SEQ ID NO: 55097 - RNA, 22 nt, Artificial Sequence
  Synthetic
cuggcgcgcccccccccaacgu

SEQ ID NO: 55098 - RNA, 24 nt, Artificial Sequence
  Synthetic
agcuggcgcgcccccccccaacgu

SEQ ID NO: 55099 - RNA, 18 nt, Artificial Sequence
  Synthetic
uuuuuucgauucccggcc

SEQ ID NO: 55100 - RNA, 19 nt, Artificial Sequence
  Synthetic
cuuuuuucgauucccggcc

SEQ ID NO: 55101 - RNA, 22 nt, Artificial Sequence
  Synthetic
aggcuuuuuucgauucccggcc

SEQ ID NO: 55102 - RNA, 19 nt, Artificial Sequence
  Synthetic
cgucuucuuccgcgccucc

SEQ ID NO: 55103 - RNA, 20 nt, Artificial Sequence
  Synthetic
ccgucuucuuccgcgccucc

SEQ ID NO: 55104 - RNA, 21 nt, Artificial Sequence
  Synthetic
cccgucuucuuccgcgccucc

SEQ ID NO: 55105 - RNA, 22 nt, Artificial Sequence
  Synthetic
ucccgucuucuuccgcgccucc

SEQ ID NO: 55106 - RNA, 23 nt, Artificial Sequence
  Synthetic
cucccgucuucuuccgcgccucc

SEQ ID NO: 55107 - RNA, 24 nt, Artificial Sequence
  Synthetic
ccucccgucuucuuccgcgccucc

SEQ ID NO: 55108 - RNA, 19 nt, Artificial Sequence
  Synthetic
cgauucccggccggggguc

SEQ ID NO: 55109 - RNA, 20 nt, Artificial Sequence
  Synthetic
ucgauucccggccggggguc

SEQ ID NO: 55110 - RNA, 21 nt, Artificial Sequence
  Synthetic
uucgauucccggccggggguc

SEQ ID NO: 55111 - RNA, 22 nt, Artificial Sequence
  Synthetic
uuucgauucccggccggggguc

SEQ ID NO: 55112 - RNA, 23 nt, Artificial Sequence
  Synthetic
uuuucgauucccggccggggguc

SEQ ID NO: 55113 - RNA, 24 nt, Artificial Sequence
  Synthetic
uuuuucgauucccggccggggguc

SEQ ID NO: 55114 - RNA, 21 nt, Artificial Sequence
  Synthetic
cguugggggggggcgcgccag

SEQ ID NO: 55115 - RNA, 22 nt, Artificial Sequence
  Synthetic
acguugggggggggcgcgccag

SEQ ID NO: 55116 - RNA, 23 nt, Artificial Sequence
  Synthetic
cacguugggggggggcgcgccag

SEQ ID NO: 55117 - RNA, 24 nt, Artificial Sequence
  Synthetic
ccacguugggggggggcgcgccag

SEQ ID NO: 55118 - RNA, 22 nt, Artificial Sequence
  Synthetic
aggggggacggggcgagccggg

SEQ ID NO: 55119 - RNA, 24 nt, Artificial Sequence
  Synthetic
agaggggggacggggcgagccggg

SEQ ID NO: 55120 - RNA, 18 nt, Artificial Sequence
  Synthetic
ccacguaaacaaugacac

SEQ ID NO: 55121 - RNA, 19 nt, Artificial Sequence
  Synthetic
gccacguaaacaaugacac

SEQ ID NO: 55122 - RNA, 20 nt, Artificial Sequence
  Synthetic
ggccacguaaacaaugacac

SEQ ID NO: 55123 - RNA, 18 nt, Artificial Sequence
  Synthetic
ccaagccccggcccgccc

SEQ ID NO: 55124 - RNA, 19 nt, Artificial Sequence
  Synthetic
gccaagccccggcccgccc

SEQ ID NO: 55125 - RNA, 20 nt, Artificial Sequence
  Synthetic
ggccaagccccggcccgccc

SEQ ID NO: 55126 - RNA, 18 nt, Artificial Sequence
  Synthetic
uacccgggacccccggcc

SEQ ID NO: 55127 - RNA, 19 nt, Artificial Sequence
  Synthetic
cuacccgggacccccggcc

SEQ ID NO: 55128 - RNA, 20 nt, Artificial Sequence
  Synthetic
gcuacccgggacccccggcc

SEQ ID NO: 55129 - RNA, 18 nt, Artificial Sequence
  Synthetic
ggagcagccuuccuucuc

SEQ ID NO: 55130 - RNA, 19 nt, Artificial Sequence
  Synthetic
cggagcagccuuccuucuc

SEQ ID NO: 55131 - RNA, 20 nt, Artificial Sequence
  Synthetic
gcggagcagccuuccuucuc

SEQ ID NO: 55132 - RNA, 18 nt, Artificial Sequence
  Synthetic
agggcguggggccggccg

SEQ ID NO: 55133 - RNA, 19 nt, Artificial Sequence
  Synthetic
aagggcguggggccggccg

SEQ ID NO: 55134 - RNA, 20 nt, Artificial Sequence
  Synthetic
gaagggcguggggccggccg

SEQ ID NO: 55135 - RNA, 18 nt, Artificial Sequence
  Synthetic
ugggggggggcgcgccag

SEQ ID NO: 55136 - RNA, 19 nt, Artificial Sequence
  Synthetic
uugggggggggcgcgccag

SEQ ID NO: 55137 - RNA, 20 nt, Artificial Sequence
  Synthetic
guugggggggggcgcgccag

SEQ ID NO: 55138 - RNA, 18 nt, Artificial Sequence
  Synthetic
gggacggggcgagccggg

SEQ ID NO: 55139 - RNA, 19 nt, Artificial Sequence
  Synthetic
ggggacggggcgagccggg

SEQ ID NO: 55140 - RNA, 20 nt, Artificial Sequence
  Synthetic
gggggacggggcgagccggg

SEQ ID NO: 55141 - RNA, 18 nt, Artificial Sequence
  Synthetic
gggaggcgggggaaaaaa

SEQ ID NO: 55142 - RNA, 19 nt, Artificial Sequence
  Synthetic
cgggaggcgggggaaaaaa

SEQ ID NO: 55143 - RNA, 20 nt, Artificial Sequence
  Synthetic
acgggaggcgggggaaaaaa

SEQ ID NO: 55144 - RNA, 21 nt, Artificial Sequence
  Synthetic
gacgggaggcgggggaaaaaa

SEQ ID NO: 55145 - RNA, 22 nt, Artificial Sequence
  Synthetic
agacgggaggcgggggaaaaaa

SEQ ID NO: 55146 - RNA, 23 nt, Artificial Sequence
  Synthetic
aagacgggaggcgggggaaaaaa

SEQ ID NO: 55147 - RNA, 24 nt, Artificial Sequence
  Synthetic
gaagacgggaggcgggggaaaaaa

SEQ ID NO: 55148 - RNA, 18 nt, Artificial Sequence
  Synthetic
cgggaggcgggggaaaaa

SEQ ID NO: 55149 - RNA, 19 nt, Artificial Sequence
  Synthetic
acgggaggcgggggaaaaa

SEQ ID NO: 55150 - RNA, 20 nt, Artificial Sequence
  Synthetic
gacgggaggcgggggaaaaa

SEQ ID NO: 55151 - RNA, 21 nt, Artificial Sequence
  Synthetic
agacgggaggcgggggaaaaa

SEQ ID NO: 55152 - RNA, 22 nt, Artificial Sequence
  Synthetic
aagacgggaggcgggggaaaaa

SEQ ID NO: 55153 - RNA, 23 nt, Artificial Sequence
  Synthetic
gaagacgggaggcgggggaaaaa

SEQ ID NO: 55154 - RNA, 24 nt, Artificial Sequence
  Synthetic
agaagacgggaggcgggggaaaaa

SEQ ID NO: 55155 - RNA, 18 nt, Artificial Sequence
  Synthetic
acgggaggcgggggaaaa

SEQ ID NO: 55156 - RNA, 19 nt, Artificial Sequence
  Synthetic
gacgggaggcgggggaaaa

SEQ ID NO: 55157 - RNA, 20 nt, Artificial Sequence
  Synthetic
agacgggaggcgggggaaaa

SEQ ID NO: 55158 - RNA, 21 nt, Artificial Sequence
  Synthetic
aagacgggaggcgggggaaaa

SEQ ID NO: 55159 - RNA, 22 nt, Artificial Sequence
  Synthetic
gaagacgggaggcgggggaaaa

SEQ ID NO: 55160 - RNA, 23 nt, Artificial Sequence
  Synthetic
agaagacgggaggcgggggaaaa

SEQ ID NO: 55161 - RNA, 24 nt, Artificial Sequence
  Synthetic
aagaagacgggaggcgggggaaaa

SEQ ID NO: 55162 - RNA, 18 nt, Artificial Sequence
  Synthetic
gccgggagggagaagaaa

SEQ ID NO: 55163 - RNA, 19 nt, Artificial Sequence
  Synthetic
ggccgggagggagaagaaa

SEQ ID NO: 55164 - RNA, 20 nt, Artificial Sequence
  Synthetic
cggccgggagggagaagaaa

SEQ ID NO: 55165 - RNA, 21 nt, Artificial Sequence
  Synthetic
gcggccgggagggagaagaaa

SEQ ID NO: 55166 - RNA, 22 nt, Artificial Sequence
  Synthetic
ggcggccgggagggagaagaaa

SEQ ID NO: 55167 - RNA, 23 nt, Artificial Sequence
  Synthetic
gggcggccgggagggagaagaaa

SEQ ID NO: 55168 - RNA, 24 nt, Artificial Sequence
  Synthetic
ggggcggccgggagggagaagaaa

SEQ ID NO: 55169 - RNA, 18 nt, Artificial Sequence
  Synthetic
ggccgggagggagaagaa

SEQ ID NO: 55170 - RNA, 19 nt, Artificial Sequence
  Synthetic
cggccgggagggagaagaa

SEQ ID NO: 55171 - RNA, 20 nt, Artificial Sequence
  Synthetic
gcggccgggagggagaagaa

SEQ ID NO: 55172 - RNA, 21 nt, Artificial Sequence
  Synthetic
ggcggccgggagggagaagaa

SEQ ID NO: 55173 - RNA, 22 nt, Artificial Sequence
  Synthetic
gggcggccgggagggagaagaa

SEQ ID NO: 55174 - RNA, 23 nt, Artificial Sequence
  Synthetic
ggggcggccgggagggagaagaa

SEQ ID NO: 55175 - RNA, 24 nt, Artificial Sequence
  Synthetic
cggggcggccgggagggagaagaa

SEQ ID NO: 55176 - RNA, 18 nt, Artificial Sequence
  Synthetic
gggacccccggccgggaa

SEQ ID NO: 55177 - RNA, 19 nt, Artificial Sequence
  Synthetic
cgggacccccggccgggaa

SEQ ID NO: 55178 - RNA, 20 nt, Artificial Sequence
  Synthetic
ccgggacccccggccgggaa

SEQ ID NO: 55179 - RNA, 21 nt, Artificial Sequence
  Synthetic
cccgggacccccggccgggaa

SEQ ID NO: 55180 - RNA, 22 nt, Artificial Sequence
  Synthetic
acccgggacccccggccgggaa

SEQ ID NO: 55181 - RNA, 23 nt, Artificial Sequence
  Synthetic
uacccgggacccccggccgggaa

SEQ ID NO: 55182 - RNA, 24 nt, Artificial Sequence
  Synthetic
cuacccgggacccccggccgggaa

SEQ ID NO: 55183 - RNA, 18 nt, Artificial Sequence
  Synthetic
gggggaaaaaagggggaa

SEQ ID NO: 55184 - RNA, 19 nt, Artificial Sequence
  Synthetic
cgggggaaaaaagggggaa

SEQ ID NO: 55185 - RNA, 20 nt, Artificial Sequence
  Synthetic
gcgggggaaaaaagggggaa

SEQ ID NO: 55186 - RNA, 21 nt, Artificial Sequence
  Synthetic
ggcgggggaaaaaagggggaa

SEQ ID NO: 55187 - RNA, 22 nt, Artificial Sequence
  Synthetic
aggcgggggaaaaaagggggaa

SEQ ID NO: 55188 - RNA, 23 nt, Artificial Sequence
  Synthetic
gaggcgggggaaaaaagggggaa

SEQ ID NO: 55189 - RNA, 24 nt, Artificial Sequence
  Synthetic
ggaggcgggggaaaaaagggggaa

SEQ ID NO: 55190 - RNA, 18 nt, Artificial Sequence
  Synthetic
caacgugggaguguuuaa

SEQ ID NO: 55191 - RNA, 19 nt, Artificial Sequence
  Synthetic
ccaacgugggaguguuuaa

SEQ ID NO: 55192 - RNA, 20 nt, Artificial Sequence
  Synthetic
cccaacgugggaguguuuaa

SEQ ID NO: 55193 - RNA, 21 nt, Artificial Sequence
  Synthetic
ccccaacgugggaguguuuaa

SEQ ID NO: 55194 - RNA, 22 nt, Artificial Sequence
  Synthetic
cccccaacgugggaguguuuaa

SEQ ID NO: 55195 - RNA, 23 nt, Artificial Sequence
  Synthetic
ccccccaacgugggaguguuuaa

SEQ ID NO: 55196 - RNA, 24 nt, Artificial Sequence
  Synthetic
cccccccaacgugggaguguuuaa

SEQ ID NO: 55197 - RNA, 18 nt, Artificial Sequence
  Synthetic
gccacguaaacaaugaca

SEQ ID NO: 55198 - RNA, 19 nt, Artificial Sequence
  Synthetic
ggccacguaaacaaugaca

SEQ ID NO: 55199 - RNA, 20 nt, Artificial Sequence
  Synthetic
cggccacguaaacaaugaca

SEQ ID NO: 55200 - RNA, 21 nt, Artificial Sequence
  Synthetic
gcggccacguaaacaaugaca

SEQ ID NO: 55201 - RNA, 22 nt, Artificial Sequence
  Synthetic
cgcggccacguaaacaaugaca

SEQ ID NO: 55202 - RNA, 23 nt, Artificial Sequence
  Synthetic
ccgcggccacguaaacaaugaca

SEQ ID NO: 55203 - RNA, 24 nt, Artificial Sequence
  Synthetic
cccgcggccacguaaacaaugaca

SEQ ID NO: 55204 - RNA, 18 nt, Artificial Sequence
  Synthetic
cggaggcgcggaagaaga

SEQ ID NO: 55205 - RNA, 19 nt, Artificial Sequence
  Synthetic
ucggaggcgcggaagaaga

SEQ ID NO: 55206 - RNA, 20 nt, Artificial Sequence
  Synthetic
cucggaggcgcggaagaaga

SEQ ID NO: 55207 - RNA, 21 nt, Artificial Sequence
  Synthetic
ccucggaggcgcggaagaaga

SEQ ID NO: 55208 - RNA, 22 nt, Artificial Sequence
  Synthetic
cccucggaggcgcggaagaaga

SEQ ID NO: 55209 - RNA, 23 nt, Artificial Sequence
  Synthetic
acccucggaggcgcggaagaaga

SEQ ID NO: 55210 - RNA, 24 nt, Artificial Sequence
  Synthetic
gacccucggaggcgcggaagaaga

SEQ ID NO: 55211 - RNA, 18 nt, Artificial Sequence
  Synthetic
gggaaaaaagggggaaga

SEQ ID NO: 55212 - RNA, 19 nt, Artificial Sequence
  Synthetic
ggggaaaaaagggggaaga

SEQ ID NO: 55213 - RNA, 20 nt, Artificial Sequence
  Synthetic
gggggaaaaaagggggaaga

SEQ ID NO: 55214 - RNA, 21 nt, Artificial Sequence
  Synthetic
cgggggaaaaaagggggaaga

SEQ ID NO: 55215 - RNA, 22 nt, Artificial Sequence
  Synthetic
gcgggggaaaaaagggggaaga

SEQ ID NO: 55216 - RNA, 23 nt, Artificial Sequence
  Synthetic
ggcgggggaaaaaagggggaaga

SEQ ID NO: 55217 - RNA, 24 nt, Artificial Sequence
  Synthetic
aggcgggggaaaaaagggggaaga

SEQ ID NO: 55218 - RNA, 18 nt, Artificial Sequence
  Synthetic
gaaaaaagggggaagaga

SEQ ID NO: 55219 - RNA, 19 nt, Artificial Sequence
  Synthetic
ggaaaaaagggggaagaga

SEQ ID NO: 55220 - RNA, 20 nt, Artificial Sequence
  Synthetic
gggaaaaaagggggaagaga

SEQ ID NO: 55221 - RNA, 21 nt, Artificial Sequence
  Synthetic
ggggaaaaaagggggaagaga

SEQ ID NO: 55222 - RNA, 22 nt, Artificial Sequence
  Synthetic
gggggaaaaaagggggaagaga

SEQ ID NO: 55223 - RNA, 23 nt, Artificial Sequence
  Synthetic
cgggggaaaaaagggggaagaga

SEQ ID NO: 55224 - RNA, 24 nt, Artificial Sequence
  Synthetic
gcgggggaaaaaagggggaagaga

SEQ ID NO: 55225 - RNA, 18 nt, Artificial Sequence
  Synthetic
cgaacgcgcggcgccgga

SEQ ID NO: 55226 - RNA, 19 nt, Artificial Sequence
  Synthetic
gcgaacgcgcggcgccgga

SEQ ID NO: 55227 - RNA, 20 nt, Artificial Sequence
  Synthetic
cgcgaacgcgcggcgccgga

SEQ ID NO: 55228 - RNA, 21 nt, Artificial Sequence
  Synthetic
ucgcgaacgcgcggcgccgga

SEQ ID NO: 55229 - RNA, 22 nt, Artificial Sequence
  Synthetic
uucgcgaacgcgcggcgccgga

SEQ ID NO: 55230 - RNA, 23 nt, Artificial Sequence
  Synthetic
uuucgcgaacgcgcggcgccgga

SEQ ID NO: 55231 - RNA, 24 nt, Artificial Sequence
  Synthetic
cuuucgcgaacgcgcggcgccgga

SEQ ID NO: 55232 - RNA, 18 nt, Artificial Sequence
  Synthetic
gagagggggagguaggga

SEQ ID NO: 55233 - RNA, 19 nt, Artificial Sequence
  Synthetic
agagagggggagguaggga

SEQ ID NO: 55234 - RNA, 20 nt, Artificial Sequence
  Synthetic
aagagagggggagguaggga

SEQ ID NO: 55235 - RNA, 21 nt, Artificial Sequence
  Synthetic
gaagagagggggagguaggga

SEQ ID NO: 55236 - RNA, 22 nt, Artificial Sequence
  Synthetic
ggaagagagggggagguaggga

SEQ ID NO: 55237 - RNA, 23 nt, Artificial Sequence
  Synthetic
gggaagagagggggagguaggga

SEQ ID NO: 55238 - RNA, 24 nt, Artificial Sequence
  Synthetic
ggggaagagagggggagguaggga

SEQ ID NO: 55239 - RNA, 18 nt, Artificial Sequence
  Synthetic
ggagcggggcggccggga

SEQ ID NO: 55240 - RNA, 19 nt, Artificial Sequence
  Synthetic
gggagcggggcggccggga

SEQ ID NO: 55241 - RNA, 20 nt, Artificial Sequence
  Synthetic
cgggagcggggcggccggga

SEQ ID NO: 55242 - RNA, 21 nt, Artificial Sequence
  Synthetic
ccgggagcggggcggccggga

SEQ ID NO: 55243 - RNA, 22 nt, Artificial Sequence
  Synthetic
cccgggagcggggcggccggga

SEQ ID NO: 55244 - RNA, 23 nt, Artificial Sequence
  Synthetic
gcccgggagcggggcggccggga

SEQ ID NO: 55245 - RNA, 24 nt, Artificial Sequence
  Synthetic
ggcccgggagcggggcggccggga

SEQ ID NO: 55246 - RNA, 18 nt, Artificial Sequence
  Synthetic
ggggagguagggagggga

SEQ ID NO: 55247 - RNA, 19 nt, Artificial Sequence
  Synthetic
gggggagguagggagggga

SEQ ID NO: 55248 - RNA, 20 nt, Artificial Sequence
  Synthetic
agggggagguagggagggga

SEQ ID NO: 55249 - RNA, 21 nt, Artificial Sequence
  Synthetic
gagggggagguagggagggga

SEQ ID NO: 55250 - RNA, 22 nt, Artificial Sequence
  Synthetic
agagggggagguagggagggga

SEQ ID NO: 55251 - RNA, 23 nt, Artificial Sequence
  Synthetic
gagagggggagguagggagggga

SEQ ID NO: 55252 - RNA, 24 nt, Artificial Sequence
  Synthetic
agagagggggagguagggagggga

SEQ ID NO: 55253 - RNA, 18 nt, Artificial Sequence
  Synthetic
ggaagagagggggaggua

SEQ ID NO: 55254 - RNA, 19 nt, Artificial Sequence
  Synthetic
gggaagagagggggaggua

SEQ ID NO: 55255 - RNA, 20 nt, Artificial Sequence
  Synthetic
ggggaagagagggggaggua

SEQ ID NO: 55256 - RNA, 21 nt, Artificial Sequence
  Synthetic
gggggaagagagggggaggua

SEQ ID NO: 55257 - RNA, 22 nt, Artificial Sequence
  Synthetic
agggggaagagagggggaggua

SEQ ID NO: 55258 - RNA, 23 nt, Artificial Sequence
  Synthetic
aagggggaagagagggggaggua

SEQ ID NO: 55259 - RNA, 24 nt, Artificial Sequence
  Synthetic
aaagggggaagagagggggaggua

SEQ ID NO: 55260 - RNA, 18 nt, Artificial Sequence
  Synthetic
ccaacgugggaguguuua

SEQ ID NO: 55261 - RNA, 19 nt, Artificial Sequence
  Synthetic
cccaacgugggaguguuua

SEQ ID NO: 55262 - RNA, 20 nt, Artificial Sequence
  Synthetic
ccccaacgugggaguguuua

SEQ ID NO: 55263 - RNA, 21 nt, Artificial Sequence
  Synthetic
cccccaacgugggaguguuua

SEQ ID NO: 55264 - RNA, 22 nt, Artificial Sequence
  Synthetic
ccccccaacgugggaguguuua

SEQ ID NO: 55265 - RNA, 23 nt, Artificial Sequence
  Synthetic
cccccccaacgugggaguguuua

SEQ ID NO: 55266 - RNA, 24 nt, Artificial Sequence
  Synthetic
ccccccccaacgugggaguguuua

SEQ ID NO: 55267 - RNA, 18 nt, Artificial Sequence
  Synthetic
ggcgcgcccccccccaac

SEQ ID NO: 55268 - RNA, 19 nt, Artificial Sequence
  Synthetic
uggcgcgcccccccccaac

SEQ ID NO: 55269 - RNA, 20 nt, Artificial Sequence
  Synthetic
cuggcgcgcccccccccaac

SEQ ID NO: 55270 - RNA, 21 nt, Artificial Sequence
  Synthetic
gcuggcgcgcccccccccaac

SEQ ID NO: 55271 - RNA, 22 nt, Artificial Sequence
  Synthetic
agcuggcgcgcccccccccaac

SEQ ID NO: 55272 - RNA, 23 nt, Artificial Sequence
  Synthetic
cagcuggcgcgcccccccccaac

SEQ ID NO: 55273 - RNA, 24 nt, Artificial Sequence
  Synthetic
ucagcuggcgcgcccccccccaac

SEQ ID NO: 55274 - RNA, 18 nt, Artificial Sequence
  Synthetic
agggagaagaaacggaac

SEQ ID NO: 55275 - RNA, 19 nt, Artificial Sequence
  Synthetic
gagggagaagaaacggaac

SEQ ID NO: 55276 - RNA, 20 nt, Artificial Sequence
  Synthetic
ggagggagaagaaacggaac

SEQ ID NO: 55277 - RNA, 21 nt, Artificial Sequence
  Synthetic
gggagggagaagaaacggaac

SEQ ID NO: 55278 - RNA, 22 nt, Artificial Sequence
  Synthetic
cgggagggagaagaaacggaac

SEQ ID NO: 55279 - RNA, 23 nt, Artificial Sequence
  Synthetic
ccgggagggagaagaaacggaac

SEQ ID NO: 55280 - RNA, 24 nt, Artificial Sequence
  Synthetic
gccgggagggagaagaaacggaac

SEQ ID NO: 55281 - RNA, 18 nt, Artificial Sequence
  Synthetic
aaaugcccacagcaacac

SEQ ID NO: 55282 - RNA, 19 nt, Artificial Sequence
  Synthetic
gaaaugcccacagcaacac

SEQ ID NO: 55283 - RNA, 20 nt, Artificial Sequence
  Synthetic
agaaaugcccacagcaacac

SEQ ID NO: 55284 - RNA, 21 nt, Artificial Sequence
  Synthetic
cagaaaugcccacagcaacac

SEQ ID NO: 55285 - RNA, 22 nt, Artificial Sequence
  Synthetic
gcagaaaugcccacagcaacac

SEQ ID NO: 55286 - RNA, 23 nt, Artificial Sequence
  Synthetic
agcagaaaugcccacagcaacac

SEQ ID NO: 55287 - RNA, 24 nt, Artificial Sequence
  Synthetic
cagcagaaaugcccacagcaacac

SEQ ID NO: 55288 - RNA, 18 nt, Artificial Sequence
  Synthetic
ggaggcgcggaagaagac

SEQ ID NO: 55289 - RNA, 19 nt, Artificial Sequence
  Synthetic
cggaggcgcggaagaagac

SEQ ID NO: 55290 - RNA, 20 nt, Artificial Sequence
  Synthetic
ucggaggcgcggaagaagac

SEQ ID NO: 55291 - RNA, 21 nt, Artificial Sequence
  Synthetic
cucggaggcgcggaagaagac

SEQ ID NO: 55292 - RNA, 22 nt, Artificial Sequence
  Synthetic
ccucggaggcgcggaagaagac

SEQ ID NO: 55293 - RNA, 23 nt, Artificial Sequence
  Synthetic
cccucggaggcgcggaagaagac

SEQ ID NO: 55294 - RNA, 24 nt, Artificial Sequence
  Synthetic
acccucggaggcgcggaagaagac

SEQ ID NO: 55295 - RNA, 18 nt, Artificial Sequence
  Synthetic
ccggcgccgggcggcuac

SEQ ID NO: 55296 - RNA, 19 nt, Artificial Sequence
  Synthetic
cccggcgccgggcggcuac

SEQ ID NO: 55297 - RNA, 20 nt, Artificial Sequence
  Synthetic
gcccggcgccgggcggcuac

SEQ ID NO: 55298 - RNA, 21 nt, Artificial Sequence
  Synthetic
cgcccggcgccgggcggcuac

SEQ ID NO: 55299 - RNA, 22 nt, Artificial Sequence
  Synthetic
ccgcccggcgccgggcggcuac

SEQ ID NO: 55300 - RNA, 23 nt, Artificial Sequence
  Synthetic
uccgcccggcgccgggcggcuac

SEQ ID NO: 55301 - RNA, 24 nt, Artificial Sequence
  Synthetic
uuccgcccggcgccgggcggcuac

SEQ ID NO: 55302 - RNA, 18 nt, Artificial Sequence
  Synthetic
cggcgccgggcggcuacc

SEQ ID NO: 55303 - RNA, 19 nt, Artificial Sequence
  Synthetic
ccggcgccgggcggcuacc

SEQ ID NO: 55304 - RNA, 20 nt, Artificial Sequence
  Synthetic
cccggcgccgggcggcuacc

SEQ ID NO: 55305 - RNA, 21 nt, Artificial Sequence
  Synthetic
gcccggcgccgggcggcuacc

SEQ ID NO: 55306 - RNA, 22 nt, Artificial Sequence
  Synthetic
cgcccggcgccgggcggcuacc

SEQ ID NO: 55307 - RNA, 23 nt, Artificial Sequence
  Synthetic
ccgcccggcgccgggcggcuacc

SEQ ID NO: 55308 - RNA, 24 nt, Artificial Sequence
  Synthetic
uccgcccggcgccgggcggcuacc

SEQ ID NO: 55309 - RNA, 18 nt, Artificial Sequence
  Synthetic
cgaggcagaggcggaccc

SEQ ID NO: 55310 - RNA, 19 nt, Artificial Sequence
  Synthetic
ccgaggcagaggcggaccc

SEQ ID NO: 55311 - RNA, 20 nt, Artificial Sequence
  Synthetic
cccgaggcagaggcggaccc

SEQ ID NO: 55312 - RNA, 21 nt, Artificial Sequence
  Synthetic
ccccgaggcagaggcggaccc

SEQ ID NO: 55313 - RNA, 22 nt, Artificial Sequence
  Synthetic
uccccgaggcagaggcggaccc

SEQ ID NO: 55314 - RNA, 23 nt, Artificial Sequence
  Synthetic
guccccgaggcagaggcggaccc

SEQ ID NO: 55315 - RNA, 24 nt, Artificial Sequence
  Synthetic
gguccccgaggcagaggcggaccc

SEQ ID NO: 55316 - RNA, 18 nt, Artificial Sequence
  Synthetic
gccggcccggcccggccc

SEQ ID NO: 55317 - RNA, 19 nt, Artificial Sequence
  Synthetic
ugccggcccggcccggccc

SEQ ID NO: 55318 - RNA, 20 nt, Artificial Sequence
  Synthetic
uugccggcccggcccggccc

SEQ ID NO: 55319 - RNA, 21 nt, Artificial Sequence
  Synthetic
guugccggcccggcccggccc

SEQ ID NO: 55320 - RNA, 22 nt, Artificial Sequence
  Synthetic
cguugccggcccggcccggccc

SEQ ID NO: 55321 - RNA, 23 nt, Artificial Sequence
  Synthetic
gcguugccggcccggcccggccc

SEQ ID NO: 55322 - RNA, 24 nt, Artificial Sequence
  Synthetic
ggcguugccggcccggcccggccc

SEQ ID NO: 55323 - RNA, 18 nt, Artificial Sequence
  Synthetic
cggcgcggcccggggccc

SEQ ID NO: 55324 - RNA, 19 nt, Artificial Sequence
  Synthetic
ccggcgcggcccggggccc

SEQ ID NO: 55325 - RNA, 20 nt, Artificial Sequence
  Synthetic
gccggcgcggcccggggccc

SEQ ID NO: 55326 - RNA, 21 nt, Artificial Sequence
  Synthetic
cgccggcgcggcccggggccc

SEQ ID NO: 55327 - RNA, 22 nt, Artificial Sequence
  Synthetic
ccgccggcgcggcccggggccc

SEQ ID NO: 55328 - RNA, 23 nt, Artificial Sequence
  Synthetic
gccgccggcgcggcccggggccc

SEQ ID NO: 55329 - RNA, 24 nt, Artificial Sequence
  Synthetic
cgccgccggcgcggcccggggccc

SEQ ID NO: 55330 - RNA, 18 nt, Artificial Sequence
  Synthetic
gccggccgccggaugccc

SEQ ID NO: 55331 - RNA, 19 nt, Artificial Sequence
  Synthetic
ggccggccgccggaugccc

SEQ ID NO: 55332 - RNA, 20 nt, Artificial Sequence
  Synthetic
gggccggccgccggaugccc

SEQ ID NO: 55333 - RNA, 21 nt, Artificial Sequence
  Synthetic
ggggccggccgccggaugccc

SEQ ID NO: 55334 - RNA, 22 nt, Artificial Sequence
  Synthetic
uggggccggccgccggaugccc

SEQ ID NO: 55335 - RNA, 23 nt, Artificial Sequence
  Synthetic
guggggccggccgccggaugccc

SEQ ID NO: 55336 - RNA, 24 nt, Artificial Sequence
  Synthetic
cguggggccggccgccggaugccc

SEQ ID NO: 55337 - RNA, 18 nt, Artificial Sequence
  Synthetic
gccaagccccggcccgcc

SEQ ID NO: 55338 - RNA, 19 nt, Artificial Sequence
  Synthetic
ggccaagccccggcccgcc

SEQ ID NO: 55339 - RNA, 20 nt, Artificial Sequence
  Synthetic
cggccaagccccggcccgcc

SEQ ID NO: 55340 - RNA, 21 nt, Artificial Sequence
  Synthetic
gcggccaagccccggcccgcc

SEQ ID NO: 55341 - RNA, 22 nt, Artificial Sequence
  Synthetic
ggcggccaagccccggcccgcc

SEQ ID NO: 55342 - RNA, 23 nt, Artificial Sequence
  Synthetic
cggcggccaagccccggcccgcc

SEQ ID NO: 55343 - RNA, 24 nt, Artificial Sequence
  Synthetic
ucggcggccaagccccggcccgcc

SEQ ID NO: 55344 - RNA, 18 nt, Artificial Sequence
  Synthetic
gggcccccgcgcuccgcc

SEQ ID NO: 55345 - RNA, 19 nt, Artificial Sequence
  Synthetic
ggggcccccgcgcuccgcc

SEQ ID NO: 55346 - RNA, 20 nt, Artificial Sequence
  Synthetic
cggggcccccgcgcuccgcc

SEQ ID NO: 55347 - RNA, 21 nt, Artificial Sequence
  Synthetic
ccggggcccccgcgcuccgcc

SEQ ID NO: 55348 - RNA, 22 nt, Artificial Sequence
  Synthetic
cccggggcccccgcgcuccgcc

SEQ ID NO: 55349 - RNA, 23 nt, Artificial Sequence
  Synthetic
ccccggggcccccgcgcuccgcc

SEQ ID NO: 55350 - RNA, 24 nt, Artificial Sequence
  Synthetic
gccccggggcccccgcgcuccgcc

SEQ ID NO: 55351 - RNA, 18 nt, Artificial Sequence
  Synthetic
ugccggcccggcccggcc

SEQ ID NO: 55352 - RNA, 19 nt, Artificial Sequence
  Synthetic
uugccggcccggcccggcc

SEQ ID NO: 55353 - RNA, 20 nt, Artificial Sequence
  Synthetic
guugccggcccggcccggcc

SEQ ID NO: 55354 - RNA, 21 nt, Artificial Sequence
  Synthetic
cguugccggcccggcccggcc

SEQ ID NO: 55355 - RNA, 22 nt, Artificial Sequence
  Synthetic
gcguugccggcccggcccggcc

SEQ ID NO: 55356 - RNA, 23 nt, Artificial Sequence
  Synthetic
ggcguugccggcccggcccggcc

SEQ ID NO: 55357 - RNA, 24 nt, Artificial Sequence
  Synthetic
gggcguugccggcccggcccggcc

SEQ ID NO: 55358 - RNA, 18 nt, Artificial Sequence
  Synthetic
aacgccgccggcgcggcc

SEQ ID NO: 55359 - RNA, 19 nt, Artificial Sequence
  Synthetic
aaacgccgccggcgcggcc

SEQ ID NO: 55360 - RNA, 20 nt, Artificial Sequence
  Synthetic
gaaacgccgccggcgcggcc

SEQ ID NO: 55361 - RNA, 21 nt, Artificial Sequence
  Synthetic
ggaaacgccgccggcgcggcc

SEQ ID NO: 55362 - RNA, 22 nt, Artificial Sequence
  Synthetic
cggaaacgccgccggcgcggcc

SEQ ID NO: 55363 - RNA, 23 nt, Artificial Sequence
  Synthetic
gcggaaacgccgccggcgcggcc

SEQ ID NO: 55364 - RNA, 24 nt, Artificial Sequence
  Synthetic
cgcggaaacgccgccggcgcggcc

SEQ ID NO: 55365 - RNA, 18 nt, Artificial Sequence
  Synthetic
cccgggagcggggcggcc

SEQ ID NO: 55366 - RNA, 19 nt, Artificial Sequence
  Synthetic
gcccgggagcggggcggcc

SEQ ID NO: 55367 - RNA, 20 nt, Artificial Sequence
  Synthetic
ggcccgggagcggggcggcc

SEQ ID NO: 55368 - RNA, 18 nt, Artificial Sequence
  Synthetic
cgcugcucggcugcggcc

SEQ ID NO: 55369 - RNA, 19 nt, Artificial Sequence
  Synthetic
gcgcugcucggcugcggcc

SEQ ID NO: 55370 - RNA, 20 nt, Artificial Sequence
  Synthetic
ggcgcugcucggcugcggcc

SEQ ID NO: 55371 - RNA, 21 nt, Artificial Sequence
  Synthetic
cggcgcugcucggcugcggcc

SEQ ID NO: 55372 - RNA, 22 nt, Artificial Sequence
  Synthetic
gcggcgcugcucggcugcggcc

SEQ ID NO: 55373 - RNA, 23 nt, Artificial Sequence
  Synthetic
cgcggcgcugcucggcugcggcc

SEQ ID NO: 55374 - RNA, 24 nt, Artificial Sequence
  Synthetic
ccgcggcgcugcucggcugcggcc

SEQ ID NO: 55375 - RNA, 18 nt, Artificial Sequence
  Synthetic
ccggcgcggcccggggcc

SEQ ID NO: 55376 - RNA, 19 nt, Artificial Sequence
  Synthetic
gccggcgcggcccggggcc

SEQ ID NO: 55377 - RNA, 20 nt, Artificial Sequence
  Synthetic
cgccggcgcggcccggggcc

SEQ ID NO: 55378 - RNA, 21 nt, Artificial Sequence
  Synthetic
ccgccggcgcggcccggggcc

SEQ ID NO: 55379 - RNA, 22 nt, Artificial Sequence
  Synthetic
gccgccggcgcggcccggggcc

SEQ ID NO: 55380 - RNA, 23 nt, Artificial Sequence
  Synthetic
cgccgccggcgcggcccggggcc

SEQ ID NO: 55381 - RNA, 24 nt, Artificial Sequence
  Synthetic
acgccgccggcgcggcccggggcc

SEQ ID NO: 55382 - RNA, 18 nt, Artificial Sequence
  Synthetic
gaaucgaaaaaagccucc

SEQ ID NO: 55383 - RNA, 19 nt, Artificial Sequence
  Synthetic
ggaaucgaaaaaagccucc

SEQ ID NO: 55384 - RNA, 20 nt, Artificial Sequence
  Synthetic
gggaaucgaaaaaagccucc

SEQ ID NO: 55385 - RNA, 21 nt, Artificial Sequence
  Synthetic
cgggaaucgaaaaaagccucc

SEQ ID NO: 55386 - RNA, 22 nt, Artificial Sequence
  Synthetic
ccgggaaucgaaaaaagccucc

SEQ ID NO: 55387 - RNA, 23 nt, Artificial Sequence
  Synthetic
gccgggaaucgaaaaaagccucc

SEQ ID NO: 55388 - RNA, 24 nt, Artificial Sequence
  Synthetic
ggccgggaaucgaaaaaagccucc

SEQ ID NO: 55389 - RNA, 18 nt, Artificial Sequence
  Synthetic
gcugcggccgcgggcucc

SEQ ID NO: 55390 - RNA, 19 nt, Artificial Sequence
  Synthetic
ggcugcggccgcgggcucc

SEQ ID NO: 55391 - RNA, 20 nt, Artificial Sequence
  Synthetic
cggcugcggccgcgggcucc

SEQ ID NO: 55392 - RNA, 21 nt, Artificial Sequence
  Synthetic
ucggcugcggccgcgggcucc

SEQ ID NO: 55393 - RNA, 22 nt, Artificial Sequence
  Synthetic
cucggcugcggccgcgggcucc

SEQ ID NO: 55394 - RNA, 23 nt, Artificial Sequence
  Synthetic
gcucggcugcggccgcgggcucc

SEQ ID NO: 55395 - RNA, 24 nt, Artificial Sequence
  Synthetic
ugcucggcugcggccgcgggcucc

SEQ ID NO: 55396 - RNA, 18 nt, Artificial Sequence
  Synthetic
cggcccgcccgggggucc

SEQ ID NO: 55397 - RNA, 19 nt, Artificial Sequence
  Synthetic
ccggcccgcccgggggucc

SEQ ID NO: 55398 - RNA, 20 nt, Artificial Sequence
  Synthetic
cccggcccgcccgggggucc

SEQ ID NO: 55399 - RNA, 21 nt, Artificial Sequence
  Synthetic
ccccggcccgcccgggggucc

SEQ ID NO: 55400 - RNA, 22 nt, Artificial Sequence
  Synthetic
gccccggcccgcccgggggucc

SEQ ID NO: 55401 - RNA, 23 nt, Artificial Sequence
  Synthetic
agccccggcccgcccgggggucc

SEQ ID NO: 55402 - RNA, 24 nt, Artificial Sequence
  Synthetic
aagccccggcccgcccgggggucc

SEQ ID NO: 55403 - RNA, 18 nt, Artificial Sequence
  Synthetic
ggccaagccccggcccgc

SEQ ID NO: 55404 - RNA, 19 nt, Artificial Sequence
  Synthetic
cggccaagccccggcccgc

SEQ ID NO: 55405 - RNA, 20 nt, Artificial Sequence
  Synthetic
gcggccaagccccggcccgc

SEQ ID NO: 55406 - RNA, 21 nt, Artificial Sequence
  Synthetic
ggcggccaagccccggcccgc

SEQ ID NO: 55407 - RNA, 22 nt, Artificial Sequence
  Synthetic
cggcggccaagccccggcccgc

SEQ ID NO: 55408 - RNA, 23 nt, Artificial Sequence
  Synthetic
ucggcggccaagccccggcccgc

SEQ ID NO: 55409 - RNA, 24 nt, Artificial Sequence
  Synthetic
cucggcggccaagccccggcccgc

SEQ ID NO: 55410 - RNA, 18 nt, Artificial Sequence
  Synthetic
cggccgccggaugcccgc

SEQ ID NO: 55411 - RNA, 19 nt, Artificial Sequence
  Synthetic
ccggccgccggaugcccgc

SEQ ID NO: 55412 - RNA, 20 nt, Artificial Sequence
  Synthetic
gccggccgccggaugcccgc

SEQ ID NO: 55413 - RNA, 21 nt, Artificial Sequence
  Synthetic
ggccggccgccggaugcccgc

SEQ ID NO: 55414 - RNA, 22 nt, Artificial Sequence
  Synthetic
gggccggccgccggaugcccgc

SEQ ID NO: 55415 - RNA, 23 nt, Artificial Sequence
  Synthetic
ggggccggccgccggaugcccgc

SEQ ID NO: 55416 - RNA, 24 nt, Artificial Sequence
  Synthetic
uggggccggccgccggaugcccgc

SEQ ID NO: 55417 - RNA, 18 nt, Artificial Sequence
  Synthetic
ggggcccccgcgcuccgc

SEQ ID NO: 55418 - RNA, 19 nt, Artificial Sequence
  Synthetic
cggggcccccgcgcuccgc

SEQ ID NO: 55419 - RNA, 20 nt, Artificial Sequence
  Synthetic
ccggggcccccgcgcuccgc

SEQ ID NO: 55420 - RNA, 21 nt, Artificial Sequence
  Synthetic
cccggggcccccgcgcuccgc

SEQ ID NO: 55421 - RNA, 22 nt, Artificial Sequence
  Synthetic
ccccggggcccccgcgcuccgc

SEQ ID NO: 55422 - RNA, 23 nt, Artificial Sequence
  Synthetic
gccccggggcccccgcgcuccgc

SEQ ID NO: 55423 - RNA, 24 nt, Artificial Sequence
  Synthetic
ggccccggggcccccgcgcuccgc

SEQ ID NO: 55424 - RNA, 18 nt, Artificial Sequence
  Synthetic
uucgcgaacgcgcggcgc

SEQ ID NO: 55425 - RNA, 19 nt, Artificial Sequence
  Synthetic
uuucgcgaacgcgcggcgc

SEQ ID NO: 55426 - RNA, 20 nt, Artificial Sequence
  Synthetic
cuuucgcgaacgcgcggcgc

SEQ ID NO: 55427 - RNA, 21 nt, Artificial Sequence
  Synthetic
ccuuucgcgaacgcgcggcgc

SEQ ID NO: 55428 - RNA, 22 nt, Artificial Sequence
  Synthetic
gccuuucgcgaacgcgcggcgc

SEQ ID NO: 55429 - RNA, 23 nt, Artificial Sequence
  Synthetic
cgccuuucgcgaacgcgcggcgc

SEQ ID NO: 55430 - RNA, 24 nt, Artificial Sequence
  Synthetic
gcgccuuucgcgaacgcgcggcgc

SEQ ID NO: 55431 - RNA, 18 nt, Artificial Sequence
  Synthetic
aggcggacccucggaggc

SEQ ID NO: 55432 - RNA, 19 nt, Artificial Sequence
  Synthetic
gaggcggacccucggaggc

SEQ ID NO: 55433 - RNA, 20 nt, Artificial Sequence
  Synthetic
agaggcggacccucggaggc

SEQ ID NO: 55434 - RNA, 21 nt, Artificial Sequence
  Synthetic
cagaggcggacccucggaggc

SEQ ID NO: 55435 - RNA, 22 nt, Artificial Sequence
  Synthetic
gcagaggcggacccucggaggc

SEQ ID NO: 55436 - RNA, 23 nt, Artificial Sequence
  Synthetic
ggcagaggcggacccucggaggc

SEQ ID NO: 55437 - RNA, 24 nt, Artificial Sequence
  Synthetic
aggcagaggcggacccucggaggc

SEQ ID NO: 55438 - RNA, 18 nt, Artificial Sequence
  Synthetic
cggaagaagacgggaggc

SEQ ID NO: 55439 - RNA, 19 nt, Artificial Sequence
  Synthetic
gcggaagaagacgggaggc

SEQ ID NO: 55440 - RNA, 20 nt, Artificial Sequence
  Synthetic
cgcggaagaagacgggaggc

SEQ ID NO: 55441 - RNA, 21 nt, Artificial Sequence
  Synthetic
gcgcggaagaagacgggaggc

SEQ ID NO: 55442 - RNA, 22 nt, Artificial Sequence
  Synthetic
ggcgcggaagaagacgggaggc

SEQ ID NO: 55443 - RNA, 23 nt, Artificial Sequence
  Synthetic
aggcgcggaagaagacgggaggc

SEQ ID NO: 55444 - RNA, 24 nt, Artificial Sequence
  Synthetic
gaggcgcggaagaagacgggaggc

SEQ ID NO: 55445 - RNA, 18 nt, Artificial Sequence
  Synthetic
ccuaaugcggcgggaggc

SEQ ID NO: 55446 - RNA, 19 nt, Artificial Sequence
  Synthetic
gccuaaugcggcgggaggc

SEQ ID NO: 55447 - RNA, 20 nt, Artificial Sequence
  Synthetic
ggccuaaugcggcgggaggc

SEQ ID NO: 55448 - RNA, 21 nt, Artificial Sequence
  Synthetic
gggccuaaugcggcgggaggc

SEQ ID NO: 55449 - RNA, 22 nt, Artificial Sequence
  Synthetic
ggggccuaaugcggcgggaggc

SEQ ID NO: 55450 - RNA, 23 nt, Artificial Sequence
  Synthetic
gggggccuaaugcggcgggaggc

SEQ ID NO: 55451 - RNA, 24 nt, Artificial Sequence
  Synthetic
cgggggccuaaugcggcgggaggc

SEQ ID NO: 55452 - RNA, 18 nt, Artificial Sequence
  Synthetic
cuacccgggacccccggc

SEQ ID NO: 55453 - RNA, 19 nt, Artificial Sequence
  Synthetic
gcuacccgggacccccggc

SEQ ID NO: 55454 - RNA, 20 nt, Artificial Sequence
  Synthetic
ggcuacccgggacccccggc

SEQ ID NO: 55455 - RNA, 21 nt, Artificial Sequence
  Synthetic
cggcuacccgggacccccggc

SEQ ID NO: 55456 - RNA, 22 nt, Artificial Sequence
  Synthetic
gcggcuacccgggacccccggc

SEQ ID NO: 55457 - RNA, 23 nt, Artificial Sequence
  Synthetic
ggcggcuacccgggacccccggc

SEQ ID NO: 55458 - RNA, 24 nt, Artificial Sequence
  Synthetic
gggcggcuacccgggacccccggc

SEQ ID NO: 55459 - RNA, 18 nt, Artificial Sequence
  Synthetic
cucuccgccgcggccggc

SEQ ID NO: 55460 - RNA, 19 nt, Artificial Sequence
  Synthetic
ucucuccgccgcggccggc

SEQ ID NO: 55461 - RNA, 20 nt, Artificial Sequence
  Synthetic
uucucuccgccgcggccggc

SEQ ID NO: 55462 - RNA, 21 nt, Artificial Sequence
  Synthetic
guucucuccgccgcggccggc

SEQ ID NO: 55463 - RNA, 22 nt, Artificial Sequence
  Synthetic
gguucucuccgccgcggccggc

SEQ ID NO: 55464 - RNA, 23 nt, Artificial Sequence
  Synthetic
ggguucucuccgccgcggccggc

SEQ ID NO: 55465 - RNA, 24 nt, Artificial Sequence
  Synthetic
gggguucucuccgccgcggccggc

SEQ ID NO: 55466 - RNA, 18 nt, Artificial Sequence
  Synthetic
ugcgggggccccuccggc

SEQ ID NO: 55467 - RNA, 19 nt, Artificial Sequence
  Synthetic
gugcgggggccccuccggc

SEQ ID NO: 55468 - RNA, 20 nt, Artificial Sequence
  Synthetic
ggugcgggggccccuccggc

SEQ ID NO: 55469 - RNA, 21 nt, Artificial Sequence
  Synthetic
aggugcgggggccccuccggc

SEQ ID NO: 55470 - RNA, 22 nt, Artificial Sequence
  Synthetic
gaggugcgggggccccuccggc

SEQ ID NO: 55471 - RNA, 23 nt, Artificial Sequence
  Synthetic
cgaggugcgggggccccuccggc

SEQ ID NO: 55472 - RNA, 24 nt, Artificial Sequence
  Synthetic
ccgaggugcgggggccccuccggc

SEQ ID NO: 55473 - RNA, 18 nt, Artificial Sequence
  Synthetic
aaacgccgccggcgcggc

SEQ ID NO: 55474 - RNA, 19 nt, Artificial Sequence
  Synthetic
gaaacgccgccggcgcggc

SEQ ID NO: 55475 - RNA, 20 nt, Artificial Sequence
  Synthetic
ggaaacgccgccggcgcggc

SEQ ID NO: 55476 - RNA, 21 nt, Artificial Sequence
  Synthetic
cggaaacgccgccggcgcggc

SEQ ID NO: 55477 - RNA, 22 nt, Artificial Sequence
  Synthetic
gcggaaacgccgccggcgcggc

SEQ ID NO: 55478 - RNA, 23 nt, Artificial Sequence
  Synthetic
cgcggaaacgccgccggcgcggc

SEQ ID NO: 55479 - RNA, 24 nt, Artificial Sequence
  Synthetic
acgcggaaacgccgccggcgcggc

SEQ ID NO: 55480 - RNA, 18 nt, Artificial Sequence
  Synthetic
gcccgggagcggggcggc

SEQ ID NO: 55481 - RNA, 19 nt, Artificial Sequence
  Synthetic
ggcccgggagcggggcggc

SEQ ID NO: 55482 - RNA, 20 nt, Artificial Sequence
  Synthetic
gggcccgggagcggggcggc

SEQ ID NO: 55483 - RNA, 18 nt, Artificial Sequence
  Synthetic
gcgggggccuaaugcggc

SEQ ID NO: 55484 - RNA, 19 nt, Artificial Sequence
  Synthetic
cgcgggggccuaaugcggc

SEQ ID NO: 55485 - RNA, 20 nt, Artificial Sequence
  Synthetic
ccgcgggggccuaaugcggc

SEQ ID NO: 55486 - RNA, 21 nt, Artificial Sequence
  Synthetic
cccgcgggggccuaaugcggc

SEQ ID NO: 55487 - RNA, 22 nt, Artificial Sequence
  Synthetic
gcccgcgggggccuaaugcggc

SEQ ID NO: 55488 - RNA, 23 nt, Artificial Sequence
  Synthetic
ugcccgcgggggccuaaugcggc

SEQ ID NO: 55489 - RNA, 24 nt, Artificial Sequence
  Synthetic
augcccgcgggggccuaaugcggc

SEQ ID NO: 55490 - RNA, 18 nt, Artificial Sequence
  Synthetic
aguguuuaauggaagggc

SEQ ID NO: 55491 - RNA, 19 nt, Artificial Sequence
  Synthetic
gaguguuuaauggaagggc

SEQ ID NO: 55492 - RNA, 20 nt, Artificial Sequence
  Synthetic
ggaguguuuaauggaagggc

SEQ ID NO: 55493 - RNA, 21 nt, Artificial Sequence
  Synthetic
gggaguguuuaauggaagggc

SEQ ID NO: 55494 - RNA, 22 nt, Artificial Sequence
  Synthetic
ugggaguguuuaauggaagggc

SEQ ID NO: 55495 - RNA, 23 nt, Artificial Sequence
  Synthetic
gugggaguguuuaauggaagggc

SEQ ID NO: 55496 - RNA, 24 nt, Artificial Sequence
  Synthetic
cgugggaguguuuaauggaagggc

SEQ ID NO: 55497 - RNA, 18 nt, Artificial Sequence
  Synthetic
cgggccggaccgccgggc

SEQ ID NO: 55498 - RNA, 19 nt, Artificial Sequence
  Synthetic
ccgggccggaccgccgggc

SEQ ID NO: 55499 - RNA, 20 nt, Artificial Sequence
  Synthetic
cccgggccggaccgccgggc

SEQ ID NO: 55500 - RNA, 21 nt, Artificial Sequence
  Synthetic
gcccgggccggaccgccgggc

SEQ ID NO: 55501 - RNA, 22 nt, Artificial Sequence
  Synthetic
ggcccgggccggaccgccgggc

SEQ ID NO: 55502 - RNA, 23 nt, Artificial Sequence
  Synthetic
gggcccgggccggaccgccgggc

SEQ ID NO: 55503 - RNA, 24 nt, Artificial Sequence
  Synthetic
ggggcccgggccggaccgccgggc

SEQ ID NO: 55504 - RNA, 18 nt, Artificial Sequence
  Synthetic
gcaacacgcgggcggggc

SEQ ID NO: 55505 - RNA, 19 nt, Artificial Sequence
  Synthetic
agcaacacgcgggcggggc

SEQ ID NO: 55506 - RNA, 20 nt, Artificial Sequence
  Synthetic
cagcaacacgcgggcggggc

SEQ ID NO: 55507 - RNA, 21 nt, Artificial Sequence
  Synthetic
acagcaacacgcgggcggggc

SEQ ID NO: 55508 - RNA, 22 nt, Artificial Sequence
  Synthetic
cacagcaacacgcgggcggggc

SEQ ID NO: 55509 - RNA, 23 nt, Artificial Sequence
  Synthetic
ccacagcaacacgcgggcggggc

SEQ ID NO: 55510 - RNA, 24 nt, Artificial Sequence
  Synthetic
cccacagcaacacgcgggcggggc

SEQ ID NO: 55511 - RNA, 18 nt, Artificial Sequence
  Synthetic
ccgcgcuccgccgggggc

SEQ ID NO: 55512 - RNA, 19 nt, Artificial Sequence
  Synthetic
cccgcgcuccgccgggggc

SEQ ID NO: 55513 - RNA, 20 nt, Artificial Sequence
  Synthetic
ccccgcgcuccgccgggggc

SEQ ID NO: 55514 - RNA, 21 nt, Artificial Sequence
  Synthetic
cccccgcgcuccgccgggggc

SEQ ID NO: 55515 - RNA, 22 nt, Artificial Sequence
  Synthetic
gcccccgcgcuccgccgggggc

SEQ ID NO: 55516 - RNA, 23 nt, Artificial Sequence
  Synthetic
ggcccccgcgcuccgccgggggc

SEQ ID NO: 55517 - RNA, 24 nt, Artificial Sequence
  Synthetic
gggcccccgcgcuccgccgggggc

SEQ ID NO: 55518 - RNA, 18 nt, Artificial Sequence
  Synthetic
gggcggccgccgaggugc

SEQ ID NO: 55519 - RNA, 19 nt, Artificial Sequence
  Synthetic
ggggcggccgccgaggugc

SEQ ID NO: 55520 - RNA, 20 nt, Artificial Sequence
  Synthetic
gggggcggccgccgaggugc

SEQ ID NO: 55521 - RNA, 21 nt, Artificial Sequence
  Synthetic
agggggcggccgccgaggugc

SEQ ID NO: 55522 - RNA, 22 nt, Artificial Sequence
  Synthetic
gagggggcggccgccgaggugc

SEQ ID NO: 55523 - RNA, 23 nt, Artificial Sequence
  Synthetic
ggagggggcggccgccgaggugc

SEQ ID NO: 55524 - RNA, 24 nt, Artificial Sequence
  Synthetic
cggagggggcggccgccgaggugc

SEQ ID NO: 55525 - RNA, 18 nt, Artificial Sequence
  Synthetic
agaagggcgcgccggugc

SEQ ID NO: 55526 - RNA, 19 nt, Artificial Sequence
  Synthetic
gagaagggcgcgccggugc

SEQ ID NO: 55527 - RNA, 20 nt, Artificial Sequence
  Synthetic
ggagaagggcgcgccggugc

SEQ ID NO: 55528 - RNA, 21 nt, Artificial Sequence
  Synthetic
aggagaagggcgcgccggugc

SEQ ID NO: 55529 - RNA, 22 nt, Artificial Sequence
  Synthetic
gaggagaagggcgcgccggugc

SEQ ID NO: 55530 - RNA, 23 nt, Artificial Sequence
  Synthetic
agaggagaagggcgcgccggugc

SEQ ID NO: 55531 - RNA, 24 nt, Artificial Sequence
  Synthetic
gagaggagaagggcgcgccggugc

SEQ ID NO: 55532 - RNA, 18 nt, Artificial Sequence
  Synthetic
ggaaucgaaaaaagccuc

SEQ ID NO: 55533 - RNA, 19 nt, Artificial Sequence
  Synthetic
gggaaucgaaaaaagccuc

SEQ ID NO: 55534 - RNA, 20 nt, Artificial Sequence
  Synthetic
cgggaaucgaaaaaagccuc

SEQ ID NO: 55535 - RNA, 21 nt, Artificial Sequence
  Synthetic
ccgggaaucgaaaaaagccuc

SEQ ID NO: 55536 - RNA, 22 nt, Artificial Sequence
  Synthetic
gccgggaaucgaaaaaagccuc

SEQ ID NO: 55537 - RNA, 23 nt, Artificial Sequence
  Synthetic
ggccgggaaucgaaaaaagccuc

SEQ ID NO: 55538 - RNA, 24 nt, Artificial Sequence
  Synthetic
cggccgggaaucgaaaaaagccuc

SEQ ID NO: 55539 - RNA, 18 nt, Artificial Sequence
  Synthetic
ggcugcggccgcgggcuc

SEQ ID NO: 55540 - RNA, 19 nt, Artificial Sequence
  Synthetic
cggcugcggccgcgggcuc

SEQ ID NO: 55541 - RNA, 20 nt, Artificial Sequence
  Synthetic
ucggcugcggccgcgggcuc

SEQ ID NO: 55542 - RNA, 21 nt, Artificial Sequence
  Synthetic
cucggcugcggccgcgggcuc

SEQ ID NO: 55543 - RNA, 22 nt, Artificial Sequence
  Synthetic
gcucggcugcggccgcgggcuc

SEQ ID NO: 55544 - RNA, 23 nt, Artificial Sequence
  Synthetic
ugcucggcugcggccgcgggcuc

SEQ ID NO: 55545 - RNA, 24 nt, Artificial Sequence
  Synthetic
cugcucggcugcggccgcgggcuc

SEQ ID NO: 55546 - RNA, 18 nt, Artificial Sequence
  Synthetic
gccccuuucgcgccuuuc

SEQ ID NO: 55547 - RNA, 19 nt, Artificial Sequence
  Synthetic
ggccccuuucgcgccuuuc

SEQ ID NO: 55548 - RNA, 20 nt, Artificial Sequence
  Synthetic
gggccccuuucgcgccuuuc

SEQ ID NO: 55549 - RNA, 21 nt, Artificial Sequence
  Synthetic
ggggccccuuucgcgccuuuc

SEQ ID NO: 55550 - RNA, 22 nt, Artificial Sequence
  Synthetic
gggggccccuuucgcgccuuuc

SEQ ID NO: 55551 - RNA, 23 nt, Artificial Sequence
  Synthetic
cgggggccccuuucgcgccuuuc

SEQ ID NO: 55552 - RNA, 24 nt, Artificial Sequence
  Synthetic
ccgggggccccuuucgcgccuuuc

SEQ ID NO: 55553 - RNA, 18 nt, Artificial Sequence
  Synthetic
ggaggcgggggaaaaaag

SEQ ID NO: 55554 - RNA, 19 nt, Artificial Sequence
  Synthetic
gggaggcgggggaaaaaag

SEQ ID NO: 55555 - RNA, 20 nt, Artificial Sequence
  Synthetic
cgggaggcgggggaaaaaag

SEQ ID NO: 55556 - RNA, 21 nt, Artificial Sequence
  Synthetic
acgggaggcgggggaaaaaag

SEQ ID NO: 55557 - RNA, 22 nt, Artificial Sequence
  Synthetic
gacgggaggcgggggaaaaaag

SEQ ID NO: 55558 - RNA, 23 nt, Artificial Sequence
  Synthetic
agacgggaggcgggggaaaaaag

SEQ ID NO: 55559 - RNA, 24 nt, Artificial Sequence
  Synthetic
aagacgggaggcgggggaaaaaag

SEQ ID NO: 55560 - RNA, 18 nt, Artificial Sequence
  Synthetic
ucggaggcgcggaagaag

SEQ ID NO: 55561 - RNA, 19 nt, Artificial Sequence
  Synthetic
cucggaggcgcggaagaag

SEQ ID NO: 55562 - RNA, 20 nt, Artificial Sequence
  Synthetic
ccucggaggcgcggaagaag

SEQ ID NO: 55563 - RNA, 21 nt, Artificial Sequence
  Synthetic
cccucggaggcgcggaagaag

SEQ ID NO: 55564 - RNA, 22 nt, Artificial Sequence
  Synthetic
acccucggaggcgcggaagaag

SEQ ID NO: 55565 - RNA, 23 nt, Artificial Sequence
  Synthetic
gacccucggaggcgcggaagaag

SEQ ID NO: 55566 - RNA, 24 nt, Artificial Sequence
  Synthetic
ggacccucggaggcgcggaagaag

SEQ ID NO: 55567 - RNA, 18 nt, Artificial Sequence
  Synthetic
ggaaaaaagggggaagag

SEQ ID NO: 55568 - RNA, 19 nt, Artificial Sequence
  Synthetic
gggaaaaaagggggaagag

SEQ ID NO: 55569 - RNA, 20 nt, Artificial Sequence
  Synthetic
ggggaaaaaagggggaagag

SEQ ID NO: 55570 - RNA, 21 nt, Artificial Sequence
  Synthetic
gggggaaaaaagggggaagag

SEQ ID NO: 55571 - RNA, 22 nt, Artificial Sequence
  Synthetic
cgggggaaaaaagggggaagag

SEQ ID NO: 55572 - RNA, 23 nt, Artificial Sequence
  Synthetic
gcgggggaaaaaagggggaagag

SEQ ID NO: 55573 - RNA, 24 nt, Artificial Sequence
  Synthetic
ggcgggggaaaaaagggggaagag

SEQ ID NO: 55574 - RNA, 18 nt, Artificial Sequence
  Synthetic
gggguccccgaggcagag

SEQ ID NO: 55575 - RNA, 19 nt, Artificial Sequence
  Synthetic
ggggguccccgaggcagag

SEQ ID NO: 55576 - RNA, 20 nt, Artificial Sequence
  Synthetic
cggggguccccgaggcagag

SEQ ID NO: 55577 - RNA, 21 nt, Artificial Sequence
  Synthetic
ccggggguccccgaggcagag

SEQ ID NO: 55578 - RNA, 22 nt, Artificial Sequence
  Synthetic
cccggggguccccgaggcagag

SEQ ID NO: 55579 - RNA, 23 nt, Artificial Sequence
  Synthetic
gcccggggguccccgaggcagag

SEQ ID NO: 55580 - RNA, 24 nt, Artificial Sequence
  Synthetic
cgcccggggguccccgaggcagag

SEQ ID NO: 55581 - RNA, 18 nt, Artificial Sequence
  Synthetic
aaaaaagggggaagagag

SEQ ID NO: 55582 - RNA, 19 nt, Artificial Sequence
  Synthetic
gaaaaaagggggaagagag

SEQ ID NO: 55583 - RNA, 20 nt, Artificial Sequence
  Synthetic
ggaaaaaagggggaagagag

SEQ ID NO: 55584 - RNA, 21 nt, Artificial Sequence
  Synthetic
gggaaaaaagggggaagagag

SEQ ID NO: 55585 - RNA, 22 nt, Artificial Sequence
  Synthetic
ggggaaaaaagggggaagagag

SEQ ID NO: 55586 - RNA, 23 nt, Artificial Sequence
  Synthetic
gggggaaaaaagggggaagagag

SEQ ID NO: 55587 - RNA, 24 nt, Artificial Sequence
  Synthetic
cgggggaaaaaagggggaagagag

SEQ ID NO: 55588 - RNA, 18 nt, Artificial Sequence
  Synthetic
gagguagggaggggagag

SEQ ID NO: 55589 - RNA, 19 nt, Artificial Sequence
  Synthetic
ggagguagggaggggagag

SEQ ID NO: 55590 - RNA, 20 nt, Artificial Sequence
  Synthetic
gggagguagggaggggagag

SEQ ID NO: 55591 - RNA, 21 nt, Artificial Sequence
  Synthetic
ggggagguagggaggggagag

SEQ ID NO: 55592 - RNA, 22 nt, Artificial Sequence
  Synthetic
gggggagguagggaggggagag

SEQ ID NO: 55593 - RNA, 23 nt, Artificial Sequence
  Synthetic
agggggagguagggaggggagag

SEQ ID NO: 55594 - RNA, 24 nt, Artificial Sequence
  Synthetic
gagggggagguagggaggggagag

SEQ ID NO: 55595 - RNA, 18 nt, Artificial Sequence
  Synthetic
guagggaggggagaggag

SEQ ID NO: 55596 - RNA, 19 nt, Artificial Sequence
  Synthetic
gguagggaggggagaggag

SEQ ID NO: 55597 - RNA, 20 nt, Artificial Sequence
  Synthetic
agguagggaggggagaggag

SEQ ID NO: 55598 - RNA, 21 nt, Artificial Sequence
  Synthetic
gagguagggaggggagaggag

SEQ ID NO: 55599 - RNA, 22 nt, Artificial Sequence
  Synthetic
ggagguagggaggggagaggag

SEQ ID NO: 55600 - RNA, 23 nt, Artificial Sequence
  Synthetic
gggagguagggaggggagaggag

SEQ ID NO: 55601 - RNA, 24 nt, Artificial Sequence
  Synthetic
ggggagguagggaggggagaggag

SEQ ID NO: 55602 - RNA, 18 nt, Artificial Sequence
  Synthetic
ggggcggccgggagggag

SEQ ID NO: 55603 - RNA, 19 nt, Artificial Sequence
  Synthetic
cggggcggccgggagggag

SEQ ID NO: 55604 - RNA, 20 nt, Artificial Sequence
  Synthetic
gcggggcggccgggagggag

SEQ ID NO: 55605 - RNA, 21 nt, Artificial Sequence
  Synthetic
agcggggcggccgggagggag

SEQ ID NO: 55606 - RNA, 22 nt, Artificial Sequence
  Synthetic
gagcggggcggccgggagggag

SEQ ID NO: 55607 - RNA, 23 nt, Artificial Sequence
  Synthetic
ggagcggggcggccgggagggag

SEQ ID NO: 55608 - RNA, 24 nt, Artificial Sequence
  Synthetic
gggagcggggcggccgggagggag

SEQ ID NO: 55609 - RNA, 18 nt, Artificial Sequence
  Synthetic
agagggggagguagggag

SEQ ID NO: 55610 - RNA, 19 nt, Artificial Sequence
  Synthetic
gagagggggagguagggag

SEQ ID NO: 55611 - RNA, 20 nt, Artificial Sequence
  Synthetic
agagagggggagguagggag

SEQ ID NO: 55612 - RNA, 21 nt, Artificial Sequence
  Synthetic
aagagagggggagguagggag

SEQ ID NO: 55613 - RNA, 22 nt, Artificial Sequence
  Synthetic
gaagagagggggagguagggag

SEQ ID NO: 55614 - RNA, 23 nt, Artificial Sequence
  Synthetic
ggaagagagggggagguagggag

SEQ ID NO: 55615 - RNA, 24 nt, Artificial Sequence
  Synthetic
gggaagagagggggagguagggag

SEQ ID NO: 55616 - RNA, 18 nt, Artificial Sequence
  Synthetic
cgcggaagaagacgggag

SEQ ID NO: 55617 - RNA, 19 nt, Artificial Sequence
  Synthetic
gcgcggaagaagacgggag

SEQ ID NO: 55618 - RNA, 20 nt, Artificial Sequence
  Synthetic
ggcgcggaagaagacgggag

SEQ ID NO: 55619 - RNA, 21 nt, Artificial Sequence
  Synthetic
aggcgcggaagaagacgggag

SEQ ID NO: 55620 - RNA, 22 nt, Artificial Sequence
  Synthetic
gaggcgcggaagaagacgggag

SEQ ID NO: 55621 - RNA, 23 nt, Artificial Sequence
  Synthetic
ggaggcgcggaagaagacgggag

SEQ ID NO: 55622 - RNA, 24 nt, Artificial Sequence
  Synthetic
cggaggcgcggaagaagacgggag

SEQ ID NO: 55623 - RNA, 18 nt, Artificial Sequence
  Synthetic
gggagguagggaggggag

SEQ ID NO: 55624 - RNA, 19 nt, Artificial Sequence
  Synthetic
ggggagguagggaggggag

SEQ ID NO: 55625 - RNA, 20 nt, Artificial Sequence
  Synthetic
gggggagguagggaggggag

SEQ ID NO: 55626 - RNA, 21 nt, Artificial Sequence
  Synthetic
agggggagguagggaggggag

SEQ ID NO: 55627 - RNA, 22 nt, Artificial Sequence
  Synthetic
gagggggagguagggaggggag

SEQ ID NO: 55628 - RNA, 23 nt, Artificial Sequence
  Synthetic
agagggggagguagggaggggag

SEQ ID NO: 55629 - RNA, 24 nt, Artificial Sequence
  Synthetic
gagagggggagguagggaggggag

SEQ ID NO: 55630 - RNA, 18 nt, Artificial Sequence
  Synthetic
gcgcgcccccccccaacg

SEQ ID NO: 55631 - RNA, 19 nt, Artificial Sequence
  Synthetic
ggcgcgcccccccccaacg

SEQ ID NO: 55632 - RNA, 20 nt, Artificial Sequence
  Synthetic
uggcgcgcccccccccaacg

SEQ ID NO: 55633 - RNA, 21 nt, Artificial Sequence
  Synthetic
cuggcgcgcccccccccaacg

SEQ ID NO: 55634 - RNA, 22 nt, Artificial Sequence
  Synthetic
gcuggcgcgcccccccccaacg

SEQ ID NO: 55635 - RNA, 23 nt, Artificial Sequence
  Synthetic
agcuggcgcgcccccccccaacg

SEQ ID NO: 55636 - RNA, 24 nt, Artificial Sequence
  Synthetic
cagcuggcgcgcccccccccaacg

SEQ ID NO: 55637 - RNA, 18 nt, Artificial Sequence
  Synthetic
gggagaagaaacggaacg

SEQ ID NO: 55638 - RNA, 19 nt, Artificial Sequence
  Synthetic
agggagaagaaacggaacg

SEQ ID NO: 55639 - RNA, 20 nt, Artificial Sequence
  Synthetic
gagggagaagaaacggaacg

SEQ ID NO: 55640 - RNA, 21 nt, Artificial Sequence
  Synthetic
ggagggagaagaaacggaacg

SEQ ID NO: 55641 - RNA, 22 nt, Artificial Sequence
  Synthetic
gggagggagaagaaacggaacg

SEQ ID NO: 55642 - RNA, 23 nt, Artificial Sequence
  Synthetic
cgggagggagaagaaacggaacg

SEQ ID NO: 55643 - RNA, 24 nt, Artificial Sequence
  Synthetic
ccgggagggagaagaaacggaacg

SEQ ID NO: 55644 - RNA, 18 nt, Artificial Sequence
  Synthetic
gcacggcgcccgcaaccg

SEQ ID NO: 55645 - RNA, 19 nt, Artificial Sequence
  Synthetic
ggcacggcgcccgcaaccg

SEQ ID NO: 55646 - RNA, 20 nt, Artificial Sequence
  Synthetic
gggcacggcgcccgcaaccg

SEQ ID NO: 55647 - RNA, 21 nt, Artificial Sequence
  Synthetic
cgggcacggcgcccgcaaccg

SEQ ID NO: 55648 - RNA, 22 nt, Artificial Sequence
  Synthetic
ccgggcacggcgcccgcaaccg

SEQ ID NO: 55649 - RNA, 23 nt, Artificial Sequence
  Synthetic
uccgggcacggcgcccgcaaccg

SEQ ID NO: 55650 - RNA, 24 nt, Artificial Sequence
  Synthetic
cuccgggcacggcgcccgcaaccg

SEQ ID NO: 55651 - RNA, 18 nt, Artificial Sequence
  Synthetic
ggggcccgggccggaccg

SEQ ID NO: 55652 - RNA, 19 nt, Artificial Sequence
  Synthetic
gggggcccgggccggaccg

SEQ ID NO: 55653 - RNA, 20 nt, Artificial Sequence
  Synthetic
cgggggcccgggccggaccg

SEQ ID NO: 55654 - RNA, 21 nt, Artificial Sequence
  Synthetic
ccgggggcccgggccggaccg

SEQ ID NO: 55655 - RNA, 22 nt, Artificial Sequence
  Synthetic
gccgggggcccgggccggaccg

SEQ ID NO: 55656 - RNA, 23 nt, Artificial Sequence
  Synthetic
cgccgggggcccgggccggaccg

SEQ ID NO: 55657 - RNA, 24 nt, Artificial Sequence
  Synthetic
ccgccgggggcccgggccggaccg

SEQ ID NO: 55658 - RNA, 18 nt, Artificial Sequence
  Synthetic
ccggccgccggaugcccg

SEQ ID NO: 55659 - RNA, 19 nt, Artificial Sequence
  Synthetic
gccggccgccggaugcccg

SEQ ID NO: 55660 - RNA, 20 nt, Artificial Sequence
  Synthetic
ggccggccgccggaugcccg

SEQ ID NO: 55661 - RNA, 21 nt, Artificial Sequence
  Synthetic
gggccggccgccggaugcccg

SEQ ID NO: 55662 - RNA, 22 nt, Artificial Sequence
  Synthetic
ggggccggccgccggaugcccg

SEQ ID NO: 55663 - RNA, 23 nt, Artificial Sequence
  Synthetic
uggggccggccgccggaugcccg

SEQ ID NO: 55664 - RNA, 24 nt, Artificial Sequence
  Synthetic
guggggccggccgccggaugcccg

SEQ ID NO: 55665 - RNA, 18 nt, Artificial Sequence
  Synthetic
cgcgaacgcgcggcgccg

SEQ ID NO: 55666 - RNA, 19 nt, Artificial Sequence
  Synthetic
ucgcgaacgcgcggcgccg

SEQ ID NO: 55667 - RNA, 20 nt, Artificial Sequence
  Synthetic
uucgcgaacgcgcggcgccg

SEQ ID NO: 55668 - RNA, 21 nt, Artificial Sequence
  Synthetic
uuucgcgaacgcgcggcgccg

SEQ ID NO: 55669 - RNA, 22 nt, Artificial Sequence
  Synthetic
cuuucgcgaacgcgcggcgccg

SEQ ID NO: 55670 - RNA, 23 nt, Artificial Sequence
  Synthetic
ccuuucgcgaacgcgcggcgccg

SEQ ID NO: 55671 - RNA, 24 nt, Artificial Sequence
  Synthetic
gccuuucgcgaacgcgcggcgccg

SEQ ID NO: 55672 - RNA, 18 nt, Artificial Sequence
  Synthetic
cgccggagggggcggccg

SEQ ID NO: 55673 - RNA, 19 nt, Artificial Sequence
  Synthetic
gcgccggagggggcggccg

SEQ ID NO: 55674 - RNA, 20 nt, Artificial Sequence
  Synthetic
ggcgccggagggggcggccg

SEQ ID NO: 55675 - RNA, 21 nt, Artificial Sequence
  Synthetic
cggcgccggagggggcggccg

SEQ ID NO: 55676 - RNA, 22 nt, Artificial Sequence
  Synthetic
gcggcgccggagggggcggccg

SEQ ID NO: 55677 - RNA, 23 nt, Artificial Sequence
  Synthetic
cgcggcgccggagggggcggccg

SEQ ID NO: 55678 - RNA, 24 nt, Artificial Sequence
  Synthetic
gcgcggcgccggagggggcggccg

SEQ ID NO: 55679 - RNA, 18 nt, Artificial Sequence
  Synthetic
cggggcccccgcgcuccg

SEQ ID NO: 55680 - RNA, 19 nt, Artificial Sequence
  Synthetic
ccggggcccccgcgcuccg

SEQ ID NO: 55681 - RNA, 20 nt, Artificial Sequence
  Synthetic
cccggggcccccgcgcuccg

SEQ ID NO: 55682 - RNA, 21 nt, Artificial Sequence
  Synthetic
ccccggggcccccgcgcuccg

SEQ ID NO: 55683 - RNA, 22 nt, Artificial Sequence
  Synthetic
gccccggggcccccgcgcuccg

SEQ ID NO: 55684 - RNA, 23 nt, Artificial Sequence
  Synthetic
ggccccggggcccccgcgcuccg

SEQ ID NO: 55685 - RNA, 24 nt, Artificial Sequence
  Synthetic
gggccccggggcccccgcgcuccg

SEQ ID NO: 55686 - RNA, 18 nt, Artificial Sequence
  Synthetic
ggcggacccucggaggcg

SEQ ID NO: 55687 - RNA, 19 nt, Artificial Sequence
  Synthetic
aggcggacccucggaggcg

SEQ ID NO: 55688 - RNA, 20 nt, Artificial Sequence
  Synthetic
gaggcggacccucggaggcg

SEQ ID NO: 55689 - RNA, 21 nt, Artificial Sequence
  Synthetic
agaggcggacccucggaggcg

SEQ ID NO: 55690 - RNA, 22 nt, Artificial Sequence
  Synthetic
cagaggcggacccucggaggcg

SEQ ID NO: 55691 - RNA, 23 nt, Artificial Sequence
  Synthetic
gcagaggcggacccucggaggcg

SEQ ID NO: 55692 - RNA, 24 nt, Artificial Sequence
  Synthetic
ggcagaggcggacccucggaggcg

SEQ ID NO: 55693 - RNA, 18 nt, Artificial Sequence
  Synthetic
ggaagaagacgggaggcg

SEQ ID NO: 55694 - RNA, 19 nt, Artificial Sequence
  Synthetic
cggaagaagacgggaggcg

SEQ ID NO: 55695 - RNA, 20 nt, Artificial Sequence
  Synthetic
gcggaagaagacgggaggcg

SEQ ID NO: 55696 - RNA, 21 nt, Artificial Sequence
  Synthetic
cgcggaagaagacgggaggcg

SEQ ID NO: 55697 - RNA, 22 nt, Artificial Sequence
  Synthetic
gcgcggaagaagacgggaggcg

SEQ ID NO: 55698 - RNA, 23 nt, Artificial Sequence
  Synthetic
ggcgcggaagaagacgggaggcg

SEQ ID NO: 55699 - RNA, 24 nt, Artificial Sequence
  Synthetic
aggcgcggaagaagacgggaggcg

SEQ ID NO: 55700 - RNA, 18 nt, Artificial Sequence
  Synthetic
gacgccuuccgcccggcg

SEQ ID NO: 55701 - RNA, 19 nt, Artificial Sequence
  Synthetic
ggacgccuuccgcccggcg

SEQ ID NO: 55702 - RNA, 20 nt, Artificial Sequence
  Synthetic
gggacgccuuccgcccggcg

SEQ ID NO: 55703 - RNA, 21 nt, Artificial Sequence
  Synthetic
ggggacgccuuccgcccggcg

SEQ ID NO: 55704 - RNA, 22 nt, Artificial Sequence
  Synthetic
gggggacgccuuccgcccggcg

SEQ ID NO: 55705 - RNA, 23 nt, Artificial Sequence
  Synthetic
cgggggacgccuuccgcccggcg

SEQ ID NO: 55706 - RNA, 24 nt, Artificial Sequence
  Synthetic
gcgggggacgccuuccgcccggcg

SEQ ID NO: 55707 - RNA, 18 nt, Artificial Sequence
  Synthetic
ucuccgccgcggccggcg

SEQ ID NO: 55708 - RNA, 19 nt, Artificial Sequence
  Synthetic
cucuccgccgcggccggcg

SEQ ID NO: 55709 - RNA, 20 nt, Artificial Sequence
  Synthetic
ucucuccgccgcggccggcg

SEQ ID NO: 55710 - RNA, 21 nt, Artificial Sequence
  Synthetic
uucucuccgccgcggccggcg

SEQ ID NO: 55711 - RNA, 22 nt, Artificial Sequence
  Synthetic
guucucuccgccgcggccggcg

SEQ ID NO: 55712 - RNA, 23 nt, Artificial Sequence
  Synthetic
gguucucuccgccgcggccggcg

SEQ ID NO: 55713 - RNA, 24 nt, Artificial Sequence
  Synthetic
ggguucucuccgccgcggccggcg

SEQ ID NO: 55714 - RNA, 18 nt, Artificial Sequence
  Synthetic
uuucgcgaacgcgcggcg

SEQ ID NO: 55715 - RNA, 19 nt, Artificial Sequence
  Synthetic
cuuucgcgaacgcgcggcg

SEQ ID NO: 55716 - RNA, 20 nt, Artificial Sequence
  Synthetic
ccuuucgcgaacgcgcggcg

SEQ ID NO: 55717 - RNA, 21 nt, Artificial Sequence
  Synthetic
gccuuucgcgaacgcgcggcg

SEQ ID NO: 55718 - RNA, 22 nt, Artificial Sequence
  Synthetic
cgccuuucgcgaacgcgcggcg

SEQ ID NO: 55719 - RNA, 23 nt, Artificial Sequence
  Synthetic
gcgccuuucgcgaacgcgcggcg

SEQ ID NO: 55720 - RNA, 24 nt, Artificial Sequence
  Synthetic
cgcgccuuucgcgaacgcgcggcg

SEQ ID NO: 55721 - RNA, 18 nt, Artificial Sequence
  Synthetic
agucccucucgaucggcg

SEQ ID NO: 55722 - RNA, 19 nt, Artificial Sequence
  Synthetic
gagucccucucgaucggcg

SEQ ID NO: 55723 - RNA, 20 nt, Artificial Sequence
  Synthetic
ggagucccucucgaucggcg

SEQ ID NO: 55724 - RNA, 21 nt, Artificial Sequence
  Synthetic
cggagucccucucgaucggcg

SEQ ID NO: 55725 - RNA, 22 nt, Artificial Sequence
  Synthetic
ccggagucccucucgaucggcg

SEQ ID NO: 55726 - RNA, 23 nt, Artificial Sequence
  Synthetic
uccggagucccucucgaucggcg

SEQ ID NO: 55727 - RNA, 24 nt, Artificial Sequence
  Synthetic
cuccggagucccucucgaucggcg

SEQ ID NO: 55728 - RNA, 18 nt, Artificial Sequence
  Synthetic
guguuuaauggaagggcg

SEQ ID NO: 55729 - RNA, 19 nt, Artificial Sequence
  Synthetic
aguguuuaauggaagggcg

SEQ ID NO: 55730 - RNA, 20 nt, Artificial Sequence
  Synthetic
gaguguuuaauggaagggcg

SEQ ID NO: 55731 - RNA, 21 nt, Artificial Sequence
  Synthetic
ggaguguuuaauggaagggcg

SEQ ID NO: 55732 - RNA, 22 nt, Artificial Sequence
  Synthetic
gggaguguuuaauggaagggcg

SEQ ID NO: 55733 - RNA, 23 nt, Artificial Sequence
  Synthetic
ugggaguguuuaauggaagggcg

SEQ ID NO: 55734 - RNA, 24 nt, Artificial Sequence
  Synthetic
gugggaguguuuaauggaagggcg

SEQ ID NO: 55735 - RNA, 18 nt, Artificial Sequence
  Synthetic
gggccggaccgccgggcg

SEQ ID NO: 55736 - RNA, 19 nt, Artificial Sequence
  Synthetic
cgggccggaccgccgggcg

SEQ ID NO: 55737 - RNA, 20 nt, Artificial Sequence
  Synthetic
ccgggccggaccgccgggcg

SEQ ID NO: 55738 - RNA, 21 nt, Artificial Sequence
  Synthetic
cccgggccggaccgccgggcg

SEQ ID NO: 55739 - RNA, 22 nt, Artificial Sequence
  Synthetic
gcccgggccggaccgccgggcg

SEQ ID NO: 55740 - RNA, 23 nt, Artificial Sequence
  Synthetic
ggcccgggccggaccgccgggcg

SEQ ID NO: 55741 - RNA, 24 nt, Artificial Sequence
  Synthetic
gggcccgggccggaccgccgggcg

SEQ ID NO: 55742 - RNA, 18 nt, Artificial Sequence
  Synthetic
ccgcgggggccuaaugcg

SEQ ID NO: 55743 - RNA, 19 nt, Artificial Sequence
  Synthetic
cccgcgggggccuaaugcg

SEQ ID NO: 55744 - RNA, 20 nt, Artificial Sequence
  Synthetic
gcccgcgggggccuaaugcg

SEQ ID NO: 55745 - RNA, 21 nt, Artificial Sequence
  Synthetic
ugcccgcgggggccuaaugcg

SEQ ID NO: 55746 - RNA, 22 nt, Artificial Sequence
  Synthetic
augcccgcgggggccuaaugcg

SEQ ID NO: 55747 - RNA, 23 nt, Artificial Sequence
  Synthetic
gaugcccgcgggggccuaaugcg

SEQ ID NO: 55748 - RNA, 24 nt, Artificial Sequence
  Synthetic
ggaugcccgcgggggccuaaugcg

SEQ ID NO: 55749 - RNA, 18 nt, Artificial Sequence
  Synthetic
gaagggcgcgccggugcg

SEQ ID NO: 55750 - RNA, 19 nt, Artificial Sequence
  Synthetic
agaagggcgcgccggugcg

SEQ ID NO: 55751 - RNA, 20 nt, Artificial Sequence
  Synthetic
gagaagggcgcgccggugcg

SEQ ID NO: 55752 - RNA, 21 nt, Artificial Sequence
  Synthetic
ggagaagggcgcgccggugcg

SEQ ID NO: 55753 - RNA, 22 nt, Artificial Sequence
  Synthetic
aggagaagggcgcgccggugcg

SEQ ID NO: 55754 - RNA, 23 nt, Artificial Sequence
  Synthetic
gaggagaagggcgcgccggugcg

SEQ ID NO: 55755 - RNA, 24 nt, Artificial Sequence
  Synthetic
agaggagaagggcgcgccggugcg

SEQ ID NO: 55756 - RNA, 18 nt, Artificial Sequence
  Synthetic
gaggcgggggaaaaaagg

SEQ ID NO: 55757 - RNA, 19 nt, Artificial Sequence
  Synthetic
ggaggcgggggaaaaaagg

SEQ ID NO: 55758 - RNA, 20 nt, Artificial Sequence
  Synthetic
gggaggcgggggaaaaaagg

SEQ ID NO: 55759 - RNA, 21 nt, Artificial Sequence
  Synthetic
cgggaggcgggggaaaaaagg

SEQ ID NO: 55760 - RNA, 22 nt, Artificial Sequence
  Synthetic
acgggaggcgggggaaaaaagg

SEQ ID NO: 55761 - RNA, 23 nt, Artificial Sequence
  Synthetic
gacgggaggcgggggaaaaaagg

SEQ ID NO: 55762 - RNA, 24 nt, Artificial Sequence
  Synthetic
agacgggaggcgggggaaaaaagg

SEQ ID NO: 55763 - RNA, 18 nt, Artificial Sequence
  Synthetic
aaaaagggggaagagagg

SEQ ID NO: 55764 - RNA, 19 nt, Artificial Sequence
  Synthetic
aaaaaagggggaagagagg

SEQ ID NO: 55765 - RNA, 20 nt, Artificial Sequence
  Synthetic
gaaaaaagggggaagagagg

SEQ ID NO: 55766 - RNA, 21 nt, Artificial Sequence
  Synthetic
ggaaaaaagggggaagagagg

SEQ ID NO: 55767 - RNA, 22 nt, Artificial Sequence
  Synthetic
gggaaaaaagggggaagagagg

SEQ ID NO: 55768 - RNA, 23 nt, Artificial Sequence
  Synthetic
ggggaaaaaagggggaagagagg

SEQ ID NO: 55769 - RNA, 24 nt, Artificial Sequence
  Synthetic
gggggaaaaaagggggaagagagg

SEQ ID NO: 55770 - RNA, 18 nt, Artificial Sequence
  Synthetic
gcccggggguccccgagg

SEQ ID NO: 55771 - RNA, 19 nt, Artificial Sequence
  Synthetic
cgcccggggguccccgagg

SEQ ID NO: 55772 - RNA, 20 nt, Artificial Sequence
  Synthetic
ccgcccggggguccccgagg

SEQ ID NO: 55773 - RNA, 21 nt, Artificial Sequence
  Synthetic
cccgcccggggguccccgagg

SEQ ID NO: 55774 - RNA, 22 nt, Artificial Sequence
  Synthetic
gcccgcccggggguccccgagg

SEQ ID NO: 55775 - RNA, 23 nt, Artificial Sequence
  Synthetic
ggcccgcccggggguccccgagg

SEQ ID NO: 55776 - RNA, 24 nt, Artificial Sequence
  Synthetic
cggcccgcccggggguccccgagg

SEQ ID NO: 55777 - RNA, 18 nt, Artificial Sequence
  Synthetic
gcggaagaagacgggagg

SEQ ID NO: 55778 - RNA, 19 nt, Artificial Sequence
  Synthetic
cgcggaagaagacgggagg

SEQ ID NO: 55779 - RNA, 20 nt, Artificial Sequence
  Synthetic
gcgcggaagaagacgggagg

SEQ ID NO: 55780 - RNA, 21 nt, Artificial Sequence
  Synthetic
ggcgcggaagaagacgggagg

SEQ ID NO: 55781 - RNA, 22 nt, Artificial Sequence
  Synthetic
aggcgcggaagaagacgggagg

SEQ ID NO: 55782 - RNA, 23 nt, Artificial Sequence
  Synthetic
gaggcgcggaagaagacgggagg

SEQ ID NO: 55783 - RNA, 24 nt, Artificial Sequence
  Synthetic
ggaggcgcggaagaagacgggagg

SEQ ID NO: 55784 - RNA, 18 nt, Artificial Sequence
  Synthetic
agcggggcggccgggagg

SEQ ID NO: 55785 - RNA, 19 nt, Artificial Sequence
  Synthetic
gagcggggcggccgggagg

SEQ ID NO: 55786 - RNA, 20 nt, Artificial Sequence
  Synthetic
ggagcggggcggccgggagg

SEQ ID NO: 55787 - RNA, 21 nt, Artificial Sequence
  Synthetic
gggagcggggcggccgggagg

SEQ ID NO: 55788 - RNA, 22 nt, Artificial Sequence
  Synthetic
cgggagcggggcggccgggagg

SEQ ID NO: 55789 - RNA, 23 nt, Artificial Sequence
  Synthetic
ccgggagcggggcggccgggagg

SEQ ID NO: 55790 - RNA, 24 nt, Artificial Sequence
  Synthetic
cccgggagcggggcggccgggagg

SEQ ID NO: 55791 - RNA, 18 nt, Artificial Sequence
  Synthetic
ggggaagagagggggagg

SEQ ID NO: 55792 - RNA, 19 nt, Artificial Sequence
  Synthetic
gggggaagagagggggagg

SEQ ID NO: 55793 - RNA, 20 nt, Artificial Sequence
  Synthetic
agggggaagagagggggagg

SEQ ID NO: 55794 - RNA, 21 nt, Artificial Sequence
  Synthetic
aagggggaagagagggggagg

SEQ ID NO: 55795 - RNA, 22 nt, Artificial Sequence
  Synthetic
aaagggggaagagagggggagg

SEQ ID NO: 55796 - RNA, 23 nt, Artificial Sequence
  Synthetic
aaaagggggaagagagggggagg

SEQ ID NO: 55797 - RNA, 24 nt, Artificial Sequence
  Synthetic
aaaaagggggaagagagggggagg

SEQ ID NO: 55798 - RNA, 18 nt, Artificial Sequence
  Synthetic
aagagagggggagguagg

SEQ ID NO: 55799 - RNA, 19 nt, Artificial Sequence
  Synthetic
gaagagagggggagguagg

SEQ ID NO: 55800 - RNA, 20 nt, Artificial Sequence
  Synthetic
ggaagagagggggagguagg

SEQ ID NO: 55801 - RNA, 21 nt, Artificial Sequence
  Synthetic
gggaagagagggggagguagg

SEQ ID NO: 55802 - RNA, 22 nt, Artificial Sequence
  Synthetic
ggggaagagagggggagguagg

SEQ ID NO: 55803 - RNA, 23 nt, Artificial Sequence
  Synthetic
gggggaagagagggggagguagg

SEQ ID NO: 55804 - RNA, 24 nt, Artificial Sequence
  Synthetic
agggggaagagagggggagguagg

SEQ ID NO: 55805 - RNA, 18 nt, Artificial Sequence
  Synthetic
gcuacccgggacccccgg

SEQ ID NO: 55806 - RNA, 19 nt, Artificial Sequence
  Synthetic
ggcuacccgggacccccgg

SEQ ID NO: 55807 - RNA, 20 nt, Artificial Sequence
  Synthetic
cggcuacccgggacccccgg

SEQ ID NO: 55808 - RNA, 21 nt, Artificial Sequence
  Synthetic
gcggcuacccgggacccccgg

SEQ ID NO: 55809 - RNA, 22 nt, Artificial Sequence
  Synthetic
ggcggcuacccgggacccccgg

SEQ ID NO: 55810 - RNA, 23 nt, Artificial Sequence
  Synthetic
gggcggcuacccgggacccccgg

SEQ ID NO: 55811 - RNA, 24 nt, Artificial Sequence
  Synthetic
cgggcggcuacccgggacccccgg

SEQ ID NO: 55812 - RNA, 18 nt, Artificial Sequence
  Synthetic
cccgggccggaccgccgg

SEQ ID NO: 55813 - RNA, 19 nt, Artificial Sequence
  Synthetic
gcccgggccggaccgccgg

SEQ ID NO: 55814 - RNA, 20 nt, Artificial Sequence
  Synthetic
ggcccgggccggaccgccgg

SEQ ID NO: 55815 - RNA, 21 nt, Artificial Sequence
  Synthetic
gggcccgggccggaccgccgg

SEQ ID NO: 55816 - RNA, 22 nt, Artificial Sequence
  Synthetic
ggggcccgggccggaccgccgg

SEQ ID NO: 55817 - RNA, 23 nt, Artificial Sequence
  Synthetic
gggggcccgggccggaccgccgg

SEQ ID NO: 55818 - RNA, 24 nt, Artificial Sequence
  Synthetic
cgggggcccgggccggaccgccgg

SEQ ID NO: 55819 - RNA, 18 nt, Artificial Sequence
  Synthetic
gcgaacgcgcggcgccgg

SEQ ID NO: 55820 - RNA, 19 nt, Artificial Sequence
  Synthetic
cgcgaacgcgcggcgccgg

SEQ ID NO: 55821 - RNA, 20 nt, Artificial Sequence
  Synthetic
ucgcgaacgcgcggcgccgg

SEQ ID NO: 55822 - RNA, 21 nt, Artificial Sequence
  Synthetic
uucgcgaacgcgcggcgccgg

SEQ ID NO: 55823 - RNA, 22 nt, Artificial Sequence
  Synthetic
uuucgcgaacgcgcggcgccgg

SEQ ID NO: 55824 - RNA, 23 nt, Artificial Sequence
  Synthetic
cuuucgcgaacgcgcggcgccgg

SEQ ID NO: 55825 - RNA, 24 nt, Artificial Sequence
  Synthetic
ccuuucgcgaacgcgcggcgccgg

SEQ ID NO: 55826 - RNA, 18 nt, Artificial Sequence
  Synthetic
cgggagcggggcggccgg

SEQ ID NO: 55827 - RNA, 19 nt, Artificial Sequence
  Synthetic
ccgggagcggggcggccgg

SEQ ID NO: 55828 - RNA, 20 nt, Artificial Sequence
  Synthetic
cccgggagcggggcggccgg

SEQ ID NO: 55829 - RNA, 21 nt, Artificial Sequence
  Synthetic
gcccgggagcggggcggccgg

SEQ ID NO: 55830 - RNA, 22 nt, Artificial Sequence
  Synthetic
ggcccgggagcggggcggccgg

SEQ ID NO: 55831 - RNA, 23 nt, Artificial Sequence
  Synthetic
gggcccgggagcggggcggccgg

SEQ ID NO: 55832 - RNA, 24 nt, Artificial Sequence
  Synthetic
cgggcccgggagcggggcggccgg

SEQ ID NO: 55833 - RNA, 18 nt, Artificial Sequence
  Synthetic
gugcgggggccccuccgg

SEQ ID NO: 55834 - RNA, 19 nt, Artificial Sequence
  Synthetic
ggugcgggggccccuccgg

SEQ ID NO: 55835 - RNA, 20 nt, Artificial Sequence
  Synthetic
aggugcgggggccccuccgg

SEQ ID NO: 55836 - RNA, 21 nt, Artificial Sequence
  Synthetic
gaggugcgggggccccuccgg

SEQ ID NO: 55837 - RNA, 22 nt, Artificial Sequence
  Synthetic
cgaggugcgggggccccuccgg

SEQ ID NO: 55838 - RNA, 23 nt, Artificial Sequence
  Synthetic
ccgaggugcgggggccccuccgg

SEQ ID NO: 55839 - RNA, 24 nt, Artificial Sequence
  Synthetic
gccgaggugcgggggccccuccgg

SEQ ID NO: 55840 - RNA, 18 nt, Artificial Sequence
  Synthetic
gcccacagcaacacgcgg

SEQ ID NO: 55841 - RNA, 19 nt, Artificial Sequence
  Synthetic
ugcccacagcaacacgcgg

SEQ ID NO: 55842 - RNA, 20 nt, Artificial Sequence
  Synthetic
augcccacagcaacacgcgg

SEQ ID NO: 55843 - RNA, 21 nt, Artificial Sequence
  Synthetic
aaugcccacagcaacacgcgg

SEQ ID NO: 55844 - RNA, 22 nt, Artificial Sequence
  Synthetic
aaaugcccacagcaacacgcgg

SEQ ID NO: 55845 - RNA, 23 nt, Artificial Sequence
  Synthetic
gaaaugcccacagcaacacgcgg

SEQ ID NO: 55846 - RNA, 24 nt, Artificial Sequence
  Synthetic
agaaaugcccacagcaacacgcgg

SEQ ID NO: 55847 - RNA, 18 nt, Artificial Sequence
  Synthetic
ggacccucggaggcgcgg

SEQ ID NO: 55848 - RNA, 19 nt, Artificial Sequence
  Synthetic
cggacccucggaggcgcgg

SEQ ID NO: 55849 - RNA, 20 nt, Artificial Sequence
  Synthetic
gcggacccucggaggcgcgg

SEQ ID NO: 55850 - RNA, 21 nt, Artificial Sequence
  Synthetic
ggcggacccucggaggcgcgg

SEQ ID NO: 55851 - RNA, 22 nt, Artificial Sequence
  Synthetic
aggcggacccucggaggcgcgg

SEQ ID NO: 55852 - RNA, 23 nt, Artificial Sequence
  Synthetic
gaggcggacccucggaggcgcgg

SEQ ID NO: 55853 - RNA, 24 nt, Artificial Sequence
  Synthetic
agaggcggacccucggaggcgcgg

SEQ ID NO: 55854 - RNA, 18 nt, Artificial Sequence
  Synthetic
gaagaagacgggaggcgg

SEQ ID NO: 55855 - RNA, 19 nt, Artificial Sequence
  Synthetic
ggaagaagacgggaggcgg

SEQ ID NO: 55856 - RNA, 20 nt, Artificial Sequence
  Synthetic
cggaagaagacgggaggcgg

SEQ ID NO: 55857 - RNA, 21 nt, Artificial Sequence
  Synthetic
gcggaagaagacgggaggcgg

SEQ ID NO: 55858 - RNA, 22 nt, Artificial Sequence
  Synthetic
cgcggaagaagacgggaggcgg

SEQ ID NO: 55859 - RNA, 23 nt, Artificial Sequence
  Synthetic
gcgcggaagaagacgggaggcgg

SEQ ID NO: 55860 - RNA, 24 nt, Artificial Sequence
  Synthetic
ggcgcggaagaagacgggaggcgg

SEQ ID NO: 55861 - RNA, 18 nt, Artificial Sequence
  Synthetic
ggcccgggagcggggcgg

SEQ ID NO: 55862 - RNA, 19 nt, Artificial Sequence
  Synthetic
gggcccgggagcggggcgg

SEQ ID NO: 55863 - RNA, 20 nt, Artificial Sequence
  Synthetic
cgggcccgggagcggggcgg

SEQ ID NO: 55864 - RNA, 18 nt, Artificial Sequence
  Synthetic
cgcgggggccuaaugcgg

SEQ ID NO: 55865 - RNA, 19 nt, Artificial Sequence
  Synthetic
ccgcgggggccuaaugcgg

SEQ ID NO: 55866 - RNA, 20 nt, Artificial Sequence
  Synthetic
cccgcgggggccuaaugcgg

SEQ ID NO: 55867 - RNA, 21 nt, Artificial Sequence
  Synthetic
gcccgcgggggccuaaugcgg

SEQ ID NO: 55868 - RNA, 22 nt, Artificial Sequence
  Synthetic
ugcccgcgggggccuaaugcgg

SEQ ID NO: 55869 - RNA, 23 nt, Artificial Sequence
  Synthetic
augcccgcgggggccuaaugcgg

SEQ ID NO: 55870 - RNA, 24 nt, Artificial Sequence
  Synthetic
gaugcccgcgggggccuaaugcgg

SEQ ID NO: 55871 - RNA, 18 nt, Artificial Sequence
  Synthetic
agggggagguagggaggg

SEQ ID NO: 55872 - RNA, 19 nt, Artificial Sequence
  Synthetic
gagggggagguagggaggg

SEQ ID NO: 55873 - RNA, 20 nt, Artificial Sequence
  Synthetic
agagggggagguagggaggg

SEQ ID NO: 55874 - RNA, 21 nt, Artificial Sequence
  Synthetic
gagagggggagguagggaggg

SEQ ID NO: 55875 - RNA, 22 nt, Artificial Sequence
  Synthetic
agagagggggagguagggaggg

SEQ ID NO: 55876 - RNA, 23 nt, Artificial Sequence
  Synthetic
aagagagggggagguagggaggg

SEQ ID NO: 55877 - RNA, 24 nt, Artificial Sequence
  Synthetic
gaagagagggggagguagggaggg

SEQ ID NO: 55878 - RNA, 18 nt, Artificial Sequence
  Synthetic
agagagggggagguaggg

SEQ ID NO: 55879 - RNA, 19 nt, Artificial Sequence
  Synthetic
aagagagggggagguaggg

SEQ ID NO: 55880 - RNA, 20 nt, Artificial Sequence
  Synthetic
gaagagagggggagguaggg

SEQ ID NO: 55881 - RNA, 21 nt, Artificial Sequence
  Synthetic
ggaagagagggggagguaggg

SEQ ID NO: 55882 - RNA, 22 nt, Artificial Sequence
  Synthetic
gggaagagagggggagguaggg

SEQ ID NO: 55883 - RNA, 23 nt, Artificial Sequence
  Synthetic
ggggaagagagggggagguaggg

SEQ ID NO: 55884 - RNA, 24 nt, Artificial Sequence
  Synthetic
gggggaagagagggggagguaggg

SEQ ID NO: 55885 - RNA, 18 nt, Artificial Sequence
  Synthetic
cuccgccgggggcccggg

SEQ ID NO: 55886 - RNA, 19 nt, Artificial Sequence
  Synthetic
gcuccgccgggggcccggg

SEQ ID NO: 55887 - RNA, 20 nt, Artificial Sequence
  Synthetic
cgcuccgccgggggcccggg

SEQ ID NO: 55888 - RNA, 21 nt, Artificial Sequence
  Synthetic
gcgcuccgccgggggcccggg

SEQ ID NO: 55889 - RNA, 22 nt, Artificial Sequence
  Synthetic
cgcgcuccgccgggggcccggg

SEQ ID NO: 55890 - RNA, 23 nt, Artificial Sequence
  Synthetic
ccgcgcuccgccgggggcccggg

SEQ ID NO: 55891 - RNA, 24 nt, Artificial Sequence
  Synthetic
cccgcgcuccgccgggggcccggg

SEQ ID NO: 55892 - RNA, 18 nt, Artificial Sequence
  Synthetic
ccgggccggaccgccggg

SEQ ID NO: 55893 - RNA, 19 nt, Artificial Sequence
  Synthetic
cccgggccggaccgccggg

SEQ ID NO: 55894 - RNA, 20 nt, Artificial Sequence
  Synthetic
gcccgggccggaccgccggg

SEQ ID NO: 55895 - RNA, 21 nt, Artificial Sequence
  Synthetic
ggcccgggccggaccgccggg

SEQ ID NO: 55896 - RNA, 22 nt, Artificial Sequence
  Synthetic
gggcccgggccggaccgccggg

SEQ ID NO: 55897 - RNA, 23 nt, Artificial Sequence
  Synthetic
ggggcccgggccggaccgccggg

SEQ ID NO: 55898 - RNA, 24 nt, Artificial Sequence
  Synthetic
gggggcccgggccggaccgccggg

SEQ ID NO: 55899 - RNA, 18 nt, Artificial Sequence
  Synthetic
gggagcggggcggccggg

SEQ ID NO: 55900 - RNA, 19 nt, Artificial Sequence
  Synthetic
cgggagcggggcggccggg

SEQ ID NO: 55901 - RNA, 20 nt, Artificial Sequence
  Synthetic
ccgggagcggggcggccggg

SEQ ID NO: 55902 - RNA, 21 nt, Artificial Sequence
  Synthetic
cccgggagcggggcggccggg

SEQ ID NO: 55903 - RNA, 22 nt, Artificial Sequence
  Synthetic
gcccgggagcggggcggccggg

SEQ ID NO: 55904 - RNA, 23 nt, Artificial Sequence
  Synthetic
ggcccgggagcggggcggccggg

SEQ ID NO: 55905 - RNA, 24 nt, Artificial Sequence
  Synthetic
gggcccgggagcggggcggccggg

SEQ ID NO: 55906 - RNA, 18 nt, Artificial Sequence
  Synthetic
cccacagcaacacgcggg

SEQ ID NO: 55907 - RNA, 19 nt, Artificial Sequence
  Synthetic
gcccacagcaacacgcggg

SEQ ID NO: 55908 - RNA, 20 nt, Artificial Sequence
  Synthetic
ugcccacagcaacacgcggg

SEQ ID NO: 55909 - RNA, 21 nt, Artificial Sequence
  Synthetic
augcccacagcaacacgcggg

SEQ ID NO: 55910 - RNA, 22 nt, Artificial Sequence
  Synthetic
aaugcccacagcaacacgcggg

SEQ ID NO: 55911 - RNA, 23 nt, Artificial Sequence
  Synthetic
aaaugcccacagcaacacgcggg

SEQ ID NO: 55912 - RNA, 24 nt, Artificial Sequence
  Synthetic
gaaaugcccacagcaacacgcggg

SEQ ID NO: 55913 - RNA, 18 nt, Artificial Sequence
  Synthetic
gcgggggaaaaaaggggg

SEQ ID NO: 55914 - RNA, 19 nt, Artificial Sequence
  Synthetic
ggcgggggaaaaaaggggg

SEQ ID NO: 55915 - RNA, 20 nt, Artificial Sequence
  Synthetic
aggcgggggaaaaaaggggg

SEQ ID NO: 55916 - RNA, 21 nt, Artificial Sequence
  Synthetic
gaggcgggggaaaaaaggggg

SEQ ID NO: 55917 - RNA, 22 nt, Artificial Sequence
  Synthetic
ggaggcgggggaaaaaaggggg

SEQ ID NO: 55918 - RNA, 23 nt, Artificial Sequence
  Synthetic
gggaggcgggggaaaaaaggggg

SEQ ID NO: 55919 - RNA, 24 nt, Artificial Sequence
  Synthetic
cgggaggcgggggaaaaaaggggg

SEQ ID NO: 55920 - RNA, 18 nt, Artificial Sequence
  Synthetic
cgugggaguguuuaaugg

SEQ ID NO: 55921 - RNA, 19 nt, Artificial Sequence
  Synthetic
acgugggaguguuuaaugg

SEQ ID NO: 55922 - RNA, 20 nt, Artificial Sequence
  Synthetic
aacgugggaguguuuaaugg

SEQ ID NO: 55923 - RNA, 21 nt, Artificial Sequence
  Synthetic
caacgugggaguguuuaaugg

SEQ ID NO: 55924 - RNA, 22 nt, Artificial Sequence
  Synthetic
ccaacgugggaguguuuaaugg

SEQ ID NO: 55925 - RNA, 23 nt, Artificial Sequence
  Synthetic
cccaacgugggaguguuuaaugg

SEQ ID NO: 55926 - RNA, 24 nt, Artificial Sequence
  Synthetic
ccccaacgugggaguguuuaaugg

SEQ ID NO: 55927 - RNA, 18 nt, Artificial Sequence
  Synthetic
ggggcggccgccgaggug

SEQ ID NO: 55928 - RNA, 19 nt, Artificial Sequence
  Synthetic
gggggcggccgccgaggug

SEQ ID NO: 55929 - RNA, 20 nt, Artificial Sequence
  Synthetic
agggggcggccgccgaggug

SEQ ID NO: 55930 - RNA, 21 nt, Artificial Sequence
  Synthetic
gagggggcggccgccgaggug

SEQ ID NO: 55931 - RNA, 22 nt, Artificial Sequence
  Synthetic
ggagggggcggccgccgaggug

SEQ ID NO: 55932 - RNA, 23 nt, Artificial Sequence
  Synthetic
cggagggggcggccgccgaggug

SEQ ID NO: 55933 - RNA, 24 nt, Artificial Sequence
  Synthetic
ccggagggggcggccgccgaggug

SEQ ID NO: 55934 - RNA, 18 nt, Artificial Sequence
  Synthetic
gaggcagaggcggacccu

SEQ ID NO: 55935 - RNA, 19 nt, Artificial Sequence
  Synthetic
cgaggcagaggcggacccu

SEQ ID NO: 55936 - RNA, 20 nt, Artificial Sequence
  Synthetic
ccgaggcagaggcggacccu

SEQ ID NO: 55937 - RNA, 21 nt, Artificial Sequence
  Synthetic
cccgaggcagaggcggacccu

SEQ ID NO: 55938 - RNA, 22 nt, Artificial Sequence
  Synthetic
ccccgaggcagaggcggacccu

SEQ ID NO: 55939 - RNA, 23 nt, Artificial Sequence
  Synthetic
uccccgaggcagaggcggacccu

SEQ ID NO: 55940 - RNA, 24 nt, Artificial Sequence
  Synthetic
guccccgaggcagaggcggacccu

SEQ ID NO: 55941 - RNA, 18 nt, Artificial Sequence
  Synthetic
gggaaucgaaaaaagccu

SEQ ID NO: 55942 - RNA, 19 nt, Artificial Sequence
  Synthetic
cgggaaucgaaaaaagccu

SEQ ID NO: 55943 - RNA, 20 nt, Artificial Sequence
  Synthetic
ccgggaaucgaaaaaagccu

SEQ ID NO: 55944 - RNA, 21 nt, Artificial Sequence
  Synthetic
gccgggaaucgaaaaaagccu

SEQ ID NO: 55945 - RNA, 22 nt, Artificial Sequence
  Synthetic
ggccgggaaucgaaaaaagccu

SEQ ID NO: 55946 - RNA, 23 nt, Artificial Sequence
  Synthetic
cggccgggaaucgaaaaaagccu

SEQ ID NO: 55947 - RNA, 24 nt, Artificial Sequence
  Synthetic
ccggccgggaaucgaaaaaagccu

SEQ ID NO: 55948 - RNA, 18 nt, Artificial Sequence
  Synthetic
cggcugcggccgcgggcu

SEQ ID NO: 55949 - RNA, 19 nt, Artificial Sequence
  Synthetic
ucggcugcggccgcgggcu

SEQ ID NO: 55950 - RNA, 20 nt, Artificial Sequence
  Synthetic
cucggcugcggccgcgggcu

SEQ ID NO: 55951 - RNA, 21 nt, Artificial Sequence
  Synthetic
gcucggcugcggccgcgggcu

SEQ ID NO: 55952 - RNA, 22 nt, Artificial Sequence
  Synthetic
ugcucggcugcggccgcgggcu

SEQ ID NO: 55953 - RNA, 23 nt, Artificial Sequence
  Synthetic
cugcucggcugcggccgcgggcu

SEQ ID NO: 55954 - RNA, 24 nt, Artificial Sequence
  Synthetic
gcugcucggcugcggccgcgggcu

SEQ ID NO: 55955 - RNA, 18 nt, Artificial Sequence
  Synthetic
cggcggcuuaauggaucu

SEQ ID NO: 55956 - RNA, 19 nt, Artificial Sequence
  Synthetic
ccggcggcuuaauggaucu

SEQ ID NO: 55957 - RNA, 20 nt, Artificial Sequence
  Synthetic
uccggcggcuuaauggaucu

SEQ ID NO: 55958 - RNA, 21 nt, Artificial Sequence
  Synthetic
cuccggcggcuuaauggaucu

SEQ ID NO: 55959 - RNA, 22 nt, Artificial Sequence
  Synthetic
ucuccggcggcuuaauggaucu

SEQ ID NO: 55960 - RNA, 23 nt, Artificial Sequence
  Synthetic
cucuccggcggcuuaauggaucu

SEQ ID NO: 55961 - RNA, 24 nt, Artificial Sequence
  Synthetic
gcucuccggcggcuuaauggaucu

SEQ ID NO: 55962 - RNA, 18 nt, Artificial Sequence
  Synthetic
cggagcagccuuccuucu

SEQ ID NO: 55963 - RNA, 19 nt, Artificial Sequence
  Synthetic
gcggagcagccuuccuucu

SEQ ID NO: 55964 - RNA, 20 nt, Artificial Sequence
  Synthetic
cgcggagcagccuuccuucu

SEQ ID NO: 55965 - RNA, 21 nt, Artificial Sequence
  Synthetic
gcgcggagcagccuuccuucu

SEQ ID NO: 55966 - RNA, 22 nt, Artificial Sequence
  Synthetic
ugcgcggagcagccuuccuucu

SEQ ID NO: 55967 - RNA, 23 nt, Artificial Sequence
  Synthetic
gugcgcggagcagccuuccuucu

SEQ ID NO: 55968 - RNA, 24 nt, Artificial Sequence
  Synthetic
ggugcgcggagcagccuuccuucu

SEQ ID NO: 55969 - RNA, 18 nt, Artificial Sequence
  Synthetic
gggggcggccgccgaggu

SEQ ID NO: 55970 - RNA, 19 nt, Artificial Sequence
  Synthetic
agggggcggccgccgaggu

SEQ ID NO: 55971 - RNA, 20 nt, Artificial Sequence
  Synthetic
gagggggcggccgccgaggu

SEQ ID NO: 55972 - RNA, 21 nt, Artificial Sequence
  Synthetic
ggagggggcggccgccgaggu

SEQ ID NO: 55973 - RNA, 22 nt, Artificial Sequence
  Synthetic
cggagggggcggccgccgaggu

SEQ ID NO: 55974 - RNA, 23 nt, Artificial Sequence
  Synthetic
ccggagggggcggccgccgaggu

SEQ ID NO: 55975 - RNA, 24 nt, Artificial Sequence
  Synthetic
gccggagggggcggccgccgaggu

SEQ ID NO: 55976 - RNA, 18 nt, Artificial Sequence
  Synthetic
gggaagagagggggaggu

SEQ ID NO: 55977 - RNA, 19 nt, Artificial Sequence
  Synthetic
ggggaagagagggggaggu

SEQ ID NO: 55978 - RNA, 20 nt, Artificial Sequence
  Synthetic
gggggaagagagggggaggu

SEQ ID NO: 55979 - RNA, 21 nt, Artificial Sequence
  Synthetic
agggggaagagagggggaggu

SEQ ID NO: 55980 - RNA, 22 nt, Artificial Sequence
  Synthetic
aagggggaagagagggggaggu

SEQ ID NO: 55981 - RNA, 23 nt, Artificial Sequence
  Synthetic
aaagggggaagagagggggaggu

SEQ ID NO: 55982 - RNA, 24 nt, Artificial Sequence
  Synthetic
aaaagggggaagagagggggaggu

SEQ ID NO: 55983 - RNA, 18 nt, Artificial Sequence
  Synthetic
agggaaagcaacgggaaa

SEQ ID NO: 55984 - RNA, 19 nt, Artificial Sequence
  Synthetic
gagggaaagcaacgggaaa

SEQ ID NO: 55985 - RNA, 20 nt, Artificial Sequence
  Synthetic
agagggaaagcaacgggaaa

SEQ ID NO: 55986 - RNA, 21 nt, Artificial Sequence
  Synthetic
gagagggaaagcaacgggaaa

SEQ ID NO: 55987 - RNA, 22 nt, Artificial Sequence
  Synthetic
ggagagggaaagcaacgggaaa

SEQ ID NO: 55988 - RNA, 23 nt, Artificial Sequence
  Synthetic
gggagagggaaagcaacgggaaa

SEQ ID NO: 55989 - RNA, 24 nt, Artificial Sequence
  Synthetic
ggggagagggaaagcaacgggaaa

SEQ ID NO: 55990 - RNA, 18 nt, Artificial Sequence
  Synthetic
gggggagagggaaagcaa

SEQ ID NO: 55991 - RNA, 19 nt, Artificial Sequence
  Synthetic
ggggggagagggaaagcaa

SEQ ID NO: 55992 - RNA, 20 nt, Artificial Sequence
  Synthetic
gggggggagagggaaagcaa

SEQ ID NO: 55993 - RNA, 21 nt, Artificial Sequence
  Synthetic
ggggggggagagggaaagcaa

SEQ ID NO: 55994 - RNA, 22 nt, Artificial Sequence
  Synthetic
gggggggggagagggaaagcaa

SEQ ID NO: 55995 - RNA, 23 nt, Artificial Sequence
  Synthetic
ggggggggggagagggaaagcaa

SEQ ID NO: 55996 - RNA, 24 nt, Artificial Sequence
  Synthetic
gggggggggggagagggaaagcaa

SEQ ID NO: 55997 - RNA, 18 nt, Artificial Sequence
  Synthetic
cgcgcggaaaagcagcaa

SEQ ID NO: 55998 - RNA, 19 nt, Artificial Sequence
  Synthetic
gcgcgcggaaaagcagcaa

SEQ ID NO: 55999 - RNA, 20 nt, Artificial Sequence
  Synthetic
ggcgcgcggaaaagcagcaa

SEQ ID NO: 56000 - RNA, 21 nt, Artificial Sequence
  Synthetic
aggcgcgcggaaaagcagcaa

SEQ ID NO: 56001 - RNA, 22 nt, Artificial Sequence
  Synthetic
gaggcgcgcggaaaagcagcaa

SEQ ID NO: 56002 - RNA, 23 nt, Artificial Sequence
  Synthetic
agaggcgcgcggaaaagcagcaa

SEQ ID NO: 56003 - RNA, 24 nt, Artificial Sequence
  Synthetic
gagaggcgcgcggaaaagcagcaa

SEQ ID NO: 56004 - RNA, 18 nt, Artificial Sequence
  Synthetic
guucgcgaaaggcgcgaa

SEQ ID NO: 56005 - RNA, 19 nt, Artificial Sequence
  Synthetic
cguucgcgaaaggcgcgaa

SEQ ID NO: 56006 - RNA, 20 nt, Artificial Sequence
  Synthetic
gcguucgcgaaaggcgcgaa

SEQ ID NO: 56007 - RNA, 21 nt, Artificial Sequence
  Synthetic
cgcguucgcgaaaggcgcgaa

SEQ ID NO: 56008 - RNA, 22 nt, Artificial Sequence
  Synthetic
gcgcguucgcgaaaggcgcgaa

SEQ ID NO: 56009 - RNA, 23 nt, Artificial Sequence
  Synthetic
cgcgcguucgcgaaaggcgcgaa

SEQ ID NO: 56010 - RNA, 24 nt, Artificial Sequence
  Synthetic
ccgcgcguucgcgaaaggcgcgaa

SEQ ID NO: 56011 - RNA, 18 nt, Artificial Sequence
  Synthetic
ggggggagagggaaagca

SEQ ID NO: 56012 - RNA, 19 nt, Artificial Sequence
  Synthetic
gggggggagagggaaagca

SEQ ID NO: 56013 - RNA, 20 nt, Artificial Sequence
  Synthetic
ggggggggagagggaaagca

SEQ ID NO: 56014 - RNA, 21 nt, Artificial Sequence
  Synthetic
gggggggggagagggaaagca

SEQ ID NO: 56015 - RNA, 22 nt, Artificial Sequence
  Synthetic
ggggggggggagagggaaagca

SEQ ID NO: 56016 - RNA, 23 nt, Artificial Sequence
  Synthetic
gggggggggggagagggaaagca

SEQ ID NO: 56017 - RNA, 24 nt, Artificial Sequence
  Synthetic
ggggggggggggagagggaaagca

SEQ ID NO: 56018 - RNA, 18 nt, Artificial Sequence
  Synthetic
accgggggcgcggcagca

SEQ ID NO: 56019 - RNA, 19 nt, Artificial Sequence
  Synthetic
aaccgggggcgcggcagca

SEQ ID NO: 56020 - RNA, 20 nt, Artificial Sequence
  Synthetic
aaaccgggggcgcggcagca

SEQ ID NO: 56021 - RNA, 21 nt, Artificial Sequence
  Synthetic
aaaaccgggggcgcggcagca

SEQ ID NO: 56022 - RNA, 22 nt, Artificial Sequence
  Synthetic
uaaaaccgggggcgcggcagca

SEQ ID NO: 56023 - RNA, 23 nt, Artificial Sequence
  Synthetic
auaaaaccgggggcgcggcagca

SEQ ID NO: 56024 - RNA, 24 nt, Artificial Sequence
  Synthetic
uauaaaaccgggggcgcggcagca

SEQ ID NO: 56025 - RNA, 18 nt, Artificial Sequence
  Synthetic
cgcggaaaagcagcaaga

SEQ ID NO: 56026 - RNA, 19 nt, Artificial Sequence
  Synthetic
gcgcggaaaagcagcaaga

SEQ ID NO: 56027 - RNA, 20 nt, Artificial Sequence
  Synthetic
cgcgcggaaaagcagcaaga

SEQ ID NO: 56028 - RNA, 21 nt, Artificial Sequence
  Synthetic
gcgcgcggaaaagcagcaaga

SEQ ID NO: 56029 - RNA, 22 nt, Artificial Sequence
  Synthetic
ggcgcgcggaaaagcagcaaga

SEQ ID NO: 56030 - RNA, 23 nt, Artificial Sequence
  Synthetic
aggcgcgcggaaaagcagcaaga

SEQ ID NO: 56031 - RNA, 24 nt, Artificial Sequence
  Synthetic
gaggcgcgcggaaaagcagcaaga

SEQ ID NO: 56032 - RNA, 18 nt, Artificial Sequence
  Synthetic
gagagagagagagagaga

SEQ ID NO: 56033 - RNA, 19 nt, Artificial Sequence
  Synthetic
agagagagagagagagaga

SEQ ID NO: 56034 - RNA, 20 nt, Artificial Sequence
  Synthetic
gagagagagagagagagaga

SEQ ID NO: 56035 - RNA, 21 nt, Artificial Sequence
  Synthetic
agagagagagagagagagaga

SEQ ID NO: 56036 - RNA, 22 nt, Artificial Sequence
  Synthetic
gagagagagagagagagagaga

SEQ ID NO: 56037 - RNA, 23 nt, Artificial Sequence
  Synthetic
agagagagagagagagagagaga

SEQ ID NO: 56038 - RNA, 24 nt, Artificial Sequence
  Synthetic
gagagagagagagagagagagaga

SEQ ID NO: 56039 - RNA, 23 nt, Artificial Sequence
  Synthetic
ggagagagagagagagagagaga

SEQ ID NO: 56040 - RNA, 24 nt, Artificial Sequence
  Synthetic
cggagagagagagagagagagaga

SEQ ID NO: 56041 - RNA, 21 nt, Artificial Sequence
  Synthetic
ggagagagagagagagagaga

SEQ ID NO: 56042 - RNA, 22 nt, Artificial Sequence
  Synthetic
cggagagagagagagagagaga

SEQ ID NO: 56043 - RNA, 23 nt, Artificial Sequence
  Synthetic
gcggagagagagagagagagaga

SEQ ID NO: 56044 - RNA, 24 nt, Artificial Sequence
  Synthetic
ggcggagagagagagagagagaga

SEQ ID NO: 56045 - RNA, 19 nt, Artificial Sequence
  Synthetic
ggagagagagagagagaga

SEQ ID NO: 56046 - RNA, 20 nt, Artificial Sequence
  Synthetic
cggagagagagagagagaga

SEQ ID NO: 56047 - RNA, 21 nt, Artificial Sequence
  Synthetic
gcggagagagagagagagaga

SEQ ID NO: 56048 - RNA, 22 nt, Artificial Sequence
  Synthetic
ggcggagagagagagagagaga

SEQ ID NO: 56049 - RNA, 23 nt, Artificial Sequence
  Synthetic
uggcggagagagagagagagaga

SEQ ID NO: 56050 - RNA, 24 nt, Artificial Sequence
  Synthetic
auggcggagagagagagagagaga

SEQ ID NO: 56051 - RNA, 18 nt, Artificial Sequence
  Synthetic
cggagagagagagagaga

SEQ ID NO: 56052 - RNA, 19 nt, Artificial Sequence
  Synthetic
gcggagagagagagagaga

SEQ ID NO: 56053 - RNA, 20 nt, Artificial Sequence
  Synthetic
ggcggagagagagagagaga

SEQ ID NO: 56054 - RNA, 21 nt, Artificial Sequence
  Synthetic
uggcggagagagagagagaga

SEQ ID NO: 56055 - RNA, 22 nt, Artificial Sequence
  Synthetic
auggcggagagagagagagaga

SEQ ID NO: 56056 - RNA, 23 nt, Artificial Sequence
  Synthetic
gauggcggagagagagagagaga

SEQ ID NO: 56057 - RNA, 24 nt, Artificial Sequence
  Synthetic
ggauggcggagagagagagagaga

SEQ ID NO: 56058 - RNA, 18 nt, Artificial Sequence
  Synthetic
ggcggagagagagagaga

SEQ ID NO: 56059 - RNA, 19 nt, Artificial Sequence
  Synthetic
uggcggagagagagagaga

SEQ ID NO: 56060 - RNA, 20 nt, Artificial Sequence
  Synthetic
auggcggagagagagagaga

SEQ ID NO: 56061 - RNA, 18 nt, Artificial Sequence
  Synthetic
auggcggagagagagaga

SEQ ID NO: 56062 - RNA, 19 nt, Artificial Sequence
  Synthetic
gauggcggagagagagaga

SEQ ID NO: 56063 - RNA, 20 nt, Artificial Sequence
  Synthetic
ggauggcggagagagagaga

SEQ ID NO: 56064 - RNA, 18 nt, Artificial Sequence
  Synthetic
cgagagggacuccggaga

SEQ ID NO: 56065 - RNA, 19 nt, Artificial Sequence
  Synthetic
ucgagagggacuccggaga

SEQ ID NO: 56066 - RNA, 20 nt, Artificial Sequence
  Synthetic
aucgagagggacuccggaga

SEQ ID NO: 56067 - RNA, 21 nt, Artificial Sequence
  Synthetic
gaucgagagggacuccggaga

SEQ ID NO: 56068 - RNA, 22 nt, Artificial Sequence
  Synthetic
cgaucgagagggacuccggaga

SEQ ID NO: 56069 - RNA, 23 nt, Artificial Sequence
  Synthetic
ccgaucgagagggacuccggaga

SEQ ID NO: 56070 - RNA, 24 nt, Artificial Sequence
  Synthetic
gccgaucgagagggacuccggaga

SEQ ID NO: 56071 - RNA, 18 nt, Artificial Sequence
  Synthetic
gagggggggggggggaga

SEQ ID NO: 56072 - RNA, 19 nt, Artificial Sequence
  Synthetic
agagggggggggggggaga

SEQ ID NO: 56073 - RNA, 20 nt, Artificial Sequence
  Synthetic
gagagggggggggggggaga

SEQ ID NO: 56074 - RNA, 21 nt, Artificial Sequence
  Synthetic
agagagggggggggggggaga

SEQ ID NO: 56075 - RNA, 22 nt, Artificial Sequence
  Synthetic
gagagagggggggggggggaga

SEQ ID NO: 56076 - RNA, 23 nt, Artificial Sequence
  Synthetic
agagagagggggggggggggaga

SEQ ID NO: 56077 - RNA, 24 nt, Artificial Sequence
  Synthetic
gagagagagggggggggggggaga

SEQ ID NO: 56078 - RNA, 18 nt, Artificial Sequence
  Synthetic
gcaggggcccgccgccga

SEQ ID NO: 56079 - RNA, 19 nt, Artificial Sequence
  Synthetic
cgcaggggcccgccgccga

SEQ ID NO: 56080 - RNA, 20 nt, Artificial Sequence
  Synthetic
acgcaggggcccgccgccga

SEQ ID NO: 56081 - RNA, 21 nt, Artificial Sequence
  Synthetic
aacgcaggggcccgccgccga

SEQ ID NO: 56082 - RNA, 22 nt, Artificial Sequence
  Synthetic
gaacgcaggggcccgccgccga

SEQ ID NO: 56083 - RNA, 23 nt, Artificial Sequence
  Synthetic
cgaacgcaggggcccgccgccga

SEQ ID NO: 56084 - RNA, 24 nt, Artificial Sequence
  Synthetic
acgaacgcaggggcccgccgccga

SEQ ID NO: 56085 - RNA, 18 nt, Artificial Sequence
  Synthetic
cguucgcgaaaggcgcga

SEQ ID NO: 56086 - RNA, 19 nt, Artificial Sequence
  Synthetic
gcguucgcgaaaggcgcga

SEQ ID NO: 56087 - RNA, 20 nt, Artificial Sequence
  Synthetic
cgcguucgcgaaaggcgcga

SEQ ID NO: 56088 - RNA, 21 nt, Artificial Sequence
  Synthetic
gcgcguucgcgaaaggcgcga

SEQ ID NO: 56089 - RNA, 22 nt, Artificial Sequence
  Synthetic
cgcgcguucgcgaaaggcgcga

SEQ ID NO: 56090 - RNA, 23 nt, Artificial Sequence
  Synthetic
ccgcgcguucgcgaaaggcgcga

SEQ ID NO: 56091 - RNA, 24 nt, Artificial Sequence
  Synthetic
gccgcgcguucgcgaaaggcgcga

SEQ ID NO: 56092 - RNA, 18 nt, Artificial Sequence
  Synthetic
gggcccgccgccgaucga

SEQ ID NO: 56093 - RNA, 19 nt, Artificial Sequence
  Synthetic
ggggcccgccgccgaucga

SEQ ID NO: 56094 - RNA, 20 nt, Artificial Sequence
  Synthetic
aggggcccgccgccgaucga

SEQ ID NO: 56095 - RNA, 21 nt, Artificial Sequence
  Synthetic
caggggcccgccgccgaucga

SEQ ID NO: 56096 - RNA, 22 nt, Artificial Sequence
  Synthetic
gcaggggcccgccgccgaucga

SEQ ID NO: 56097 - RNA, 23 nt, Artificial Sequence
  Synthetic
cgcaggggcccgccgccgaucga

SEQ ID NO: 56098 - RNA, 24 nt, Artificial Sequence
  Synthetic
acgcaggggcccgccgccgaucga

SEQ ID NO: 56099 - RNA, 18 nt, Artificial Sequence
  Synthetic
cgcgccggccgcggcgga

SEQ ID NO: 56100 - RNA, 19 nt, Artificial Sequence
  Synthetic
ccgcgccggccgcggcgga

SEQ ID NO: 56101 - RNA, 20 nt, Artificial Sequence
  Synthetic
cccgcgccggccgcggcgga

SEQ ID NO: 56102 - RNA, 21 nt, Artificial Sequence
  Synthetic
ccccgcgccggccgcggcgga

SEQ ID NO: 56103 - RNA, 22 nt, Artificial Sequence
  Synthetic
gccccgcgccggccgcggcgga

SEQ ID NO: 56104 - RNA, 23 nt, Artificial Sequence
  Synthetic
cgccccgcgccggccgcggcgga

SEQ ID NO: 56105 - RNA, 24 nt, Artificial Sequence
  Synthetic
acgccccgcgccggccgcggcgga

SEQ ID NO: 56106 - RNA, 18 nt, Artificial Sequence
  Synthetic
agagggaaagcaacggga

SEQ ID NO: 56107 - RNA, 19 nt, Artificial Sequence
  Synthetic
gagagggaaagcaacggga

SEQ ID NO: 56108 - RNA, 20 nt, Artificial Sequence
  Synthetic
ggagagggaaagcaacggga

SEQ ID NO: 56109 - RNA, 21 nt, Artificial Sequence
  Synthetic
gggagagggaaagcaacggga

SEQ ID NO: 56110 - RNA, 22 nt, Artificial Sequence
  Synthetic
ggggagagggaaagcaacggga

SEQ ID NO: 56111 - RNA, 23 nt, Artificial Sequence
  Synthetic
gggggagagggaaagcaacggga

SEQ ID NO: 56112 - RNA, 24 nt, Artificial Sequence
  Synthetic
ggggggagagggaaagcaacggga

SEQ ID NO: 56113 - RNA, 18 nt, Artificial Sequence
  Synthetic
aagcagcaagagggggga

SEQ ID NO: 56114 - RNA, 19 nt, Artificial Sequence
  Synthetic
aaagcagcaagagggggga

SEQ ID NO: 56115 - RNA, 20 nt, Artificial Sequence
  Synthetic
aaaagcagcaagagggggga

SEQ ID NO: 56116 - RNA, 21 nt, Artificial Sequence
  Synthetic
gaaaagcagcaagagggggga

SEQ ID NO: 56117 - RNA, 22 nt, Artificial Sequence
  Synthetic
ggaaaagcagcaagagggggga

SEQ ID NO: 56118 - RNA, 23 nt, Artificial Sequence
  Synthetic
cggaaaagcagcaagagggggga

SEQ ID NO: 56119 - RNA, 24 nt, Artificial Sequence
  Synthetic
gcggaaaagcagcaagagggggga

SEQ ID NO: 56120 - RNA, 18 nt, Artificial Sequence
  Synthetic
gagaggggggggggggga

SEQ ID NO: 56121 - RNA, 19 nt, Artificial Sequence
  Synthetic
agagaggggggggggggga

SEQ ID NO: 56122 - RNA, 20 nt, Artificial Sequence
  Synthetic
gagagaggggggggggggga

SEQ ID NO: 56123 - RNA, 21 nt, Artificial Sequence
  Synthetic
agagagaggggggggggggga

SEQ ID NO: 56124 - RNA, 22 nt, Artificial Sequence
  Synthetic
gagagagaggggggggggggga

SEQ ID NO: 56125 - RNA, 23 nt, Artificial Sequence
  Synthetic
agagagagaggggggggggggga

SEQ ID NO: 56126 - RNA, 24 nt, Artificial Sequence
  Synthetic
gagagagagaggggggggggggga

SEQ ID NO: 56127 - RNA, 18 nt, Artificial Sequence
  Synthetic
ggggagagggaaagcaac

SEQ ID NO: 56128 - RNA, 19 nt, Artificial Sequence
  Synthetic
gggggagagggaaagcaac

SEQ ID NO: 56129 - RNA, 20 nt, Artificial Sequence
  Synthetic
ggggggagagggaaagcaac

SEQ ID NO: 56130 - RNA, 21 nt, Artificial Sequence
  Synthetic
gggggggagagggaaagcaac

SEQ ID NO: 56131 - RNA, 22 nt, Artificial Sequence
  Synthetic
ggggggggagagggaaagcaac

SEQ ID NO: 56132 - RNA, 23 nt, Artificial Sequence
  Synthetic
gggggggggagagggaaagcaac

SEQ ID NO: 56133 - RNA, 24 nt, Artificial Sequence
  Synthetic
ggggggggggagagggaaagcaac

SEQ ID NO: 56134 - RNA, 18 nt, Artificial Sequence
  Synthetic
ccucugccucggggaccc

SEQ ID NO: 56135 - RNA, 19 nt, Artificial Sequence
  Synthetic
gccucugccucggggaccc

SEQ ID NO: 56136 - RNA, 20 nt, Artificial Sequence
  Synthetic
cgccucugccucggggaccc

SEQ ID NO: 56137 - RNA, 21 nt, Artificial Sequence
  Synthetic
ccgccucugccucggggaccc

SEQ ID NO: 56138 - RNA, 22 nt, Artificial Sequence
  Synthetic
uccgccucugccucggggaccc

SEQ ID NO: 56139 - RNA, 23 nt, Artificial Sequence
  Synthetic
guccgccucugccucggggaccc

SEQ ID NO: 56140 - RNA, 24 nt, Artificial Sequence
  Synthetic
gguccgccucugccucggggaccc

SEQ ID NO: 56141 - RNA, 18 nt, Artificial Sequence
  Synthetic
ccgccgcauuaggccccc

SEQ ID NO: 56142 - RNA, 19 nt, Artificial Sequence
  Synthetic
cccgccgcauuaggccccc

SEQ ID NO: 56143 - RNA, 20 nt, Artificial Sequence
  Synthetic
ucccgccgcauuaggccccc

SEQ ID NO: 56144 - RNA, 21 nt, Artificial Sequence
  Synthetic
cucccgccgcauuaggccccc

SEQ ID NO: 56145 - RNA, 22 nt, Artificial Sequence
  Synthetic
ccucccgccgcauuaggccccc

SEQ ID NO: 56146 - RNA, 23 nt, Artificial Sequence
  Synthetic
gccucccgccgcauuaggccccc

SEQ ID NO: 56147 - RNA, 24 nt, Artificial Sequence
  Synthetic
cgccucccgccgcauuaggccccc

SEQ ID NO: 56148 - RNA, 18 nt, Artificial Sequence
  Synthetic
ggcagagugcggagcccc

SEQ ID NO: 56149 - RNA, 19 nt, Artificial Sequence
  Synthetic
gggcagagugcggagcccc

SEQ ID NO: 56150 - RNA, 20 nt, Artificial Sequence
  Synthetic
cgggcagagugcggagcccc

SEQ ID NO: 56151 - RNA, 21 nt, Artificial Sequence
  Synthetic
ccgggcagagugcggagcccc

SEQ ID NO: 56152 - RNA, 22 nt, Artificial Sequence
  Synthetic
gccgggcagagugcggagcccc

SEQ ID NO: 56153 - RNA, 23 nt, Artificial Sequence
  Synthetic
agccgggcagagugcggagcccc

SEQ ID NO: 56154 - RNA, 24 nt, Artificial Sequence
  Synthetic
gagccgggcagagugcggagcccc

SEQ ID NO: 56155 - RNA, 18 nt, Artificial Sequence
  Synthetic
aggcgcgaaaggggcccc

SEQ ID NO: 56156 - RNA, 19 nt, Artificial Sequence
  Synthetic
aaggcgcgaaaggggcccc

SEQ ID NO: 56157 - RNA, 20 nt, Artificial Sequence
  Synthetic
aaaggcgcgaaaggggcccc

SEQ ID NO: 56158 - RNA, 21 nt, Artificial Sequence
  Synthetic
gaaaggcgcgaaaggggcccc

SEQ ID NO: 56159 - RNA, 22 nt, Artificial Sequence
  Synthetic
cgaaaggcgcgaaaggggcccc

SEQ ID NO: 56160 - RNA, 23 nt, Artificial Sequence
  Synthetic
gcgaaaggcgcgaaaggggcccc

SEQ ID NO: 56161 - RNA, 24 nt, Artificial Sequence
  Synthetic
cgcgaaaggcgcgaaaggggcccc

SEQ ID NO: 56162 - RNA, 18 nt, Artificial Sequence
  Synthetic
gggcagagugcggagccc

SEQ ID NO: 56163 - RNA, 19 nt, Artificial Sequence
  Synthetic
cgggcagagugcggagccc

SEQ ID NO: 56164 - RNA, 20 nt, Artificial Sequence
  Synthetic
ccgggcagagugcggagccc

SEQ ID NO: 56165 - RNA, 21 nt, Artificial Sequence
  Synthetic
gccgggcagagugcggagccc

SEQ ID NO: 56166 - RNA, 22 nt, Artificial Sequence
  Synthetic
agccgggcagagugcggagccc

SEQ ID NO: 56167 - RNA, 23 nt, Artificial Sequence
  Synthetic
gagccgggcagagugcggagccc

SEQ ID NO: 56168 - RNA, 24 nt, Artificial Sequence
  Synthetic
cgagccgggcagagugcggagccc

SEQ ID NO: 56169 - RNA, 18 nt, Artificial Sequence
  Synthetic
aaggcgcgaaaggggccc

SEQ ID NO: 56170 - RNA, 19 nt, Artificial Sequence
  Synthetic
aaaggcgcgaaaggggccc

SEQ ID NO: 56171 - RNA, 20 nt, Artificial Sequence
  Synthetic
gaaaggcgcgaaaggggccc

SEQ ID NO: 56172 - RNA, 21 nt, Artificial Sequence
  Synthetic
cgaaaggcgcgaaaggggccc

SEQ ID NO: 56173 - RNA, 22 nt, Artificial Sequence
  Synthetic
gcgaaaggcgcgaaaggggccc

SEQ ID NO: 56174 - RNA, 23 nt, Artificial Sequence
  Synthetic
cgcgaaaggcgcgaaaggggccc

SEQ ID NO: 56175 - RNA, 24 nt, Artificial Sequence
  Synthetic
ucgcgaaaggcgcgaaaggggccc

SEQ ID NO: 56176 - RNA, 18 nt, Artificial Sequence
  Synthetic
ggcggagcgcgggggccc

SEQ ID NO: 56177 - RNA, 19 nt, Artificial Sequence
  Synthetic
cggcggagcgcgggggccc

SEQ ID NO: 56178 - RNA, 20 nt, Artificial Sequence
  Synthetic
ccggcggagcgcgggggccc

SEQ ID NO: 56179 - RNA, 21 nt, Artificial Sequence
  Synthetic
cccggcggagcgcgggggccc

SEQ ID NO: 56180 - RNA, 22 nt, Artificial Sequence
  Synthetic
ccccggcggagcgcgggggccc

SEQ ID NO: 56181 - RNA, 23 nt, Artificial Sequence
  Synthetic
cccccggcggagcgcgggggccc

SEQ ID NO: 56182 - RNA, 24 nt, Artificial Sequence
  Synthetic
gcccccggcggagcgcgggggccc

SEQ ID NO: 56183 - RNA, 18 nt, Artificial Sequence
  Synthetic
ccgcagccgagcagcgcc

SEQ ID NO: 56184 - RNA, 19 nt, Artificial Sequence
  Synthetic
gccgcagccgagcagcgcc

SEQ ID NO: 56185 - RNA, 20 nt, Artificial Sequence
  Synthetic
ggccgcagccgagcagcgcc

SEQ ID NO: 56186 - RNA, 21 nt, Artificial Sequence
  Synthetic
cggccgcagccgagcagcgcc

SEQ ID NO: 56187 - RNA, 22 nt, Artificial Sequence
  Synthetic
gcggccgcagccgagcagcgcc

SEQ ID NO: 56188 - RNA, 23 nt, Artificial Sequence
  Synthetic
cgcggccgcagccgagcagcgcc

SEQ ID NO: 56189 - RNA, 24 nt, Artificial Sequence
  Synthetic
ccgcggccgcagccgagcagcgcc

SEQ ID NO: 56190 - RNA, 18 nt, Artificial Sequence
  Synthetic
cgggccagcagacgggcc

SEQ ID NO: 56191 - RNA, 19 nt, Artificial Sequence
  Synthetic
gcgggccagcagacgggcc

SEQ ID NO: 56192 - RNA, 20 nt, Artificial Sequence
  Synthetic
cgcgggccagcagacgggcc

SEQ ID NO: 56193 - RNA, 21 nt, Artificial Sequence
  Synthetic
ccgcgggccagcagacgggcc

SEQ ID NO: 56194 - RNA, 22 nt, Artificial Sequence
  Synthetic
gccgcgggccagcagacgggcc

SEQ ID NO: 56195 - RNA, 23 nt, Artificial Sequence
  Synthetic
ggccgcgggccagcagacgggcc

SEQ ID NO: 56196 - RNA, 24 nt, Artificial Sequence
  Synthetic
uggccgcgggccagcagacgggcc

SEQ ID NO: 56197 - RNA, 18 nt, Artificial Sequence
  Synthetic
cgcgggggccccggggcc

SEQ ID NO: 56198 - RNA, 19 nt, Artificial Sequence
  Synthetic
gcgcgggggccccggggcc

SEQ ID NO: 56199 - RNA, 20 nt, Artificial Sequence
  Synthetic
agcgcgggggccccggggcc

SEQ ID NO: 56200 - RNA, 21 nt, Artificial Sequence
  Synthetic
gagcgcgggggccccggggcc

SEQ ID NO: 56201 - RNA, 22 nt, Artificial Sequence
  Synthetic
ggagcgcgggggccccggggcc

SEQ ID NO: 56202 - RNA, 23 nt, Artificial Sequence
  Synthetic
cggagcgcgggggccccggggcc

SEQ ID NO: 56203 - RNA, 24 nt, Artificial Sequence
  Synthetic
gcggagcgcgggggccccggggcc

SEQ ID NO: 56204 - RNA, 18 nt, Artificial Sequence
  Synthetic
cggcggagcgcgggggcc

SEQ ID NO: 56205 - RNA, 19 nt, Artificial Sequence
  Synthetic
ccggcggagcgcgggggcc

SEQ ID NO: 56206 - RNA, 20 nt, Artificial Sequence
  Synthetic
cccggcggagcgcgggggcc

SEQ ID NO: 56207 - RNA, 21 nt, Artificial Sequence
  Synthetic
ccccggcggagcgcgggggcc

SEQ ID NO: 56208 - RNA, 22 nt, Artificial Sequence
  Synthetic
cccccggcggagcgcgggggcc

SEQ ID NO: 56209 - RNA, 23 nt, Artificial Sequence
  Synthetic
gcccccggcggagcgcgggggcc

SEQ ID NO: 56210 - RNA, 24 nt, Artificial Sequence
  Synthetic
ggcccccggcggagcgcgggggcc

SEQ ID NO: 56211 - RNA, 18 nt, Artificial Sequence
  Synthetic
gucauuguuuacguggcc

SEQ ID NO: 56212 - RNA, 19 nt, Artificial Sequence
  Synthetic
ugucauuguuuacguggcc

SEQ ID NO: 56213 - RNA, 20 nt, Artificial Sequence
  Synthetic
gugucauuguuuacguggcc

SEQ ID NO: 56214 - RNA, 21 nt, Artificial Sequence
  Synthetic
ugugucauuguuuacguggcc

SEQ ID NO: 56215 - RNA, 22 nt, Artificial Sequence
  Synthetic
cugugucauuguuuacguggcc

SEQ ID NO: 56216 - RNA, 23 nt, Artificial Sequence
  Synthetic
ccugugucauuguuuacguggcc

SEQ ID NO: 56217 - RNA, 24 nt, Artificial Sequence
  Synthetic
cccugugucauuguuuacguggcc

SEQ ID NO: 56218 - RNA, 18 nt, Artificial Sequence
  Synthetic
cgaggguccgccucugcc

SEQ ID NO: 56219 - RNA, 19 nt, Artificial Sequence
  Synthetic
ccgaggguccgccucugcc

SEQ ID NO: 56220 - RNA, 20 nt, Artificial Sequence
  Synthetic
uccgaggguccgccucugcc

SEQ ID NO: 56221 - RNA, 21 nt, Artificial Sequence
  Synthetic
cuccgaggguccgccucugcc

SEQ ID NO: 56222 - RNA, 22 nt, Artificial Sequence
  Synthetic
ccuccgaggguccgccucugcc

SEQ ID NO: 56223 - RNA, 23 nt, Artificial Sequence
  Synthetic
gccuccgaggguccgccucugcc

SEQ ID NO: 56224 - RNA, 24 nt, Artificial Sequence
  Synthetic
cgccuccgaggguccgccucugcc

SEQ ID NO: 56225 - RNA, 18 nt, Artificial Sequence
  Synthetic
gguugcgggcgccgugcc

SEQ ID NO: 56226 - RNA, 19 nt, Artificial Sequence
  Synthetic
cgguugcgggcgccgugcc

SEQ ID NO: 56227 - RNA, 20 nt, Artificial Sequence
  Synthetic
gcgguugcgggcgccgugcc

SEQ ID NO: 56228 - RNA, 21 nt, Artificial Sequence
  Synthetic
ugcgguugcgggcgccgugcc

SEQ ID NO: 56229 - RNA, 22 nt, Artificial Sequence
  Synthetic
cugcgguugcgggcgccgugcc

SEQ ID NO: 56230 - RNA, 23 nt, Artificial Sequence
  Synthetic
ucugcgguugcgggcgccgugcc

SEQ ID NO: 56231 - RNA, 24 nt, Artificial Sequence
  Synthetic
cucugcgguugcgggcgccgugcc

SEQ ID NO: 56232 - RNA, 18 nt, Artificial Sequence
  Synthetic
ggcgcgcggaaaagcagc

SEQ ID NO: 56233 - RNA, 19 nt, Artificial Sequence
  Synthetic
aggcgcgcggaaaagcagc

SEQ ID NO: 56234 - RNA, 20 nt, Artificial Sequence
  Synthetic
gaggcgcgcggaaaagcagc

SEQ ID NO: 56235 - RNA, 21 nt, Artificial Sequence
  Synthetic
agaggcgcgcggaaaagcagc

SEQ ID NO: 56236 - RNA, 22 nt, Artificial Sequence
  Synthetic
gagaggcgcgcggaaaagcagc

SEQ ID NO: 56237 - RNA, 23 nt, Artificial Sequence
  Synthetic
agagaggcgcgcggaaaagcagc

SEQ ID NO: 56238 - RNA, 24 nt, Artificial Sequence
  Synthetic
aagagaggcgcgcggaaaagcagc

SEQ ID NO: 56239 - RNA, 18 nt, Artificial Sequence
  Synthetic
auuaagccgccggagagc

SEQ ID NO: 56240 - RNA, 19 nt, Artificial Sequence
  Synthetic
cauuaagccgccggagagc

SEQ ID NO: 56241 - RNA, 20 nt, Artificial Sequence
  Synthetic
ccauuaagccgccggagagc

SEQ ID NO: 56242 - RNA, 21 nt, Artificial Sequence
  Synthetic
uccauuaagccgccggagagc

SEQ ID NO: 56243 - RNA, 22 nt, Artificial Sequence
  Synthetic
auccauuaagccgccggagagc

SEQ ID NO: 56244 - RNA, 23 nt, Artificial Sequence
  Synthetic
gauccauuaagccgccggagagc

SEQ ID NO: 56245 - RNA, 24 nt, Artificial Sequence
  Synthetic
agauccauuaagccgccggagagc

SEQ ID NO: 56246 - RNA, 18 nt, Artificial Sequence
  Synthetic
ccgggcccccggcggagc

SEQ ID NO: 56247 - RNA, 19 nt, Artificial Sequence
  Synthetic
cccgggcccccggcggagc

SEQ ID NO: 56248 - RNA, 20 nt, Artificial Sequence
  Synthetic
gcccgggcccccggcggagc

SEQ ID NO: 56249 - RNA, 21 nt, Artificial Sequence
  Synthetic
ggcccgggcccccggcggagc

SEQ ID NO: 56250 - RNA, 22 nt, Artificial Sequence
  Synthetic
cggcccgggcccccggcggagc

SEQ ID NO: 56251 - RNA, 23 nt, Artificial Sequence
  Synthetic
ccggcccgggcccccggcggagc

SEQ ID NO: 56252 - RNA, 24 nt, Artificial Sequence
  Synthetic
uccggcccgggcccccggcggagc

SEQ ID NO: 56253 - RNA, 18 nt, Artificial Sequence
  Synthetic
cgcggcagcaacgaacgc

SEQ ID NO: 56254 - RNA, 19 nt, Artificial Sequence
  Synthetic
gcgcggcagcaacgaacgc

SEQ ID NO: 56255 - RNA, 20 nt, Artificial Sequence
  Synthetic
ggcgcggcagcaacgaacgc

SEQ ID NO: 56256 - RNA, 21 nt, Artificial Sequence
  Synthetic
gggcgcggcagcaacgaacgc

SEQ ID NO: 56257 - RNA, 22 nt, Artificial Sequence
  Synthetic
ggggcgcggcagcaacgaacgc

SEQ ID NO: 56258 - RNA, 23 nt, Artificial Sequence
  Synthetic
gggggcgcggcagcaacgaacgc

SEQ ID NO: 56259 - RNA, 24 nt, Artificial Sequence
  Synthetic
cgggggcgcggcagcaacgaacgc

SEQ ID NO: 56260 - RNA, 18 nt, Artificial Sequence
  Synthetic
ggagauccauuaagccgc

SEQ ID NO: 56261 - RNA, 19 nt, Artificial Sequence
  Synthetic
cggagauccauuaagccgc

SEQ ID NO: 56262 - RNA, 20 nt, Artificial Sequence
  Synthetic
ccggagauccauuaagccgc

SEQ ID NO: 56263 - RNA, 21 nt, Artificial Sequence
  Synthetic
cccggagauccauuaagccgc

SEQ ID NO: 56264 - RNA, 22 nt, Artificial Sequence
  Synthetic
gcccggagauccauuaagccgc

SEQ ID NO: 56265 - RNA, 23 nt, Artificial Sequence
  Synthetic
ugcccggagauccauuaagccgc

SEQ ID NO: 56266 - RNA, 24 nt, Artificial Sequence
  Synthetic
gugcccggagauccauuaagccgc

SEQ ID NO: 56267 - RNA, 18 nt, Artificial Sequence
  Synthetic
gggcccccggcggagcgc

SEQ ID NO: 56268 - RNA, 19 nt, Artificial Sequence
  Synthetic
cgggcccccggcggagcgc

SEQ ID NO: 56269 - RNA, 20 nt, Artificial Sequence
  Synthetic
ccgggcccccggcggagcgc

SEQ ID NO: 56270 - RNA, 21 nt, Artificial Sequence
  Synthetic
cccgggcccccggcggagcgc

SEQ ID NO: 56271 - RNA, 22 nt, Artificial Sequence
  Synthetic
gcccgggcccccggcggagcgc

SEQ ID NO: 56272 - RNA, 23 nt, Artificial Sequence
  Synthetic
ggcccgggcccccggcggagcgc

SEQ ID NO: 56273 - RNA, 24 nt, Artificial Sequence
  Synthetic
cggcccgggcccccggcggagcgc

SEQ ID NO: 56274 - RNA, 18 nt, Artificial Sequence
  Synthetic
aacgggaaagagaggcgc

SEQ ID NO: 56275 - RNA, 19 nt, Artificial Sequence
  Synthetic
caacgggaaagagaggcgc

SEQ ID NO: 56276 - RNA, 20 nt, Artificial Sequence
  Synthetic
gcaacgggaaagagaggcgc

SEQ ID NO: 56277 - RNA, 21 nt, Artificial Sequence
  Synthetic
agcaacgggaaagagaggcgc

SEQ ID NO: 56278 - RNA, 22 nt, Artificial Sequence
  Synthetic
aagcaacgggaaagagaggcgc

SEQ ID NO: 56279 - RNA, 23 nt, Artificial Sequence
  Synthetic
aaagcaacgggaaagagaggcgc

SEQ ID NO: 56280 - RNA, 24 nt, Artificial Sequence
  Synthetic
gaaagcaacgggaaagagaggcgc

SEQ ID NO: 56281 - RNA, 18 nt, Artificial Sequence
  Synthetic
cgcgcguucgcgaaaggc

SEQ ID NO: 56282 - RNA, 19 nt, Artificial Sequence
  Synthetic
ccgcgcguucgcgaaaggc

SEQ ID NO: 56283 - RNA, 20 nt, Artificial Sequence
  Synthetic
gccgcgcguucgcgaaaggc

SEQ ID NO: 56284 - RNA, 21 nt, Artificial Sequence
  Synthetic
cgccgcgcguucgcgaaaggc

SEQ ID NO: 56285 - RNA, 22 nt, Artificial Sequence
  Synthetic
gcgccgcgcguucgcgaaaggc

SEQ ID NO: 56286 - RNA, 23 nt, Artificial Sequence
  Synthetic
ggcgccgcgcguucgcgaaaggc

SEQ ID NO: 56287 - RNA, 24 nt, Artificial Sequence
  Synthetic
cggcgccgcgcguucgcgaaaggc

SEQ ID NO: 56288 - RNA, 18 nt, Artificial Sequence
  Synthetic
gccgaggugcgccccggc

SEQ ID NO: 56289 - RNA, 19 nt, Artificial Sequence
  Synthetic
cgccgaggugcgccccggc

SEQ ID NO: 56290 - RNA, 20 nt, Artificial Sequence
  Synthetic
ccgccgaggugcgccccggc

SEQ ID NO: 56291 - RNA, 21 nt, Artificial Sequence
  Synthetic
gccgccgaggugcgccccggc

SEQ ID NO: 56292 - RNA, 22 nt, Artificial Sequence
  Synthetic
ggccgccgaggugcgccccggc

SEQ ID NO: 56293 - RNA, 23 nt, Artificial Sequence
  Synthetic
uggccgccgaggugcgccccggc

SEQ ID NO: 56294 - RNA, 24 nt, Artificial Sequence
  Synthetic
uuggccgccgaggugcgccccggc

SEQ ID NO: 56295 - RNA, 18 nt, Artificial Sequence
  Synthetic
cuuuuuucgauucccggc

SEQ ID NO: 56296 - RNA, 19 nt, Artificial Sequence
  Synthetic
gcuuuuuucgauucccggc

SEQ ID NO: 56297 - RNA, 20 nt, Artificial Sequence
  Synthetic
ggcuuuuuucgauucccggc

SEQ ID NO: 56298 - RNA, 21 nt, Artificial Sequence
  Synthetic
aggcuuuuuucgauucccggc

SEQ ID NO: 56299 - RNA, 22 nt, Artificial Sequence
  Synthetic
gaggcuuuuuucgauucccggc

SEQ ID NO: 56300 - RNA, 23 nt, Artificial Sequence
  Synthetic
ggaggcuuuuuucgauucccggc

SEQ ID NO: 56301 - RNA, 24 nt, Artificial Sequence
  Synthetic
cggaggcuuuuuucgauucccggc

SEQ ID NO: 56302 - RNA, 18 nt, Artificial Sequence
  Synthetic
cccgcccggcgguccggc

SEQ ID NO: 56303 - RNA, 19 nt, Artificial Sequence
  Synthetic
ccccgcccggcgguccggc

SEQ ID NO: 56304 - RNA, 20 nt, Artificial Sequence
  Synthetic
cccccgcccggcgguccggc

SEQ ID NO: 56305 - RNA, 21 nt, Artificial Sequence
  Synthetic
ucccccgcccggcgguccggc

SEQ ID NO: 56306 - RNA, 22 nt, Artificial Sequence
  Synthetic
gucccccgcccggcgguccggc

SEQ ID NO: 56307 - RNA, 23 nt, Artificial Sequence
  Synthetic
cgucccccgcccggcgguccggc

SEQ ID NO: 56308 - RNA, 24 nt, Artificial Sequence
  Synthetic
gcgucccccgcccggcgguccggc

SEQ ID NO: 56309 - RNA, 18 nt, Artificial Sequence
  Synthetic
ggggacccccgggcgggc

SEQ ID NO: 56310 - RNA, 19 nt, Artificial Sequence
  Synthetic
cggggacccccgggcgggc

SEQ ID NO: 56311 - RNA, 20 nt, Artificial Sequence
  Synthetic
ucggggacccccgggcgggc

SEQ ID NO: 56312 - RNA, 21 nt, Artificial Sequence
  Synthetic
cucggggacccccgggcgggc

SEQ ID NO: 56313 - RNA, 22 nt, Artificial Sequence
  Synthetic
ccucggggacccccgggcgggc

SEQ ID NO: 56314 - RNA, 23 nt, Artificial Sequence
  Synthetic
gccucggggacccccgggcgggc

SEQ ID NO: 56315 - RNA, 24 nt, Artificial Sequence
  Synthetic
ugccucggggacccccgggcgggc

SEQ ID NO: 56316 - RNA, 18 nt, Artificial Sequence
  Synthetic
cgguugcgggcgccgugc

SEQ ID NO: 56317 - RNA, 19 nt, Artificial Sequence
  Synthetic
gcgguugcgggcgccgugc

SEQ ID NO: 56318 - RNA, 20 nt, Artificial Sequence
  Synthetic
ugcgguugcgggcgccgugc

SEQ ID NO: 56319 - RNA, 21 nt, Artificial Sequence
  Synthetic
cugcgguugcgggcgccgugc

SEQ ID NO: 56320 - RNA, 22 nt, Artificial Sequence
  Synthetic
ucugcgguugcgggcgccgugc

SEQ ID NO: 56321 - RNA, 23 nt, Artificial Sequence
  Synthetic
cucugcgguugcgggcgccgugc

SEQ ID NO: 56322 - RNA, 24 nt, Artificial Sequence
  Synthetic
gcucugcgguugcgggcgccgugc

SEQ ID NO: 56323 - RNA, 18 nt, Artificial Sequence
  Synthetic
aggggcccgccgccgauc

SEQ ID NO: 56324 - RNA, 19 nt, Artificial Sequence
  Synthetic
caggggcccgccgccgauc

SEQ ID NO: 56325 - RNA, 20 nt, Artificial Sequence
  Synthetic
gcaggggcccgccgccgauc

SEQ ID NO: 56326 - RNA, 21 nt, Artificial Sequence
  Synthetic
cgcaggggcccgccgccgauc

SEQ ID NO: 56327 - RNA, 22 nt, Artificial Sequence
  Synthetic
acgcaggggcccgccgccgauc

SEQ ID NO: 56328 - RNA, 23 nt, Artificial Sequence
  Synthetic
aacgcaggggcccgccgccgauc

SEQ ID NO: 56329 - RNA, 24 nt, Artificial Sequence
  Synthetic
gaacgcaggggcccgccgccgauc

SEQ ID NO: 56330 - RNA, 18 nt, Artificial Sequence
  Synthetic
gccgaucgagagggacuc

SEQ ID NO: 56331 - RNA, 19 nt, Artificial Sequence
  Synthetic
cgccgaucgagagggacuc

SEQ ID NO: 56332 - RNA, 20 nt, Artificial Sequence
  Synthetic
ccgccgaucgagagggacuc

SEQ ID NO: 56333 - RNA, 21 nt, Artificial Sequence
  Synthetic
gccgccgaucgagagggacuc

SEQ ID NO: 56334 - RNA, 22 nt, Artificial Sequence
  Synthetic
cgccgccgaucgagagggacuc

SEQ ID NO: 56335 - RNA, 23 nt, Artificial Sequence
  Synthetic
ccgccgccgaucgagagggacuc

SEQ ID NO: 56336 - RNA, 24 nt, Artificial Sequence
  Synthetic
cccgccgccgaucgagagggacuc

SEQ ID NO: 56337 - RNA, 18 nt, Artificial Sequence
  Synthetic
aggguccgccucugccuc

SEQ ID NO: 56338 - RNA, 19 nt, Artificial Sequence
  Synthetic
gaggguccgccucugccuc

SEQ ID NO: 56339 - RNA, 20 nt, Artificial Sequence
  Synthetic
cgaggguccgccucugccuc

SEQ ID NO: 56340 - RNA, 21 nt, Artificial Sequence
  Synthetic
ccgaggguccgccucugccuc

SEQ ID NO: 56341 - RNA, 22 nt, Artificial Sequence
  Synthetic
uccgaggguccgccucugccuc

SEQ ID NO: 56342 - RNA, 23 nt, Artificial Sequence
  Synthetic
cuccgaggguccgccucugccuc

SEQ ID NO: 56343 - RNA, 24 nt, Artificial Sequence
  Synthetic
ccuccgaggguccgccucugccuc

SEQ ID NO: 56344 - RNA, 18 nt, Artificial Sequence
  Synthetic
cucccggccgccccgcuc

SEQ ID NO: 56345 - RNA, 19 nt, Artificial Sequence
  Synthetic
ccucccggccgccccgcuc

SEQ ID NO: 56346 - RNA, 20 nt, Artificial Sequence
  Synthetic
cccucccggccgccccgcuc

SEQ ID NO: 56347 - RNA, 21 nt, Artificial Sequence
  Synthetic
ucccucccggccgccccgcuc

SEQ ID NO: 56348 - RNA, 22 nt, Artificial Sequence
  Synthetic
cucccucccggccgccccgcuc

SEQ ID NO: 56349 - RNA, 23 nt, Artificial Sequence
  Synthetic
ucucccucccggccgccccgcuc

SEQ ID NO: 56350 - RNA, 24 nt, Artificial Sequence
  Synthetic
uucucccucccggccgccccgcuc

SEQ ID NO: 56351 - RNA, 18 nt, Artificial Sequence
  Synthetic
gagcagcgccgcgggcuc

SEQ ID NO: 56352 - RNA, 19 nt, Artificial Sequence
  Synthetic
cgagcagcgccgcgggcuc

SEQ ID NO: 56353 - RNA, 20 nt, Artificial Sequence
  Synthetic
ccgagcagcgccgcgggcuc

SEQ ID NO: 56354 - RNA, 21 nt, Artificial Sequence
  Synthetic
gccgagcagcgccgcgggcuc

SEQ ID NO: 56355 - RNA, 22 nt, Artificial Sequence
  Synthetic
agccgagcagcgccgcgggcuc

SEQ ID NO: 56356 - RNA, 23 nt, Artificial Sequence
  Synthetic
cagccgagcagcgccgcgggcuc

SEQ ID NO: 56357 - RNA, 24 nt, Artificial Sequence
  Synthetic
gcagccgagcagcgccgcgggcuc

SEQ ID NO: 56358 - RNA, 18 nt, Artificial Sequence
  Synthetic
cuccggcgccgcgcguuc

SEQ ID NO: 56359 - RNA, 19 nt, Artificial Sequence
  Synthetic
ccuccggcgccgcgcguuc

SEQ ID NO: 56360 - RNA, 20 nt, Artificial Sequence
  Synthetic
cccuccggcgccgcgcguuc

SEQ ID NO: 56361 - RNA, 21 nt, Artificial Sequence
  Synthetic
ccccuccggcgccgcgcguuc

SEQ ID NO: 56362 - RNA, 22 nt, Artificial Sequence
  Synthetic
cccccuccggcgccgcgcguuc

SEQ ID NO: 56363 - RNA, 23 nt, Artificial Sequence
  Synthetic
gcccccuccggcgccgcgcguuc

SEQ ID NO: 56364 - RNA, 24 nt, Artificial Sequence
  Synthetic
cgcccccuccggcgccgcgcguuc

SEQ ID NO: 56365 - RNA, 18 nt, Artificial Sequence
  Synthetic
gcgcggaaaagcagcaag

SEQ ID NO: 56366 - RNA, 19 nt, Artificial Sequence
  Synthetic
cgcgcggaaaagcagcaag

SEQ ID NO: 56367 - RNA, 20 nt, Artificial Sequence
  Synthetic
gcgcgcggaaaagcagcaag

SEQ ID NO: 56368 - RNA, 21 nt, Artificial Sequence
  Synthetic
ggcgcgcggaaaagcagcaag

SEQ ID NO: 56369 - RNA, 22 nt, Artificial Sequence
  Synthetic
aggcgcgcggaaaagcagcaag

SEQ ID NO: 56370 - RNA, 23 nt, Artificial Sequence
  Synthetic
gaggcgcgcggaaaagcagcaag

SEQ ID NO: 56371 - RNA, 24 nt, Artificial Sequence
  Synthetic
agaggcgcgcggaaaagcagcaag

SEQ ID NO: 56372 - RNA, 18 nt, Artificial Sequence
  Synthetic
cgggccgcgggccagcag

SEQ ID NO: 56373 - RNA, 19 nt, Artificial Sequence
  Synthetic
acgggccgcgggccagcag

SEQ ID NO: 56374 - RNA, 20 nt, Artificial Sequence
  Synthetic
gacgggccgcgggccagcag

SEQ ID NO: 56375 - RNA, 21 nt, Artificial Sequence
  Synthetic
agacgggccgcgggccagcag

SEQ ID NO: 56376 - RNA, 22 nt, Artificial Sequence
  Synthetic
cagacgggccgcgggccagcag

SEQ ID NO: 56377 - RNA, 23 nt, Artificial Sequence
  Synthetic
gcagacgggccgcgggccagcag

SEQ ID NO: 56378 - RNA, 24 nt, Artificial Sequence
  Synthetic
agcagacgggccgcgggccagcag

SEQ ID NO: 56379 - RNA, 18 nt, Artificial Sequence
  Synthetic
guggccgcgggccagcag

SEQ ID NO: 56380 - RNA, 19 nt, Artificial Sequence
  Synthetic
cguggccgcgggccagcag

SEQ ID NO: 56381 - RNA, 20 nt, Artificial Sequence
  Synthetic
acguggccgcgggccagcag

SEQ ID NO: 56382 - RNA, 21 nt, Artificial Sequence
  Synthetic
uacguggccgcgggccagcag

SEQ ID NO: 56383 - RNA, 22 nt, Artificial Sequence
  Synthetic
uuacguggccgcgggccagcag

SEQ ID NO: 56384 - RNA, 23 nt, Artificial Sequence
  Synthetic
uuuacguggccgcgggccagcag

SEQ ID NO: 56385 - RNA, 24 nt, Artificial Sequence
  Synthetic
guuuacguggccgcgggccagcag

SEQ ID NO: 56386 - RNA, 18 nt, Artificial Sequence
  Synthetic
cggagcccgcggccgcag

SEQ ID NO: 56387 - RNA, 19 nt, Artificial Sequence
  Synthetic
ccggagcccgcggccgcag

SEQ ID NO: 56388 - RNA, 20 nt, Artificial Sequence
  Synthetic
cccggagcccgcggccgcag

SEQ ID NO: 56389 - RNA, 21 nt, Artificial Sequence
  Synthetic
ccccggagcccgcggccgcag

SEQ ID NO: 56390 - RNA, 22 nt, Artificial Sequence
  Synthetic
cccccggagcccgcggccgcag

SEQ ID NO: 56391 - RNA, 23 nt, Artificial Sequence
  Synthetic
gcccccggagcccgcggccgcag

SEQ ID NO: 56392 - RNA, 24 nt, Artificial Sequence
  Synthetic
agcccccggagcccgcggccgcag

SEQ ID NO: 56393 - RNA, 18 nt, Artificial Sequence
  Synthetic
gcggaaaagcagcaagag

SEQ ID NO: 56394 - RNA, 19 nt, Artificial Sequence
  Synthetic
cgcggaaaagcagcaagag

SEQ ID NO: 56395 - RNA, 20 nt, Artificial Sequence
  Synthetic
gcgcggaaaagcagcaagag

SEQ ID NO: 56396 - RNA, 21 nt, Artificial Sequence
  Synthetic
cgcgcggaaaagcagcaagag

SEQ ID NO: 56397 - RNA, 22 nt, Artificial Sequence
  Synthetic
gcgcgcggaaaagcagcaagag

SEQ ID NO: 56398 - RNA, 23 nt, Artificial Sequence
  Synthetic
ggcgcgcggaaaagcagcaagag

SEQ ID NO: 56399 - RNA, 24 nt, Artificial Sequence
  Synthetic
aggcgcgcggaaaagcagcaagag

SEQ ID NO: 56400 - RNA, 18 nt, Artificial Sequence
  Synthetic
agagagagagagagagag

SEQ ID NO: 56401 - RNA, 19 nt, Artificial Sequence
  Synthetic
gagagagagagagagagag

SEQ ID NO: 56402 - RNA, 20 nt, Artificial Sequence
  Synthetic
agagagagagagagagagag

SEQ ID NO: 56403 - RNA, 21 nt, Artificial Sequence
  Synthetic
gagagagagagagagagagag

SEQ ID NO: 56404 - RNA, 22 nt, Artificial Sequence
  Synthetic
agagagagagagagagagagag

SEQ ID NO: 56405 - RNA, 23 nt, Artificial Sequence
  Synthetic
gagagagagagagagagagagag

SEQ ID NO: 56406 - RNA, 24 nt, Artificial Sequence
  Synthetic
agagagagagagagagagagagag

SEQ ID NO: 56407 - RNA, 24 nt, Artificial Sequence
  Synthetic
ggagagagagagagagagagagag

SEQ ID NO: 56408 - RNA, 18 nt, Artificial Sequence
  Synthetic
gaggggggacggggcgag

SEQ ID NO: 56409 - RNA, 19 nt, Artificial Sequence
  Synthetic
agaggggggacggggcgag

SEQ ID NO: 56410 - RNA, 20 nt, Artificial Sequence
  Synthetic
aagaggggggacggggcgag

SEQ ID NO: 56411 - RNA, 21 nt, Artificial Sequence
  Synthetic
caagaggggggacggggcgag

SEQ ID NO: 56412 - RNA, 22 nt, Artificial Sequence
  Synthetic
gcaagaggggggacggggcgag

SEQ ID NO: 56413 - RNA, 23 nt, Artificial Sequence
  Synthetic
agcaagaggggggacggggcgag

SEQ ID NO: 56414 - RNA, 24 nt, Artificial Sequence
  Synthetic
cagcaagaggggggacggggcgag

SEQ ID NO: 56415 - RNA, 18 nt, Artificial Sequence
  Synthetic
ggcccgccgccgaucgag

SEQ ID NO: 56416 - RNA, 19 nt, Artificial Sequence
  Synthetic
gggcccgccgccgaucgag

SEQ ID NO: 56417 - RNA, 20 nt, Artificial Sequence
  Synthetic
ggggcccgccgccgaucgag

SEQ ID NO: 56418 - RNA, 21 nt, Artificial Sequence
  Synthetic
aggggcccgccgccgaucgag

SEQ ID NO: 56419 - RNA, 22 nt, Artificial Sequence
  Synthetic
caggggcccgccgccgaucgag

SEQ ID NO: 56420 - RNA, 23 nt, Artificial Sequence
  Synthetic
gcaggggcccgccgccgaucgag

SEQ ID NO: 56421 - RNA, 24 nt, Artificial Sequence
  Synthetic
cgcaggggcccgccgccgaucgag

SEQ ID NO: 56422 - RNA, 18 nt, Artificial Sequence
  Synthetic
ucgagagggacuccggag

SEQ ID NO: 56423 - RNA, 19 nt, Artificial Sequence
  Synthetic
aucgagagggacuccggag

SEQ ID NO: 56424 - RNA, 20 nt, Artificial Sequence
  Synthetic
gaucgagagggacuccggag

SEQ ID NO: 56425 - RNA, 21 nt, Artificial Sequence
  Synthetic
cgaucgagagggacuccggag

SEQ ID NO: 56426 - RNA, 22 nt, Artificial Sequence
  Synthetic
ccgaucgagagggacuccggag

SEQ ID NO: 56427 - RNA, 23 nt, Artificial Sequence
  Synthetic
gccgaucgagagggacuccggag

SEQ ID NO: 56428 - RNA, 24 nt, Artificial Sequence
  Synthetic
cgccgaucgagagggacuccggag

SEQ ID NO: 56429 - RNA, 18 nt, Artificial Sequence
  Synthetic
agagggggggggggggag

SEQ ID NO: 56430 - RNA, 19 nt, Artificial Sequence
  Synthetic
gagagggggggggggggag

SEQ ID NO: 56431 - RNA, 20 nt, Artificial Sequence
  Synthetic
agagagggggggggggggag

SEQ ID NO: 56432 - RNA, 21 nt, Artificial Sequence
  Synthetic
gagagagggggggggggggag

SEQ ID NO: 56433 - RNA, 22 nt, Artificial Sequence
  Synthetic
agagagagggggggggggggag

SEQ ID NO: 56434 - RNA, 23 nt, Artificial Sequence
  Synthetic
gagagagagggggggggggggag

SEQ ID NO: 56435 - RNA, 24 nt, Artificial Sequence
  Synthetic
agagagagagggggggggggggag

SEQ ID NO: 56436 - RNA, 18 nt, Artificial Sequence
  Synthetic
gcgcggcagcaacgaacg

SEQ ID NO: 56437 - RNA, 19 nt, Artificial Sequence
  Synthetic
ggcgcggcagcaacgaacg

SEQ ID NO: 56438 - RNA, 20 nt, Artificial Sequence
  Synthetic
gggcgcggcagcaacgaacg

SEQ ID NO: 56439 - RNA, 21 nt, Artificial Sequence
  Synthetic
ggggcgcggcagcaacgaacg

SEQ ID NO: 56440 - RNA, 22 nt, Artificial Sequence
  Synthetic
gggggcgcggcagcaacgaacg

SEQ ID NO: 56441 - RNA, 23 nt, Artificial Sequence
  Synthetic
cgggggcgcggcagcaacgaacg

SEQ ID NO: 56442 - RNA, 24 nt, Artificial Sequence
  Synthetic
ccgggggcgcggcagcaacgaacg

SEQ ID NO: 56443 - RNA, 18 nt, Artificial Sequence
  Synthetic
ccauuaaacacucccacg

SEQ ID NO: 56444 - RNA, 19 nt, Artificial Sequence
  Synthetic
uccauuaaacacucccacg

SEQ ID NO: 56445 - RNA, 20 nt, Artificial Sequence
  Synthetic
uuccauuaaacacucccacg

SEQ ID NO: 56446 - RNA, 21 nt, Artificial Sequence
  Synthetic
cuuccauuaaacacucccacg

SEQ ID NO: 56447 - RNA, 22 nt, Artificial Sequence
  Synthetic
ccuuccauuaaacacucccacg

SEQ ID NO: 56448 - RNA, 23 nt, Artificial Sequence
  Synthetic
cccuuccauuaaacacucccacg

SEQ ID NO: 56449 - RNA, 24 nt, Artificial Sequence
  Synthetic
gcccuuccauuaaacacucccacg

SEQ ID NO: 56450 - RNA, 18 nt, Artificial Sequence
  Synthetic
guccggcccgggcccccg

SEQ ID NO: 56451 - RNA, 19 nt, Artificial Sequence
  Synthetic
gguccggcccgggcccccg

SEQ ID NO: 56452 - RNA, 20 nt, Artificial Sequence
  Synthetic
cgguccggcccgggcccccg

SEQ ID NO: 56453 - RNA, 21 nt, Artificial Sequence
  Synthetic
gcgguccggcccgggcccccg

SEQ ID NO: 56454 - RNA, 22 nt, Artificial Sequence
  Synthetic
ggcgguccggcccgggcccccg

SEQ ID NO: 56455 - RNA, 23 nt, Artificial Sequence
  Synthetic
cggcgguccggcccgggcccccg

SEQ ID NO: 56456 - RNA, 24 nt, Artificial Sequence
  Synthetic
ccggcgguccggcccgggcccccg

SEQ ID NO: 56457 - RNA, 18 nt, Artificial Sequence
  Synthetic
cggagauccauuaagccg

SEQ ID NO: 56458 - RNA, 19 nt, Artificial Sequence
  Synthetic
ccggagauccauuaagccg

SEQ ID NO: 56459 - RNA, 20 nt, Artificial Sequence
  Synthetic
cccggagauccauuaagccg

SEQ ID NO: 56460 - RNA, 21 nt, Artificial Sequence
  Synthetic
gcccggagauccauuaagccg

SEQ ID NO: 56461 - RNA, 22 nt, Artificial Sequence
  Synthetic
ugcccggagauccauuaagccg

SEQ ID NO: 56462 - RNA, 23 nt, Artificial Sequence
  Synthetic
gugcccggagauccauuaagccg

SEQ ID NO: 56463 - RNA, 24 nt, Artificial Sequence
  Synthetic
cgugcccggagauccauuaagccg

SEQ ID NO: 56464 - RNA, 18 nt, Artificial Sequence
  Synthetic
agauccauuaagccgccg

SEQ ID NO: 56465 - RNA, 19 nt, Artificial Sequence
  Synthetic
gagauccauuaagccgccg

SEQ ID NO: 56466 - RNA, 20 nt, Artificial Sequence
  Synthetic
ggagauccauuaagccgccg

SEQ ID NO: 56467 - RNA, 21 nt, Artificial Sequence
  Synthetic
cggagauccauuaagccgccg

SEQ ID NO: 56468 - RNA, 22 nt, Artificial Sequence
  Synthetic
ccggagauccauuaagccgccg

SEQ ID NO: 56469 - RNA, 23 nt, Artificial Sequence
  Synthetic
cccggagauccauuaagccgccg

SEQ ID NO: 56470 - RNA, 24 nt, Artificial Sequence
  Synthetic
gcccggagauccauuaagccgccg

SEQ ID NO: 56471 - RNA, 18 nt, Artificial Sequence
  Synthetic
cgaggugcgccccggccg

SEQ ID NO: 56472 - RNA, 19 nt, Artificial Sequence
  Synthetic
ccgaggugcgccccggccg

SEQ ID NO: 56473 - RNA, 20 nt, Artificial Sequence
  Synthetic
gccgaggugcgccccggccg

SEQ ID NO: 56474 - RNA, 21 nt, Artificial Sequence
  Synthetic
cgccgaggugcgccccggccg

SEQ ID NO: 56475 - RNA, 22 nt, Artificial Sequence
  Synthetic
ccgccgaggugcgccccggccg

SEQ ID NO: 56476 - RNA, 23 nt, Artificial Sequence
  Synthetic
gccgccgaggugcgccccggccg

SEQ ID NO: 56477 - RNA, 24 nt, Artificial Sequence
  Synthetic
ggccgccgaggugcgccccggccg

SEQ ID NO: 56478 - RNA, 18 nt, Artificial Sequence
  Synthetic
cgggccggggcuuggccg

SEQ ID NO: 56479 - RNA, 19 nt, Artificial Sequence
  Synthetic
gcgggccggggcuuggccg

SEQ ID NO: 56480 - RNA, 20 nt, Artificial Sequence
  Synthetic
ggcgggccggggcuuggccg

SEQ ID NO: 56481 - RNA, 21 nt, Artificial Sequence
  Synthetic
gggcgggccggggcuuggccg

SEQ ID NO: 56482 - RNA, 22 nt, Artificial Sequence
  Synthetic
cgggcgggccggggcuuggccg

SEQ ID NO: 56483 - RNA, 23 nt, Artificial Sequence
  Synthetic
ccgggcgggccggggcuuggccg

SEQ ID NO: 56484 - RNA, 24 nt, Artificial Sequence
  Synthetic
cccgggcgggccggggcuuggccg

SEQ ID NO: 56485 - RNA, 18 nt, Artificial Sequence
  Synthetic
cgaucgagagggacuccg

SEQ ID NO: 56486 - RNA, 19 nt, Artificial Sequence
  Synthetic
ccgaucgagagggacuccg

SEQ ID NO: 56487 - RNA, 20 nt, Artificial Sequence
  Synthetic
gccgaucgagagggacuccg

SEQ ID NO: 56488 - RNA, 21 nt, Artificial Sequence
  Synthetic
cgccgaucgagagggacuccg

SEQ ID NO: 56489 - RNA, 22 nt, Artificial Sequence
  Synthetic
ccgccgaucgagagggacuccg

SEQ ID NO: 56490 - RNA, 23 nt, Artificial Sequence
  Synthetic
gccgccgaucgagagggacuccg

SEQ ID NO: 56491 - RNA, 24 nt, Artificial Sequence
  Synthetic
cgccgccgaucgagagggacuccg

SEQ ID NO: 56492 - RNA, 18 nt, Artificial Sequence
  Synthetic
cgggcccccggcggagcg

SEQ ID NO: 56493 - RNA, 19 nt, Artificial Sequence
  Synthetic
ccgggcccccggcggagcg

SEQ ID NO: 56494 - RNA, 20 nt, Artificial Sequence
  Synthetic
cccgggcccccggcggagcg

SEQ ID NO: 56495 - RNA, 21 nt, Artificial Sequence
  Synthetic
gcccgggcccccggcggagcg

SEQ ID NO: 56496 - RNA, 22 nt, Artificial Sequence
  Synthetic
ggcccgggcccccggcggagcg

SEQ ID NO: 56497 - RNA, 23 nt, Artificial Sequence
  Synthetic
cggcccgggcccccggcggagcg

SEQ ID NO: 56498 - RNA, 24 nt, Artificial Sequence
  Synthetic
ccggcccgggcccccggcggagcg

SEQ ID NO: 56499 - RNA, 18 nt, Artificial Sequence
  Synthetic
cgccccgcgccggccgcg

SEQ ID NO: 56500 - RNA, 19 nt, Artificial Sequence
  Synthetic
acgccccgcgccggccgcg

SEQ ID NO: 56501 - RNA, 20 nt, Artificial Sequence
  Synthetic
aacgccccgcgccggccgcg

SEQ ID NO: 56502 - RNA, 21 nt, Artificial Sequence
  Synthetic
caacgccccgcgccggccgcg

SEQ ID NO: 56503 - RNA, 22 nt, Artificial Sequence
  Synthetic
gcaacgccccgcgccggccgcg

SEQ ID NO: 56504 - RNA, 23 nt, Artificial Sequence
  Synthetic
ggcaacgccccgcgccggccgcg

SEQ ID NO: 56505 - RNA, 24 nt, Artificial Sequence
  Synthetic
cggcaacgccccgcgccggccgcg

SEQ ID NO: 56506 - RNA, 18 nt, Artificial Sequence
  Synthetic
acgggaaagagaggcgcg

SEQ ID NO: 56507 - RNA, 19 nt, Artificial Sequence
  Synthetic
aacgggaaagagaggcgcg

SEQ ID NO: 56508 - RNA, 20 nt, Artificial Sequence
  Synthetic
caacgggaaagagaggcgcg

SEQ ID NO: 56509 - RNA, 21 nt, Artificial Sequence
  Synthetic
gcaacgggaaagagaggcgcg

SEQ ID NO: 56510 - RNA, 22 nt, Artificial Sequence
  Synthetic
agcaacgggaaagagaggcgcg

SEQ ID NO: 56511 - RNA, 23 nt, Artificial Sequence
  Synthetic
aagcaacgggaaagagaggcgcg

SEQ ID NO: 56512 - RNA, 24 nt, Artificial Sequence
  Synthetic
aaagcaacgggaaagagaggcgcg

SEQ ID NO: 56513 - RNA, 18 nt, Artificial Sequence
  Synthetic
ccggguagccgcccggcg

SEQ ID NO: 56514 - RNA, 19 nt, Artificial Sequence
  Synthetic
cccggguagccgcccggcg

SEQ ID NO: 56515 - RNA, 20 nt, Artificial Sequence
  Synthetic
ucccggguagccgcccggcg

SEQ ID NO: 56516 - RNA, 21 nt, Artificial Sequence
  Synthetic
gucccggguagccgcccggcg

SEQ ID NO: 56517 - RNA, 22 nt, Artificial Sequence
  Synthetic
ggucccggguagccgcccggcg

SEQ ID NO: 56518 - RNA, 23 nt, Artificial Sequence
  Synthetic
gggucccggguagccgcccggcg

SEQ ID NO: 56519 - RNA, 24 nt, Artificial Sequence
  Synthetic
ggggucccggguagccgcccggcg

SEQ ID NO: 56520 - RNA, 18 nt, Artificial Sequence
  Synthetic
cccgcgccggccgcggcg

SEQ ID NO: 56521 - RNA, 19 nt, Artificial Sequence
  Synthetic
ccccgcgccggccgcggcg

SEQ ID NO: 56522 - RNA, 20 nt, Artificial Sequence
  Synthetic
gccccgcgccggccgcggcg

SEQ ID NO: 56523 - RNA, 21 nt, Artificial Sequence
  Synthetic
cgccccgcgccggccgcggcg

SEQ ID NO: 56524 - RNA, 22 nt, Artificial Sequence
  Synthetic
acgccccgcgccggccgcggcg

SEQ ID NO: 56525 - RNA, 23 nt, Artificial Sequence
  Synthetic
aacgccccgcgccggccgcggcg

SEQ ID NO: 56526 - RNA, 24 nt, Artificial Sequence
  Synthetic
caacgccccgcgccggccgcggcg

SEQ ID NO: 56527 - RNA, 18 nt, Artificial Sequence
  Synthetic
cggaaaagcagcaagagg

SEQ ID NO: 56528 - RNA, 19 nt, Artificial Sequence
  Synthetic
gcggaaaagcagcaagagg

SEQ ID NO: 56529 - RNA, 20 nt, Artificial Sequence
  Synthetic
cgcggaaaagcagcaagagg

SEQ ID NO: 56530 - RNA, 21 nt, Artificial Sequence
  Synthetic
gcgcggaaaagcagcaagagg

SEQ ID NO: 56531 - RNA, 22 nt, Artificial Sequence
  Synthetic
cgcgcggaaaagcagcaagagg

SEQ ID NO: 56532 - RNA, 23 nt, Artificial Sequence
  Synthetic
gcgcgcggaaaagcagcaagagg

SEQ ID NO: 56533 - RNA, 24 nt, Artificial Sequence
  Synthetic
ggcgcgcggaaaagcagcaagagg

SEQ ID NO: 56534 - RNA, 18 nt, Artificial Sequence
  Synthetic
gagagagagagagagagg

SEQ ID NO: 56535 - RNA, 19 nt, Artificial Sequence
  Synthetic
agagagagagagagagagg

SEQ ID NO: 56536 - RNA, 20 nt, Artificial Sequence
  Synthetic
gagagagagagagagagagg

SEQ ID NO: 56537 - RNA, 21 nt, Artificial Sequence
  Synthetic
agagagagagagagagagagg

SEQ ID NO: 56538 - RNA, 22 nt, Artificial Sequence
  Synthetic
gagagagagagagagagagagg

SEQ ID NO: 56539 - RNA, 23 nt, Artificial Sequence
  Synthetic
agagagagagagagagagagagg

SEQ ID NO: 56540 - RNA, 24 nt, Artificial Sequence
  Synthetic
gagagagagagagagagagagagg

SEQ ID NO: 56541 - RNA, 18 nt, Artificial Sequence
  Synthetic
ugccucggggacccccgg

SEQ ID NO: 56542 - RNA, 19 nt, Artificial Sequence
  Synthetic
cugccucggggacccccgg

SEQ ID NO: 56543 - RNA, 20 nt, Artificial Sequence
  Synthetic
ucugccucggggacccccgg

SEQ ID NO: 56544 - RNA, 21 nt, Artificial Sequence
  Synthetic
cucugccucggggacccccgg

SEQ ID NO: 56545 - RNA, 22 nt, Artificial Sequence
  Synthetic
ccucugccucggggacccccgg

SEQ ID NO: 56546 - RNA, 23 nt, Artificial Sequence
  Synthetic
gccucugccucggggacccccgg

SEQ ID NO: 56547 - RNA, 24 nt, Artificial Sequence
  Synthetic
cgccucugccucggggacccccgg

SEQ ID NO: 56548 - RNA, 18 nt, Artificial Sequence
  Synthetic
uccggcccgggcccccgg

SEQ ID NO: 56549 - RNA, 19 nt, Artificial Sequence
  Synthetic
guccggcccgggcccccgg

SEQ ID NO: 56550 - RNA, 20 nt, Artificial Sequence
  Synthetic
gguccggcccgggcccccgg

SEQ ID NO: 56551 - RNA, 21 nt, Artificial Sequence
  Synthetic
cgguccggcccgggcccccgg

SEQ ID NO: 56552 - RNA, 22 nt, Artificial Sequence
  Synthetic
gcgguccggcccgggcccccgg

SEQ ID NO: 56553 - RNA, 23 nt, Artificial Sequence
  Synthetic
ggcgguccggcccgggcccccgg

SEQ ID NO: 56554 - RNA, 24 nt, Artificial Sequence
  Synthetic
cggcgguccggcccgggcccccgg

SEQ ID NO: 56555 - RNA, 18 nt, Artificial Sequence
  Synthetic
cgccgaggugcgccccgg

SEQ ID NO: 56556 - RNA, 19 nt, Artificial Sequence
  Synthetic
ccgccgaggugcgccccgg

SEQ ID NO: 56557 - RNA, 20 nt, Artificial Sequence
  Synthetic
gccgccgaggugcgccccgg

SEQ ID NO: 56558 - RNA, 21 nt, Artificial Sequence
  Synthetic
ggccgccgaggugcgccccgg

SEQ ID NO: 56559 - RNA, 22 nt, Artificial Sequence
  Synthetic
uggccgccgaggugcgccccgg

SEQ ID NO: 56560 - RNA, 23 nt, Artificial Sequence
  Synthetic
uuggccgccgaggugcgccccgg

SEQ ID NO: 56561 - RNA, 24 nt, Artificial Sequence
  Synthetic
cuuggccgccgaggugcgccccgg

SEQ ID NO: 56562 - RNA, 18 nt, Artificial Sequence
  Synthetic
gcuuuuuucgauucccgg

SEQ ID NO: 56563 - RNA, 19 nt, Artificial Sequence
  Synthetic
ggcuuuuuucgauucccgg

SEQ ID NO: 56564 - RNA, 20 nt, Artificial Sequence
  Synthetic
aggcuuuuuucgauucccgg

SEQ ID NO: 56565 - RNA, 21 nt, Artificial Sequence
  Synthetic
gaggcuuuuuucgauucccgg

SEQ ID NO: 56566 - RNA, 22 nt, Artificial Sequence
  Synthetic
ggaggcuuuuuucgauucccgg

SEQ ID NO: 56567 - RNA, 23 nt, Artificial Sequence
  Synthetic
cggaggcuuuuuucgauucccgg

SEQ ID NO: 56568 - RNA, 24 nt, Artificial Sequence
  Synthetic
ccggaggcuuuuuucgauucccgg

SEQ ID NO: 56569 - RNA, 18 nt, Artificial Sequence
  Synthetic
guagccgcccggcgccgg

SEQ ID NO: 56570 - RNA, 19 nt, Artificial Sequence
  Synthetic
gguagccgcccggcgccgg

SEQ ID NO: 56571 - RNA, 20 nt, Artificial Sequence
  Synthetic
ggguagccgcccggcgccgg

SEQ ID NO: 56572 - RNA, 21 nt, Artificial Sequence
  Synthetic
cggguagccgcccggcgccgg

SEQ ID NO: 56573 - RNA, 22 nt, Artificial Sequence
  Synthetic
ccggguagccgcccggcgccgg

SEQ ID NO: 56574 - RNA, 23 nt, Artificial Sequence
  Synthetic
cccggguagccgcccggcgccgg

SEQ ID NO: 56575 - RNA, 24 nt, Artificial Sequence
  Synthetic
ucccggguagccgcccggcgccgg

SEQ ID NO: 56576 - RNA, 18 nt, Artificial Sequence
  Synthetic
gaggugcgccccggccgg

SEQ ID NO: 56577 - RNA, 19 nt, Artificial Sequence
  Synthetic
cgaggugcgccccggccgg

SEQ ID NO: 56578 - RNA, 20 nt, Artificial Sequence
  Synthetic
ccgaggugcgccccggccgg

SEQ ID NO: 56579 - RNA, 21 nt, Artificial Sequence
  Synthetic
gccgaggugcgccccggccgg

SEQ ID NO: 56580 - RNA, 22 nt, Artificial Sequence
  Synthetic
cgccgaggugcgccccggccgg

SEQ ID NO: 56581 - RNA, 23 nt, Artificial Sequence
  Synthetic
ccgccgaggugcgccccggccgg

SEQ ID NO: 56582 - RNA, 24 nt, Artificial Sequence
  Synthetic
gccgccgaggugcgccccggccgg

SEQ ID NO: 56583 - RNA, 18 nt, Artificial Sequence
  Synthetic
gccccgcgccggccgcgg

SEQ ID NO: 56584 - RNA, 19 nt, Artificial Sequence
  Synthetic
cgccccgcgccggccgcgg

SEQ ID NO: 56585 - RNA, 20 nt, Artificial Sequence
  Synthetic
acgccccgcgccggccgcgg

SEQ ID NO: 56586 - RNA, 21 nt, Artificial Sequence
  Synthetic
aacgccccgcgccggccgcgg

SEQ ID NO: 56587 - RNA, 22 nt, Artificial Sequence
  Synthetic
caacgccccgcgccggccgcgg

SEQ ID NO: 56588 - RNA, 23 nt, Artificial Sequence
  Synthetic
gcaacgccccgcgccggccgcgg

SEQ ID NO: 56589 - RNA, 24 nt, Artificial Sequence
  Synthetic
ggcaacgccccgcgccggccgcgg

SEQ ID NO: 56590 - RNA, 18 nt, Artificial Sequence
  Synthetic
agagagagagagagaggg

SEQ ID NO: 56591 - RNA, 19 nt, Artificial Sequence
  Synthetic
gagagagagagagagaggg

SEQ ID NO: 56592 - RNA, 20 nt, Artificial Sequence
  Synthetic
agagagagagagagagaggg

SEQ ID NO: 56593 - RNA, 21 nt, Artificial Sequence
  Synthetic
gagagagagagagagagaggg

SEQ ID NO: 56594 - RNA, 22 nt, Artificial Sequence
  Synthetic
agagagagagagagagagaggg

SEQ ID NO: 56595 - RNA, 23 nt, Artificial Sequence
  Synthetic
gagagagagagagagagagaggg

SEQ ID NO: 56596 - RNA, 24 nt, Artificial Sequence
  Synthetic
agagagagagagagagagagaggg

SEQ ID NO: 56597 - RNA, 18 nt, Artificial Sequence
  Synthetic
agcaagaggggggacggg

SEQ ID NO: 56598 - RNA, 19 nt, Artificial Sequence
  Synthetic
cagcaagaggggggacggg

SEQ ID NO: 56599 - RNA, 20 nt, Artificial Sequence
  Synthetic
gcagcaagaggggggacggg

SEQ ID NO: 56600 - RNA, 21 nt, Artificial Sequence
  Synthetic
agcagcaagaggggggacggg

SEQ ID NO: 56601 - RNA, 22 nt, Artificial Sequence
  Synthetic
aagcagcaagaggggggacggg

SEQ ID NO: 56602 - RNA, 23 nt, Artificial Sequence
  Synthetic
aaagcagcaagaggggggacggg

SEQ ID NO: 56603 - RNA, 24 nt, Artificial Sequence
  Synthetic
aaaagcagcaagaggggggacggg

SEQ ID NO: 56604 - RNA, 18 nt, Artificial Sequence
  Synthetic
uagccgcccggcgccggg

SEQ ID NO: 56605 - RNA, 19 nt, Artificial Sequence
  Synthetic
guagccgcccggcgccggg

SEQ ID NO: 56606 - RNA, 20 nt, Artificial Sequence
  Synthetic
gguagccgcccggcgccggg

SEQ ID NO: 56607 - RNA, 21 nt, Artificial Sequence
  Synthetic
ggguagccgcccggcgccggg

SEQ ID NO: 56608 - RNA, 22 nt, Artificial Sequence
  Synthetic
cggguagccgcccggcgccggg

SEQ ID NO: 56609 - RNA, 23 nt, Artificial Sequence
  Synthetic
ccggguagccgcccggcgccggg

SEQ ID NO: 56610 - RNA, 24 nt, Artificial Sequence
  Synthetic
cccggguagccgcccggcgccggg

SEQ ID NO: 56611 - RNA, 18 nt, Artificial Sequence
  Synthetic
gcgggcuccggggccggg

SEQ ID NO: 56612 - RNA, 19 nt, Artificial Sequence
  Synthetic
cgcgggcuccggggccggg

SEQ ID NO: 56613 - RNA, 20 nt, Artificial Sequence
  Synthetic
ccgcgggcuccggggccggg

SEQ ID NO: 56614 - RNA, 21 nt, Artificial Sequence
  Synthetic
gccgcgggcuccggggccggg

SEQ ID NO: 56615 - RNA, 22 nt, Artificial Sequence
  Synthetic
cgccgcgggcuccggggccggg

SEQ ID NO: 56616 - RNA, 23 nt, Artificial Sequence
  Synthetic
gcgccgcgggcuccggggccggg

SEQ ID NO: 56617 - RNA, 24 nt, Artificial Sequence
  Synthetic
agcgccgcgggcuccggggccggg

SEQ ID NO: 56618 - RNA, 18 nt, Artificial Sequence
  Synthetic
cggggacccccgggcggg

SEQ ID NO: 56619 - RNA, 19 nt, Artificial Sequence
  Synthetic
ucggggacccccgggcggg

SEQ ID NO: 56620 - RNA, 20 nt, Artificial Sequence
  Synthetic
cucggggacccccgggcggg

SEQ ID NO: 56621 - RNA, 21 nt, Artificial Sequence
  Synthetic
ccucggggacccccgggcggg

SEQ ID NO: 56622 - RNA, 22 nt, Artificial Sequence
  Synthetic
gccucggggacccccgggcggg

SEQ ID NO: 56623 - RNA, 23 nt, Artificial Sequence
  Synthetic
ugccucggggacccccgggcggg

SEQ ID NO: 56624 - RNA, 24 nt, Artificial Sequence
  Synthetic
cugccucggggacccccgggcggg

SEQ ID NO: 56625 - RNA, 18 nt, Artificial Sequence
  Synthetic
gagagagagagagagggg

SEQ ID NO: 56626 - RNA, 19 nt, Artificial Sequence
  Synthetic
agagagagagagagagggg

SEQ ID NO: 56627 - RNA, 20 nt, Artificial Sequence
  Synthetic
gagagagagagagagagggg

SEQ ID NO: 56628 - RNA, 21 nt, Artificial Sequence
  Synthetic
agagagagagagagagagggg

SEQ ID NO: 56629 - RNA, 22 nt, Artificial Sequence
  Synthetic
gagagagagagagagagagggg

SEQ ID NO: 56630 - RNA, 23 nt, Artificial Sequence
  Synthetic
agagagagagagagagagagggg

SEQ ID NO: 56631 - RNA, 24 nt, Artificial Sequence
  Synthetic
gagagagagagagagagagagggg

SEQ ID NO: 56632 - RNA, 18 nt, Artificial Sequence
  Synthetic
gcgccgcgggcuccgggg

SEQ ID NO: 56633 - RNA, 19 nt, Artificial Sequence
  Synthetic
agcgccgcgggcuccgggg

SEQ ID NO: 56634 - RNA, 20 nt, Artificial Sequence
  Synthetic
cagcgccgcgggcuccgggg

SEQ ID NO: 56635 - RNA, 21 nt, Artificial Sequence
  Synthetic
gcagcgccgcgggcuccgggg

SEQ ID NO: 56636 - RNA, 22 nt, Artificial Sequence
  Synthetic
agcagcgccgcgggcuccgggg

SEQ ID NO: 56637 - RNA, 23 nt, Artificial Sequence
  Synthetic
gagcagcgccgcgggcuccgggg

SEQ ID NO: 56638 - RNA, 24 nt, Artificial Sequence
  Synthetic
cgagcagcgccgcgggcuccgggg

SEQ ID NO: 56639 - RNA, 18 nt, Artificial Sequence
  Synthetic
agagagagagagaggggg

SEQ ID NO: 56640 - RNA, 19 nt, Artificial Sequence
  Synthetic
gagagagagagagaggggg

SEQ ID NO: 56641 - RNA, 20 nt, Artificial Sequence
  Synthetic
agagagagagagagaggggg

SEQ ID NO: 56642 - RNA, 21 nt, Artificial Sequence
  Synthetic
gagagagagagagagaggggg

SEQ ID NO: 56643 - RNA, 22 nt, Artificial Sequence
  Synthetic
agagagagagagagagaggggg

SEQ ID NO: 56644 - RNA, 23 nt, Artificial Sequence
  Synthetic
gagagagagagagagagaggggg

SEQ ID NO: 56645 - RNA, 24 nt, Artificial Sequence
  Synthetic
agagagagagagagagagaggggg

SEQ ID NO: 56646 - RNA, 18 nt, Artificial Sequence
  Synthetic
aaagcagcaagagggggg

SEQ ID NO: 56647 - RNA, 19 nt, Artificial Sequence
  Synthetic
aaaagcagcaagagggggg

SEQ ID NO: 56648 - RNA, 20 nt, Artificial Sequence
  Synthetic
gaaaagcagcaagagggggg

SEQ ID NO: 56649 - RNA, 21 nt, Artificial Sequence
  Synthetic
ggaaaagcagcaagagggggg

SEQ ID NO: 56650 - RNA, 22 nt, Artificial Sequence
  Synthetic
cggaaaagcagcaagagggggg

SEQ ID NO: 56651 - RNA, 23 nt, Artificial Sequence
  Synthetic
gcggaaaagcagcaagagggggg

SEQ ID NO: 56652 - RNA, 24 nt, Artificial Sequence
  Synthetic
cgcggaaaagcagcaagagggggg

SEQ ID NO: 56653 - RNA, 18 nt, Artificial Sequence
  Synthetic
gagagagagagagggggg

SEQ ID NO: 56654 - RNA, 19 nt, Artificial Sequence
  Synthetic
agagagagagagagggggg

SEQ ID NO: 56655 - RNA, 20 nt, Artificial Sequence
  Synthetic
gagagagagagagagggggg

SEQ ID NO: 56656 - RNA, 21 nt, Artificial Sequence
  Synthetic
agagagagagagagagggggg

SEQ ID NO: 56657 - RNA, 22 nt, Artificial Sequence
  Synthetic
gagagagagagagagagggggg

SEQ ID NO: 56658 - RNA, 23 nt, Artificial Sequence
  Synthetic
agagagagagagagagagggggg

SEQ ID NO: 56659 - RNA, 24 nt, Artificial Sequence
  Synthetic
gagagagagagagagagagggggg

SEQ ID NO: 56660 - RNA, 18 nt, Artificial Sequence
  Synthetic
agagagagagaggggggg

SEQ ID NO: 56661 - RNA, 19 nt, Artificial Sequence
  Synthetic
gagagagagagaggggggg

SEQ ID NO: 56662 - RNA, 20 nt, Artificial Sequence
  Synthetic
agagagagagagaggggggg

SEQ ID NO: 56663 - RNA, 21 nt, Artificial Sequence
  Synthetic
gagagagagagagaggggggg

SEQ ID NO: 56664 - RNA, 22 nt, Artificial Sequence
  Synthetic
agagagagagagagaggggggg

SEQ ID NO: 56665 - RNA, 23 nt, Artificial Sequence
  Synthetic
gagagagagagagagaggggggg

SEQ ID NO: 56666 - RNA, 24 nt, Artificial Sequence
  Synthetic
agagagagagagagagaggggggg

SEQ ID NO: 56667 - RNA, 18 nt, Artificial Sequence
  Synthetic
gagagagagagggggggg

SEQ ID NO: 56668 - RNA, 19 nt, Artificial Sequence
  Synthetic
agagagagagagggggggg

SEQ ID NO: 56669 - RNA, 20 nt, Artificial Sequence
  Synthetic
gagagagagagagggggggg

SEQ ID NO: 56670 - RNA, 21 nt, Artificial Sequence
  Synthetic
agagagagagagagggggggg

SEQ ID NO: 56671 - RNA, 22 nt, Artificial Sequence
  Synthetic
gagagagagagagagggggggg

SEQ ID NO: 56672 - RNA, 23 nt, Artificial Sequence
  Synthetic
agagagagagagagagggggggg

SEQ ID NO: 56673 - RNA, 24 nt, Artificial Sequence
  Synthetic
gagagagagagagagagggggggg

SEQ ID NO: 56674 - RNA, 18 nt, Artificial Sequence
  Synthetic
agagagagaggggggggg

SEQ ID NO: 56675 - RNA, 19 nt, Artificial Sequence
  Synthetic
gagagagagaggggggggg

SEQ ID NO: 56676 - RNA, 20 nt, Artificial Sequence
  Synthetic
agagagagagaggggggggg

SEQ ID NO: 56677 - RNA, 21 nt, Artificial Sequence
  Synthetic
gagagagagagaggggggggg

SEQ ID NO: 56678 - RNA, 22 nt, Artificial Sequence
  Synthetic
agagagagagagaggggggggg

SEQ ID NO: 56679 - RNA, 23 nt, Artificial Sequence
  Synthetic
gagagagagagagaggggggggg

SEQ ID NO: 56680 - RNA, 24 nt, Artificial Sequence
  Synthetic
agagagagagagagaggggggggg

SEQ ID NO: 56681 - RNA, 18 nt, Artificial Sequence
  Synthetic
gagagagagggggggggg

SEQ ID NO: 56682 - RNA, 19 nt, Artificial Sequence
  Synthetic
agagagagagggggggggg

SEQ ID NO: 56683 - RNA, 20 nt, Artificial Sequence
  Synthetic
gagagagagagggggggggg

SEQ ID NO: 56684 - RNA, 21 nt, Artificial Sequence
  Synthetic
agagagagagagggggggggg

SEQ ID NO: 56685 - RNA, 22 nt, Artificial Sequence
  Synthetic
gagagagagagagggggggggg

SEQ ID NO: 56686 - RNA, 23 nt, Artificial Sequence
  Synthetic
agagagagagagagggggggggg

SEQ ID NO: 56687 - RNA, 24 nt, Artificial Sequence
  Synthetic
gagagagagagagagggggggggg

SEQ ID NO: 56688 - RNA, 18 nt, Artificial Sequence
  Synthetic
gagagagggggggggggg

SEQ ID NO: 56689 - RNA, 19 nt, Artificial Sequence
  Synthetic
agagagagggggggggggg

SEQ ID NO: 56690 - RNA, 20 nt, Artificial Sequence
  Synthetic
gagagagagggggggggggg

SEQ ID NO: 56691 - RNA, 21 nt, Artificial Sequence
  Synthetic
agagagagagggggggggggg

SEQ ID NO: 56692 - RNA, 22 nt, Artificial Sequence
  Synthetic
gagagagagagggggggggggg

SEQ ID NO: 56693 - RNA, 23 nt, Artificial Sequence
  Synthetic
agagagagagagggggggggggg

SEQ ID NO: 56694 - RNA, 24 nt, Artificial Sequence
  Synthetic
gagagagagagagggggggggggg

SEQ ID NO: 56695 - RNA, 18 nt, Artificial Sequence
  Synthetic
aacacucccacguugggg

SEQ ID NO: 56696 - RNA, 19 nt, Artificial Sequence
  Synthetic
aaacacucccacguugggg

SEQ ID NO: 56697 - RNA, 20 nt, Artificial Sequence
  Synthetic
uaaacacucccacguugggg

SEQ ID NO: 56698 - RNA, 21 nt, Artificial Sequence
  Synthetic
uuaaacacucccacguugggg

SEQ ID NO: 56699 - RNA, 22 nt, Artificial Sequence
  Synthetic
auuaaacacucccacguugggg

SEQ ID NO: 56700 - RNA, 23 nt, Artificial Sequence
  Synthetic
cauuaaacacucccacguugggg

SEQ ID NO: 56701 - RNA, 24 nt, Artificial Sequence
  Synthetic
ccauuaaacacucccacguugggg

SEQ ID NO: 56702 - RNA, 18 nt, Artificial Sequence
  Synthetic
aaacacucccacguuggg

SEQ ID NO: 56703 - RNA, 19 nt, Artificial Sequence
  Synthetic
uaaacacucccacguuggg

SEQ ID NO: 56704 - RNA, 20 nt, Artificial Sequence
  Synthetic
uuaaacacucccacguuggg

SEQ ID NO: 56705 - RNA, 21 nt, Artificial Sequence
  Synthetic
auuaaacacucccacguuggg

SEQ ID NO: 56706 - RNA, 22 nt, Artificial Sequence
  Synthetic
cauuaaacacucccacguuggg

SEQ ID NO: 56707 - RNA, 23 nt, Artificial Sequence
  Synthetic
ccauuaaacacucccacguuggg

SEQ ID NO: 56708 - RNA, 24 nt, Artificial Sequence
  Synthetic
uccauuaaacacucccacguuggg

SEQ ID NO: 56709 - RNA, 18 nt, Artificial Sequence
  Synthetic
uaaacacucccacguugg

SEQ ID NO: 56710 - RNA, 19 nt, Artificial Sequence
  Synthetic
uuaaacacucccacguugg

SEQ ID NO: 56711 - RNA, 20 nt, Artificial Sequence
  Synthetic
auuaaacacucccacguugg

SEQ ID NO: 56712 - RNA, 21 nt, Artificial Sequence
  Synthetic
cauuaaacacucccacguugg

SEQ ID NO: 56713 - RNA, 22 nt, Artificial Sequence
  Synthetic
ccauuaaacacucccacguugg

SEQ ID NO: 56714 - RNA, 23 nt, Artificial Sequence
  Synthetic
uccauuaaacacucccacguugg

SEQ ID NO: 56715 - RNA, 24 nt, Artificial Sequence
  Synthetic
uuccauuaaacacucccacguugg

SEQ ID NO: 56716 - RNA, 18 nt, Artificial Sequence
  Synthetic
ggcgagccgggcagagug

SEQ ID NO: 56717 - RNA, 19 nt, Artificial Sequence
  Synthetic
gggcgagccgggcagagug

SEQ ID NO: 56718 - RNA, 20 nt, Artificial Sequence
  Synthetic
ggggcgagccgggcagagug

SEQ ID NO: 56719 - RNA, 21 nt, Artificial Sequence
  Synthetic
cggggcgagccgggcagagug

SEQ ID NO: 56720 - RNA, 22 nt, Artificial Sequence
  Synthetic
acggggcgagccgggcagagug

SEQ ID NO: 56721 - RNA, 23 nt, Artificial Sequence
  Synthetic
gacggggcgagccgggcagagug

SEQ ID NO: 56722 - RNA, 24 nt, Artificial Sequence
  Synthetic
ggacggggcgagccgggcagagug

SEQ ID NO: 56723 - RNA, 18 nt, Artificial Sequence
  Synthetic
uuaaacacucccacguug

SEQ ID NO: 56724 - RNA, 19 nt, Artificial Sequence
  Synthetic
auuaaacacucccacguug

SEQ ID NO: 56725 - RNA, 20 nt, Artificial Sequence
  Synthetic
cauuaaacacucccacguug

SEQ ID NO: 56726 - RNA, 21 nt, Artificial Sequence
  Synthetic
ccauuaaacacucccacguug

SEQ ID NO: 56727 - RNA, 22 nt, Artificial Sequence
  Synthetic
uccauuaaacacucccacguug

SEQ ID NO: 56728 - RNA, 23 nt, Artificial Sequence
  Synthetic
uuccauuaaacacucccacguug

SEQ ID NO: 56729 - RNA, 24 nt, Artificial Sequence
  Synthetic
cuuccauuaaacacucccacguug

SEQ ID NO: 56730 - RNA, 18 nt, Artificial Sequence
  Synthetic
cgccgaucgagagggacu

SEQ ID NO: 56731 - RNA, 19 nt, Artificial Sequence
  Synthetic
ccgccgaucgagagggacu

SEQ ID NO: 56732 - RNA, 20 nt, Artificial Sequence
  Synthetic
gccgccgaucgagagggacu

SEQ ID NO: 56733 - RNA, 21 nt, Artificial Sequence
  Synthetic
cgccgccgaucgagagggacu

SEQ ID NO: 56734 - RNA, 22 nt, Artificial Sequence
  Synthetic
ccgccgccgaucgagagggacu

SEQ ID NO: 56735 - RNA, 23 nt, Artificial Sequence
  Synthetic
cccgccgccgaucgagagggacu

SEQ ID NO: 56736 - RNA, 24 nt, Artificial Sequence
  Synthetic
gcccgccgccgaucgagagggacu

SEQ ID NO: 56737 - RNA, 18 nt, Artificial Sequence
  Synthetic
ccgucuucuuccgcgccu

SEQ ID NO: 56738 - RNA, 19 nt, Artificial Sequence
  Synthetic
cccgucuucuuccgcgccu

SEQ ID NO: 56739 - RNA, 20 nt, Artificial Sequence
  Synthetic
ucccgucuucuuccgcgccu

SEQ ID NO: 56740 - RNA, 21 nt, Artificial Sequence
  Synthetic
cucccgucuucuuccgcgccu

SEQ ID NO: 56741 - RNA, 22 nt, Artificial Sequence
  Synthetic
ccucccgucuucuuccgcgccu

SEQ ID NO: 56742 - RNA, 23 nt, Artificial Sequence
  Synthetic
gccucccgucuucuuccgcgccu

SEQ ID NO: 56743 - RNA, 24 nt, Artificial Sequence
  Synthetic
cgccucccgucuucuuccgcgccu

SEQ ID NO: 56744 - RNA, 18 nt, Artificial Sequence
  Synthetic
gaggguccgccucugccu

SEQ ID NO: 56745 - RNA, 19 nt, Artificial Sequence
  Synthetic
cgaggguccgccucugccu

SEQ ID NO: 56746 - RNA, 20 nt, Artificial Sequence
  Synthetic
ccgaggguccgccucugccu

SEQ ID NO: 56747 - RNA, 21 nt, Artificial Sequence
  Synthetic
uccgaggguccgccucugccu

SEQ ID NO: 56748 - RNA, 22 nt, Artificial Sequence
  Synthetic
cuccgaggguccgccucugccu

SEQ ID NO: 56749 - RNA, 23 nt, Artificial Sequence
  Synthetic
ccuccgaggguccgccucugccu

SEQ ID NO: 56750 - RNA, 24 nt, Artificial Sequence
  Synthetic
gccuccgaggguccgccucugccu

SEQ ID NO: 56751 - RNA, 18 nt, Artificial Sequence
  Synthetic
cgagcagcgccgcgggcu

SEQ ID NO: 56752 - RNA, 19 nt, Artificial Sequence
  Synthetic
ccgagcagcgccgcgggcu

SEQ ID NO: 56753 - RNA, 20 nt, Artificial Sequence
  Synthetic
gccgagcagcgccgcgggcu

SEQ ID NO: 56754 - RNA, 21 nt, Artificial Sequence
  Synthetic
agccgagcagcgccgcgggcu

SEQ ID NO: 56755 - RNA, 22 nt, Artificial Sequence
  Synthetic
cagccgagcagcgccgcgggcu

SEQ ID NO: 56756 - RNA, 23 nt, Artificial Sequence
  Synthetic
gcagccgagcagcgccgcgggcu

SEQ ID NO: 56757 - RNA, 24 nt, Artificial Sequence
  Synthetic
cgcagccgagcagcgccgcgggcu

SEQ ID NO: 56758 - RNA, 18 nt, Artificial Sequence
  Synthetic
ccccgcccgcguguugcu

SEQ ID NO: 56759 - RNA, 19 nt, Artificial Sequence
  Synthetic
gccccgcccgcguguugcu

SEQ ID NO: 56760 - RNA, 20 nt, Artificial Sequence
  Synthetic
agccccgcccgcguguugcu

SEQ ID NO: 56761 - RNA, 21 nt, Artificial Sequence
  Synthetic
gagccccgcccgcguguugcu

SEQ ID NO: 56762 - RNA, 22 nt, Artificial Sequence
  Synthetic
cgagccccgcccgcguguugcu

SEQ ID NO: 56763 - RNA, 23 nt, Artificial Sequence
  Synthetic
ccgagccccgcccgcguguugcu

SEQ ID NO: 56764 - RNA, 24 nt, Artificial Sequence
  Synthetic
cccgagccccgcccgcguguugcu

SEQ ID NO: 56765 - RNA, 18 nt, Artificial Sequence
  Synthetic
gggcgagccgggcagagu

SEQ ID NO: 56766 - RNA, 19 nt, Artificial Sequence
  Synthetic
ggggcgagccgggcagagu

SEQ ID NO: 56767 - RNA, 20 nt, Artificial Sequence
  Synthetic
cggggcgagccgggcagagu

SEQ ID NO: 56768 - RNA, 21 nt, Artificial Sequence
  Synthetic
acggggcgagccgggcagagu

SEQ ID NO: 56769 - RNA, 22 nt, Artificial Sequence
  Synthetic
gacggggcgagccgggcagagu

SEQ ID NO: 56770 - RNA, 23 nt, Artificial Sequence
  Synthetic
ggacggggcgagccgggcagagu

SEQ ID NO: 56771 - RNA, 24 nt, Artificial Sequence
  Synthetic
gggacggggcgagccgggcagagu

SEQ ID NO: 56772 - RNA, 18 nt, Artificial Sequence
  Synthetic
cauuaaacacucccacgu

SEQ ID NO: 56773 - RNA, 19 nt, Artificial Sequence
  Synthetic
ccauuaaacacucccacgu

SEQ ID NO: 56774 - RNA, 20 nt, Artificial Sequence
  Synthetic
uccauuaaacacucccacgu

SEQ ID NO: 56775 - RNA, 21 nt, Artificial Sequence
  Synthetic
uuccauuaaacacucccacgu

SEQ ID NO: 56776 - RNA, 22 nt, Artificial Sequence
  Synthetic
cuuccauuaaacacucccacgu

SEQ ID NO: 56777 - RNA, 23 nt, Artificial Sequence
  Synthetic
ccuuccauuaaacacucccacgu

SEQ ID NO: 56778 - RNA, 24 nt, Artificial Sequence
  Synthetic
cccuuccauuaaacacucccacgu

SEQ ID NO: 56779 - RNA, 18 nt, Artificial Sequence
  Synthetic
auuaaacacucccacguu

SEQ ID NO: 56780 - RNA, 19 nt, Artificial Sequence
  Synthetic
cauuaaacacucccacguu

SEQ ID NO: 56781 - RNA, 20 nt, Artificial Sequence
  Synthetic
ccauuaaacacucccacguu

SEQ ID NO: 56782 - RNA, 21 nt, Artificial Sequence
  Synthetic
uccauuaaacacucccacguu

SEQ ID NO: 56783 - RNA, 22 nt, Artificial Sequence
  Synthetic
uuccauuaaacacucccacguu

SEQ ID NO: 56784 - RNA, 23 nt, Artificial Sequence
  Synthetic
cuuccauuaaacacucccacguu

SEQ ID NO: 56785 - RNA, 24 nt, Artificial Sequence
  Synthetic
ccuuccauuaaacacucccacguu

SEQ ID NO: 56786 - RNA, 18 nt, Artificial Sequence
  Synthetic
gcugagugcucugcgguu

SEQ ID NO: 56787 - RNA, 19 nt, Artificial Sequence
  Synthetic
agcugagugcucugcgguu

SEQ ID NO: 56788 - RNA, 20 nt, Artificial Sequence
  Synthetic
cagcugagugcucugcgguu

SEQ ID NO: 56789 - RNA, 21 nt, Artificial Sequence
  Synthetic
ccagcugagugcucugcgguu

SEQ ID NO: 56790 - RNA, 22 nt, Artificial Sequence
  Synthetic
gccagcugagugcucugcgguu

SEQ ID NO: 56791 - RNA, 23 nt, Artificial Sequence
  Synthetic
cgccagcugagugcucugcgguu

SEQ ID NO: 56792 - RNA, 24 nt, Artificial Sequence
  Synthetic
gcgccagcugagugcucugcgguu

SEQ ID NO: 56793 - RNA, 19 nt, Artificial Sequence
  Synthetic
gccggagaauggaaggcga

SEQ ID NO: 56794 - RNA, 20 nt, Artificial Sequence
  Synthetic
ggccggagaauggaaggcga

SEQ ID NO: 56795 - RNA, 21 nt, Artificial Sequence
  Synthetic
gggccggagaauggaaggcga

SEQ ID NO: 56796 - RNA, 23 nt, Artificial Sequence
  Synthetic
gagggccggagaauggaaggcga

SEQ ID NO: 56797 - RNA, 24 nt, Artificial Sequence
  Synthetic
ggagggccggagaauggaaggcga

SEQ ID NO: 56798 - RNA, 18 nt, Artificial Sequence
  Synthetic
gccccccccccccggagc

SEQ ID NO: 56799 - RNA, 20 nt, Artificial Sequence
  Synthetic
gcgccccccccccccggagc

SEQ ID NO: 56800 - RNA, 21 nt, Artificial Sequence
  Synthetic
ggcgccccccccccccggagc

SEQ ID NO: 56801 - RNA, 24 nt, Artificial Sequence
  Synthetic
gcaggcgccccccccccccggagc

SEQ ID NO: 56802 - RNA, 18 nt, Artificial Sequence
  Synthetic
gaggagaagggaaggggc

SEQ ID NO: 56803 - RNA, 21 nt, Artificial Sequence
  Synthetic
gacgaggagaagggaaggggc

SEQ ID NO: 56804 - RNA, 24 nt, Artificial Sequence
  Synthetic
gaagacgaggagaagggaaggggc

SEQ ID NO: 56805 - RNA, 19 nt, Artificial Sequence
  Synthetic
gccucuccggcugcggugc

SEQ ID NO: 56806 - RNA, 20 nt, Artificial Sequence
  Synthetic
ggccucuccggcugcggugc

SEQ ID NO: 56807 - RNA, 24 nt, Artificial Sequence
  Synthetic
gcucggccucuccggcugcggugc

SEQ ID NO: 56808 - RNA, 18 nt, Artificial Sequence
  Synthetic
ggguggggggagaguguc

SEQ ID NO: 56809 - RNA, 19 nt, Artificial Sequence
  Synthetic
gggguggggggagaguguc

SEQ ID NO: 56810 - RNA, 22 nt, Artificial Sequence
  Synthetic
gucgggguggggggagaguguc

SEQ ID NO: 56811 - RNA, 23 nt, Artificial Sequence
  Synthetic
ggucgggguggggggagaguguc

SEQ ID NO: 56812 - RNA, 18 nt, Artificial Sequence
  Synthetic
ggcgaggggaugcaggag

SEQ ID NO: 56813 - RNA, 21 nt, Artificial Sequence
  Synthetic
gaaggcgaggggaugcaggag

SEQ ID NO: 56814 - RNA, 22 nt, Artificial Sequence
  Synthetic
ggaaggcgaggggaugcaggag

SEQ ID NO: 56815 - RNA, 18 nt, Artificial Sequence
  Synthetic
gcugcgggcgcgggguag

SEQ ID NO: 56816 - RNA, 19 nt, Artificial Sequence
  Synthetic
ggcugcgggcgcgggguag

SEQ ID NO: 56817 - RNA, 21 nt, Artificial Sequence
  Synthetic
gaggcugcgggcgcgggguag

SEQ ID NO: 56818 - RNA, 22 nt, Artificial Sequence
  Synthetic
ggaggcugcgggcgcgggguag

SEQ ID NO: 56819 - RNA, 18 nt, Artificial Sequence
  Synthetic
gggacucgcggagggccg

SEQ ID NO: 56820 - RNA, 21 nt, Artificial Sequence
  Synthetic
gucgggacucgcggagggccg

SEQ ID NO: 56821 - RNA, 23 nt, Artificial Sequence
  Synthetic
gcgucgggacucgcggagggccg

SEQ ID NO: 56822 - RNA, 24 nt, Artificial Sequence
  Synthetic
ggcgucgggacucgcggagggccg

SEQ ID NO: 56823 - RNA, 20 nt, Artificial Sequence
  Synthetic
gcugccggaggcugcgggcg

SEQ ID NO: 56824 - RNA, 22 nt, Artificial Sequence
  Synthetic
gugcugccggaggcugcgggcg

SEQ ID NO: 56825 - RNA, 24 nt, Artificial Sequence
  Synthetic
gcgugcugccggaggcugcgggcg

SEQ ID NO: 56826 - RNA, 19 nt, Artificial Sequence
  Synthetic
gcggcggucgggguggggg

SEQ ID NO: 56827 - RNA, 20 nt, Artificial Sequence
  Synthetic
ggcggcggucgggguggggg

SEQ ID NO: 56828 - RNA, 22 nt, Artificial Sequence
  Synthetic
gcggcggcggucgggguggggg

SEQ ID NO: 56829 - RNA, 24 nt, Artificial Sequence
  Synthetic
gcgcggcggcggucgggguggggg

SEQ ID NO: 56830 - RNA, 19 nt, Artificial Sequence
  Synthetic
gcgcgggguaggugggugg

SEQ ID NO: 56831 - RNA, 20 nt, Artificial Sequence
  Synthetic
ggcgcgggguaggugggugg

SEQ ID NO: 56832 - RNA, 21 nt, Artificial Sequence
  Synthetic
gggcgcgggguaggugggugg

SEQ ID NO: 56833 - RNA, 23 nt, Artificial Sequence
  Synthetic
gcgggcgcgggguaggugggugg

SEQ ID NO: 56834 - RNA, 18 nt, Artificial Sequence
  Synthetic
guggggcgcggcggcggu

SEQ ID NO: 56835 - RNA, 19 nt, Artificial Sequence
  Synthetic
gguggggcgcggcggcggu

SEQ ID NO: 56836 - RNA, 22 nt, Artificial Sequence
  Synthetic
gccgguggggcgcggcggcggu

SEQ ID NO: 56837 - RNA, 22 nt, Artificial Sequence
  Synthetic
gccuuccauucuccggcccucc

SEQ ID NO: 56838 - RNA, 19 nt, Artificial Sequence
  Synthetic
gcggaagagagaagagagc

SEQ ID NO: 56839 - RNA, 20 nt, Artificial Sequence
  Synthetic
ggcggaagagagaagagagc

SEQ ID NO: 56840 - RNA, 21 nt, Artificial Sequence
  Synthetic
gggcggaagagagaagagagc

SEQ ID NO: 56841 - RNA, 23 nt, Artificial Sequence
  Synthetic
gcgggcggaagagagaagagagc

SEQ ID NO: 56842 - RNA, 24 nt, Artificial Sequence
  Synthetic
ggcgggcggaagagagaagagagc

SEQ ID NO: 56843 - RNA, 18 nt, Artificial Sequence
  Synthetic
guggaaagcggaaaaacg

SEQ ID NO: 56844 - RNA, 19 nt, Artificial Sequence
  Synthetic
gguggaaagcggaaaaacg

SEQ ID NO: 56845 - RNA, 21 nt, Artificial Sequence
  Synthetic
gcgguggaaagcggaaaaacg

SEQ ID NO: 56846 - RNA, 22 nt, Artificial Sequence
  Synthetic
ggcgguggaaagcggaaaaacg

SEQ ID NO: 56847 - RNA, 24 nt, Artificial Sequence
  Synthetic
gcggcgguggaaagcggaaaaacg

SEQ ID NO: 56848 - RNA, 20 nt, Artificial Sequence
  Synthetic
gcagccggagaggccgagcg

SEQ ID NO: 56849 - RNA, 19 nt, Artificial Sequence
  Synthetic
gcgggcgggcgaaggaagg

SEQ ID NO: 56850 - RNA, 20 nt, Artificial Sequence
  Synthetic
ggcgggcgggcgaaggaagg

SEQ ID NO: 56851 - RNA, 22 nt, Artificial Sequence
  Synthetic
gaggcgggcgggcgaaggaagg

SEQ ID NO: 56852 - RNA, 24 nt, Artificial Sequence
  Synthetic
gcgaggcgggcgggcgaaggaagg

SEQ ID NO: 56853 - RNA, 18 nt, Artificial Sequence
  Synthetic
gccgccgcgccccaccgg

SEQ ID NO: 56854 - RNA, 22 nt, Artificial Sequence
  Synthetic
gaccgccgccgcgccccaccgg

SEQ ID NO: 56855 - RNA, 18 nt, Artificial Sequence
  Synthetic
ggggggaacacggggggg

SEQ ID NO: 56856 - RNA, 21 nt, Artificial Sequence
  Synthetic
gauggggggaacacggggggg

SEQ ID NO: 56857 - RNA, 19 nt, Artificial Sequence
  Synthetic
gauggaagggcagaagaug

SEQ ID NO: 56858 - RNA, 20 nt, Artificial Sequence
  Synthetic
ggauggaagggcagaagaug

SEQ ID NO: 56859 - RNA, 22 nt, Artificial Sequence
  Synthetic
gaggauggaagggcagaagaug

SEQ ID NO: 56860 - RNA, 23 nt, Artificial Sequence
  Synthetic
ggaggauggaagggcagaagaug

SEQ ID NO: 56861 - RNA, 19 nt, Artificial Sequence
  Synthetic
gcgcggcggcggucggggu

SEQ ID NO: 56862 - RNA, 20 nt, Artificial Sequence
  Synthetic
ggcgcggcggcggucggggu

SEQ ID NO: 56863 - RNA, 19 nt, Artificial Sequence
  Synthetic
gcguucucgcagguagguu

SEQ ID NO: 56864 - RNA, 21 nt, Artificial Sequence
  Synthetic
gcgcguucucgcagguagguu

SEQ ID NO: 56865 - RNA, 24 nt, Artificial Sequence
  Synthetic
gccgcgcguucucgcagguagguu

SEQ ID NO: 56866 - RNA, 18 nt, Artificial Sequence
  Synthetic
caaaaacaccuagaaaaa

SEQ ID NO: 56867 - RNA, 19 nt, Artificial Sequence
  Synthetic
acaaaaacaccuagaaaaa

SEQ ID NO: 56868 - RNA, 20 nt, Artificial Sequence
  Synthetic
aacaaaaacaccuagaaaaa

SEQ ID NO: 56869 - RNA, 21 nt, Artificial Sequence
  Synthetic
aaacaaaaacaccuagaaaaa

SEQ ID NO: 56870 - RNA, 22 nt, Artificial Sequence
  Synthetic
aaaacaaaaacaccuagaaaaa

SEQ ID NO: 56871 - RNA, 23 nt, Artificial Sequence
  Synthetic
aaaaacaaaaacaccuagaaaaa

SEQ ID NO: 56872 - RNA, 24 nt, Artificial Sequence
  Synthetic
caaaaacaaaaacaccuagaaaaa

SEQ ID NO: 56873 - RNA, 18 nt, Artificial Sequence
  Synthetic
ccggagaauggaaggcga

SEQ ID NO: 56874 - RNA, 22 nt, Artificial Sequence
  Synthetic
agggccggagaauggaaggcga

SEQ ID NO: 56875 - RNA, 19 nt, Artificial Sequence
  Synthetic
cgccccccccccccggagc

SEQ ID NO: 56876 - RNA, 22 nt, Artificial Sequence
  Synthetic
aggcgccccccccccccggagc

SEQ ID NO: 56877 - RNA, 23 nt, Artificial Sequence
  Synthetic
caggcgccccccccccccggagc

SEQ ID NO: 56878 - RNA, 19 nt, Artificial Sequence
  Synthetic
cgaggagaagggaaggggc

SEQ ID NO: 56879 - RNA, 20 nt, Artificial Sequence
  Synthetic
acgaggagaagggaaggggc

SEQ ID NO: 56880 - RNA, 22 nt, Artificial Sequence
  Synthetic
agacgaggagaagggaaggggc

SEQ ID NO: 56881 - RNA, 23 nt, Artificial Sequence
  Synthetic
aagacgaggagaagggaaggggc

SEQ ID NO: 56882 - RNA, 18 nt, Artificial Sequence
  Synthetic
ccucuccggcugcggugc

SEQ ID NO: 56883 - RNA, 21 nt, Artificial Sequence
  Synthetic
cggccucuccggcugcggugc

SEQ ID NO: 56884 - RNA, 22 nt, Artificial Sequence
  Synthetic
ucggccucuccggcugcggugc

SEQ ID NO: 56885 - RNA, 23 nt, Artificial Sequence
  Synthetic
cucggccucuccggcugcggugc

SEQ ID NO: 56886 - RNA, 20 nt, Artificial Sequence
  Synthetic
cgggguggggggagaguguc

SEQ ID NO: 56887 - RNA, 21 nt, Artificial Sequence
  Synthetic
ucgggguggggggagaguguc

SEQ ID NO: 56888 - RNA, 24 nt, Artificial Sequence
  Synthetic
cggucgggguggggggagaguguc

SEQ ID NO: 56889 - RNA, 19 nt, Artificial Sequence
  Synthetic
aggcgaggggaugcaggag

SEQ ID NO: 56890 - RNA, 20 nt, Artificial Sequence
  Synthetic
aaggcgaggggaugcaggag

SEQ ID NO: 56891 - RNA, 23 nt, Artificial Sequence
  Synthetic
uggaaggcgaggggaugcaggag

SEQ ID NO: 56892 - RNA, 24 nt, Artificial Sequence
  Synthetic
auggaaggcgaggggaugcaggag

SEQ ID NO: 56893 - RNA, 20 nt, Artificial Sequence
  Synthetic
aggcugcgggcgcgggguag

SEQ ID NO: 56894 - RNA, 23 nt, Artificial Sequence
  Synthetic
cggaggcugcgggcgcgggguag

SEQ ID NO: 56895 - RNA, 24 nt, Artificial Sequence
  Synthetic
ccggaggcugcgggcgcgggguag

SEQ ID NO: 56896 - RNA, 19 nt, Artificial Sequence
  Synthetic
cgggacucgcggagggccg

SEQ ID NO: 56897 - RNA, 20 nt, Artificial Sequence
  Synthetic
ucgggacucgcggagggccg

SEQ ID NO: 56898 - RNA, 22 nt, Artificial Sequence
  Synthetic
cgucgggacucgcggagggccg

SEQ ID NO: 56899 - RNA, 18 nt, Artificial Sequence
  Synthetic
ugccggaggcugcgggcg

SEQ ID NO: 56900 - RNA, 19 nt, Artificial Sequence
  Synthetic
cugccggaggcugcgggcg

SEQ ID NO: 56901 - RNA, 21 nt, Artificial Sequence
  Synthetic
ugcugccggaggcugcgggcg

SEQ ID NO: 56902 - RNA, 23 nt, Artificial Sequence
  Synthetic
cgugcugccggaggcugcgggcg

SEQ ID NO: 56903 - RNA, 18 nt, Artificial Sequence
  Synthetic
cggcggucgggguggggg

SEQ ID NO: 56904 - RNA, 21 nt, Artificial Sequence
  Synthetic
cggcggcggucgggguggggg

SEQ ID NO: 56905 - RNA, 23 nt, Artificial Sequence
  Synthetic
cgcggcggcggucgggguggggg

SEQ ID NO: 56906 - RNA, 18 nt, Artificial Sequence
  Synthetic
cgcgggguaggugggugg

SEQ ID NO: 56907 - RNA, 22 nt, Artificial Sequence
  Synthetic
cgggcgcgggguaggugggugg

SEQ ID NO: 56908 - RNA, 24 nt, Artificial Sequence
  Synthetic
ugcgggcgcgggguaggugggugg

SEQ ID NO: 56909 - RNA, 18 nt, Artificial Sequence
  Synthetic
ccgcgccuuggcuguuug

SEQ ID NO: 56910 - RNA, 19 nt, Artificial Sequence
  Synthetic
accgcgccuuggcuguuug

SEQ ID NO: 56911 - RNA, 20 nt, Artificial Sequence
  Synthetic
caccgcgccuuggcuguuug

SEQ ID NO: 56912 - RNA, 21 nt, Artificial Sequence
  Synthetic
ccaccgcgccuuggcuguuug

SEQ ID NO: 56913 - RNA, 22 nt, Artificial Sequence
  Synthetic
cccaccgcgccuuggcuguuug

SEQ ID NO: 56914 - RNA, 23 nt, Artificial Sequence
  Synthetic
ccccaccgcgccuuggcuguuug

SEQ ID NO: 56915 - RNA, 24 nt, Artificial Sequence
  Synthetic
cccccaccgcgccuuggcuguuug

SEQ ID NO: 56916 - RNA, 18 nt, Artificial Sequence
  Synthetic
caccuagaaaaaaaggau

SEQ ID NO: 56917 - RNA, 19 nt, Artificial Sequence
  Synthetic
acaccuagaaaaaaaggau

SEQ ID NO: 56918 - RNA, 20 nt, Artificial Sequence
  Synthetic
aacaccuagaaaaaaaggau

SEQ ID NO: 56919 - RNA, 21 nt, Artificial Sequence
  Synthetic
aaacaccuagaaaaaaaggau

SEQ ID NO: 56920 - RNA, 22 nt, Artificial Sequence
  Synthetic
aaaacaccuagaaaaaaaggau

SEQ ID NO: 56921 - RNA, 23 nt, Artificial Sequence
  Synthetic
aaaaacaccuagaaaaaaaggau

SEQ ID NO: 56922 - RNA, 24 nt, Artificial Sequence
  Synthetic
caaaaacaccuagaaaaaaaggau

SEQ ID NO: 56923 - RNA, 20 nt, Artificial Sequence
  Synthetic
cgguggggcgcggcggcggu

SEQ ID NO: 56924 - RNA, 21 nt, Artificial Sequence
  Synthetic
ccgguggggcgcggcggcggu

SEQ ID NO: 56925 - RNA, 23 nt, Artificial Sequence
  Synthetic
cgccgguggggcgcggcggcggu

SEQ ID NO: 56926 - RNA, 24 nt, Artificial Sequence
  Synthetic
ccgccgguggggcgcggcggcggu

SEQ ID NO: 56927 - RNA, 18 nt, Artificial Sequence
  Synthetic
uccauucuccggcccucc

SEQ ID NO: 56928 - RNA, 19 nt, Artificial Sequence
  Synthetic
uuccauucuccggcccucc

SEQ ID NO: 56929 - RNA, 20 nt, Artificial Sequence
  Synthetic
cuuccauucuccggcccucc

SEQ ID NO: 56930 - RNA, 21 nt, Artificial Sequence
  Synthetic
ccuuccauucuccggcccucc

SEQ ID NO: 56931 - RNA, 23 nt, Artificial Sequence
  Synthetic
cgccuuccauucuccggcccucc

SEQ ID NO: 56932 - RNA, 24 nt, Artificial Sequence
  Synthetic
ucgccuuccauucuccggcccucc

SEQ ID NO: 56933 - RNA, 18 nt, Artificial Sequence
  Synthetic
cggaagagagaagagagc

SEQ ID NO: 56934 - RNA, 22 nt, Artificial Sequence
  Synthetic
cgggcggaagagagaagagagc

SEQ ID NO: 56935 - RNA, 18 nt, Artificial Sequence
  Synthetic
uuucaagaaacacgaggc

SEQ ID NO: 56936 - RNA, 19 nt, Artificial Sequence
  Synthetic
cuuucaagaaacacgaggc

SEQ ID NO: 56937 - RNA, 20 nt, Artificial Sequence
  Synthetic
ccuuucaagaaacacgaggc

SEQ ID NO: 56938 - RNA, 21 nt, Artificial Sequence
  Synthetic
cccuuucaagaaacacgaggc

SEQ ID NO: 56939 - RNA, 22 nt, Artificial Sequence
  Synthetic
ccccuuucaagaaacacgaggc

SEQ ID NO: 56940 - RNA, 23 nt, Artificial Sequence
  Synthetic
cccccuuucaagaaacacgaggc

SEQ ID NO: 56941 - RNA, 24 nt, Artificial Sequence
  Synthetic
ucccccuuucaagaaacacgaggc

SEQ ID NO: 56942 - RNA, 20 nt, Artificial Sequence
  Synthetic
cgguggaaagcggaaaaacg

SEQ ID NO: 56943 - RNA, 23 nt, Artificial Sequence
  Synthetic
cggcgguggaaagcggaaaaacg

SEQ ID NO: 56944 - RNA, 18 nt, Artificial Sequence
  Synthetic
agccggagaggccgagcg

SEQ ID NO: 56945 - RNA, 19 nt, Artificial Sequence
  Synthetic
cagccggagaggccgagcg

SEQ ID NO: 56946 - RNA, 21 nt, Artificial Sequence
  Synthetic
cgcagccggagaggccgagcg

SEQ ID NO: 56947 - RNA, 22 nt, Artificial Sequence
  Synthetic
ccgcagccggagaggccgagcg

SEQ ID NO: 56948 - RNA, 23 nt, Artificial Sequence
  Synthetic
accgcagccggagaggccgagcg

SEQ ID NO: 56949 - RNA, 24 nt, Artificial Sequence
  Synthetic
caccgcagccggagaggccgagcg

SEQ ID NO: 56950 - RNA, 18 nt, Artificial Sequence
  Synthetic
cgggcgggcgaaggaagg

SEQ ID NO: 56951 - RNA, 21 nt, Artificial Sequence
  Synthetic
aggcgggcgggcgaaggaagg

SEQ ID NO: 56952 - RNA, 23 nt, Artificial Sequence
  Synthetic
cgaggcgggcgggcgaaggaagg

SEQ ID NO: 56953 - RNA, 19 nt, Artificial Sequence
  Synthetic
cgccgccgcgccccaccgg

SEQ ID NO: 56954 - RNA, 20 nt, Artificial Sequence
  Synthetic
ccgccgccgcgccccaccgg

SEQ ID NO: 56955 - RNA, 21 nt, Artificial Sequence
  Synthetic
accgccgccgcgccccaccgg

SEQ ID NO: 56956 - RNA, 23 nt, Artificial Sequence
  Synthetic
cgaccgccgccgcgccccaccgg

SEQ ID NO: 56957 - RNA, 24 nt, Artificial Sequence
  Synthetic
ccgaccgccgccgcgccccaccgg

SEQ ID NO: 56958 - RNA, 19 nt, Artificial Sequence
  Synthetic
uggggggaacacggggggg

SEQ ID NO: 56959 - RNA, 20 nt, Artificial Sequence
  Synthetic
auggggggaacacggggggg

SEQ ID NO: 56960 - RNA, 22 nt, Artificial Sequence
  Synthetic
cgauggggggaacacggggggg

SEQ ID NO: 56961 - RNA, 23 nt, Artificial Sequence
  Synthetic
acgauggggggaacacggggggg

SEQ ID NO: 56962 - RNA, 24 nt, Artificial Sequence
  Synthetic
aacgauggggggaacacggggggg

SEQ ID NO: 56963 - RNA, 18 nt, Artificial Sequence
  Synthetic
auggaagggcagaagaug

SEQ ID NO: 56964 - RNA, 21 nt, Artificial Sequence
  Synthetic
aggauggaagggcagaagaug

SEQ ID NO: 56965 - RNA, 24 nt, Artificial Sequence
  Synthetic
cggaggauggaagggcagaagaug

SEQ ID NO: 56966 - RNA, 18 nt, Artificial Sequence
  Synthetic
cgcggcggcggucggggu

SEQ ID NO: 56967 - RNA, 18 nt, Artificial Sequence
  Synthetic
cguucucgcagguagguu

SEQ ID NO: 56968 - RNA, 20 nt, Artificial Sequence
  Synthetic
cgcguucucgcagguagguu

SEQ ID NO: 56969 - RNA, 22 nt, Artificial Sequence
  Synthetic
cgcgcguucucgcagguagguu

SEQ ID NO: 56970 - RNA, 23 nt, Artificial Sequence
  Synthetic
ccgcgcguucucgcagguagguu

SEQ ID NO: 56971 - RNA, 18 nt, Artificial Sequence
  Synthetic
uaacaaaacaaacaaaaa

SEQ ID NO: 56972 - RNA, 19 nt, Artificial Sequence
  Synthetic
auaacaaaacaaacaaaaa

SEQ ID NO: 56973 - RNA, 20 nt, Artificial Sequence
  Synthetic
aauaacaaaacaaacaaaaa

SEQ ID NO: 56974 - RNA, 21 nt, Artificial Sequence
  Synthetic
uaauaacaaaacaaacaaaaa

SEQ ID NO: 56975 - RNA, 22 nt, Artificial Sequence
  Synthetic
auaauaacaaaacaaacaaaaa

SEQ ID NO: 56976 - RNA, 23 nt, Artificial Sequence
  Synthetic
aauaauaacaaaacaaacaaaaa

SEQ ID NO: 56977 - RNA, 24 nt, Artificial Sequence
  Synthetic
aaauaauaacaaaacaaacaaaaa

SEQ ID NO: 56978 - RNA, 18 nt, Artificial Sequence
  Synthetic
gccucguguuucuugaaa

SEQ ID NO: 56979 - RNA, 19 nt, Artificial Sequence
  Synthetic
cgccucguguuucuugaaa

SEQ ID NO: 56980 - RNA, 20 nt, Artificial Sequence
  Synthetic
ccgccucguguuucuugaaa

SEQ ID NO: 56981 - RNA, 21 nt, Artificial Sequence
  Synthetic
cccgccucguguuucuugaaa

SEQ ID NO: 56982 - RNA, 22 nt, Artificial Sequence
  Synthetic
ccccgccucguguuucuugaaa

SEQ ID NO: 56983 - RNA, 23 nt, Artificial Sequence
  Synthetic
cccccgccucguguuucuugaaa

SEQ ID NO: 56984 - RNA, 24 nt, Artificial Sequence
  Synthetic
acccccgccucguguuucuugaaa

SEQ ID NO: 56985 - RNA, 18 nt, Artificial Sequence
  Synthetic
gggggaagacgaggagaa

SEQ ID NO: 56986 - RNA, 19 nt, Artificial Sequence
  Synthetic
cgggggaagacgaggagaa

SEQ ID NO: 56987 - RNA, 20 nt, Artificial Sequence
  Synthetic
acgggggaagacgaggagaa

SEQ ID NO: 56988 - RNA, 21 nt, Artificial Sequence
  Synthetic
gacgggggaagacgaggagaa

SEQ ID NO: 56989 - RNA, 22 nt, Artificial Sequence
  Synthetic
ggacgggggaagacgaggagaa

SEQ ID NO: 56990 - RNA, 23 nt, Artificial Sequence
  Synthetic
gggacgggggaagacgaggagaa

SEQ ID NO: 56991 - RNA, 24 nt, Artificial Sequence
  Synthetic
cgggacgggggaagacgaggagaa

SEQ ID NO: 56992 - RNA, 18 nt, Artificial Sequence
  Synthetic
ucgcggagggccggagaa

SEQ ID NO: 56993 - RNA, 19 nt, Artificial Sequence
  Synthetic
cucgcggagggccggagaa

SEQ ID NO: 56994 - RNA, 20 nt, Artificial Sequence
  Synthetic
acucgcggagggccggagaa

SEQ ID NO: 56995 - RNA, 21 nt, Artificial Sequence
  Synthetic
gacucgcggagggccggagaa

SEQ ID NO: 56996 - RNA, 22 nt, Artificial Sequence
  Synthetic
ggacucgcggagggccggagaa

SEQ ID NO: 56997 - RNA, 23 nt, Artificial Sequence
  Synthetic
gggacucgcggagggccggagaa

SEQ ID NO: 56998 - RNA, 24 nt, Artificial Sequence
  Synthetic
cgggacucgcggagggccggagaa

SEQ ID NO: 56999 - RNA, 18 nt, Artificial Sequence
  Synthetic
acagagagagagaaggaa

SEQ ID NO: 57000 - RNA, 19 nt, Artificial Sequence
  Synthetic
gacagagagagagaaggaa

SEQ ID NO: 57001 - RNA, 20 nt, Artificial Sequence
  Synthetic
agacagagagagagaaggaa

SEQ ID NO: 57002 - RNA, 21 nt, Artificial Sequence
  Synthetic
gagacagagagagagaaggaa

SEQ ID NO: 57003 - RNA, 22 nt, Artificial Sequence
  Synthetic
cgagacagagagagagaaggaa

SEQ ID NO: 57004 - RNA, 23 nt, Artificial Sequence
  Synthetic
gcgagacagagagagagaaggaa

SEQ ID NO: 57005 - RNA, 24 nt, Artificial Sequence
  Synthetic
agcgagacagagagagagaaggaa

SEQ ID NO: 57006 - RNA, 18 nt, Artificial Sequence
  Synthetic
cgccucguguuucuugaa

SEQ ID NO: 57007 - RNA, 19 nt, Artificial Sequence
  Synthetic
ccgccucguguuucuugaa

SEQ ID NO: 57008 - RNA, 20 nt, Artificial Sequence
  Synthetic
cccgccucguguuucuugaa

SEQ ID NO: 57009 - RNA, 21 nt, Artificial Sequence
  Synthetic
ccccgccucguguuucuugaa

SEQ ID NO: 57010 - RNA, 22 nt, Artificial Sequence
  Synthetic
cccccgccucguguuucuugaa

SEQ ID NO: 57011 - RNA, 23 nt, Artificial Sequence
  Synthetic
acccccgccucguguuucuugaa

SEQ ID NO: 57012 - RNA, 24 nt, Artificial Sequence
  Synthetic
gacccccgccucguguuucuugaa

SEQ ID NO: 57013 - RNA, 18 nt, Artificial Sequence
  Synthetic
ugugaggagagcgagaca

SEQ ID NO: 57014 - RNA, 19 nt, Artificial Sequence
  Synthetic
augugaggagagcgagaca

SEQ ID NO: 57015 - RNA, 20 nt, Artificial Sequence
  Synthetic
aaugugaggagagcgagaca

SEQ ID NO: 57016 - RNA, 21 nt, Artificial Sequence
  Synthetic
aaaugugaggagagcgagaca

SEQ ID NO: 57017 - RNA, 22 nt, Artificial Sequence
  Synthetic
gaaaugugaggagagcgagaca

SEQ ID NO: 57018 - RNA, 23 nt, Artificial Sequence
  Synthetic
ggaaaugugaggagagcgagaca

SEQ ID NO: 57019 - RNA, 24 nt, Artificial Sequence
  Synthetic
gggaaaugugaggagagcgagaca

SEQ ID NO: 57020 - RNA, 18 nt, Artificial Sequence
  Synthetic
cucggugggacgcgggca

SEQ ID NO: 57021 - RNA, 19 nt, Artificial Sequence
  Synthetic
ucucggugggacgcgggca

SEQ ID NO: 57022 - RNA, 20 nt, Artificial Sequence
  Synthetic
gucucggugggacgcgggca

SEQ ID NO: 57023 - RNA, 21 nt, Artificial Sequence
  Synthetic
cgucucggugggacgcgggca

SEQ ID NO: 57024 - RNA, 22 nt, Artificial Sequence
  Synthetic
gcgucucggugggacgcgggca

SEQ ID NO: 57025 - RNA, 23 nt, Artificial Sequence
  Synthetic
ggcgucucggugggacgcgggca

SEQ ID NO: 57026 - RNA, 24 nt, Artificial Sequence
  Synthetic
cggcgucucggugggacgcgggca

SEQ ID NO: 57027 - RNA, 18 nt, Artificial Sequence
  Synthetic
agagagagagaaggaaga

SEQ ID NO: 57028 - RNA, 19 nt, Artificial Sequence
  Synthetic
cagagagagagaaggaaga

SEQ ID NO: 57029 - RNA, 20 nt, Artificial Sequence
  Synthetic
acagagagagagaaggaaga

SEQ ID NO: 57030 - RNA, 21 nt, Artificial Sequence
  Synthetic
gacagagagagagaaggaaga

SEQ ID NO: 57031 - RNA, 22 nt, Artificial Sequence
  Synthetic
agacagagagagagaaggaaga

SEQ ID NO: 57032 - RNA, 23 nt, Artificial Sequence
  Synthetic
gagacagagagagagaaggaaga

SEQ ID NO: 57033 - RNA, 24 nt, Artificial Sequence
  Synthetic
cgagacagagagagagaaggaaga

SEQ ID NO: 57034 - RNA, 18 nt, Artificial Sequence
  Synthetic
ugaggagagcgagacaga

SEQ ID NO: 57035 - RNA, 19 nt, Artificial Sequence
  Synthetic
gugaggagagcgagacaga

SEQ ID NO: 57036 - RNA, 20 nt, Artificial Sequence
  Synthetic
ugugaggagagcgagacaga

SEQ ID NO: 57037 - RNA, 21 nt, Artificial Sequence
  Synthetic
augugaggagagcgagacaga

SEQ ID NO: 57038 - RNA, 22 nt, Artificial Sequence
  Synthetic
aaugugaggagagcgagacaga

SEQ ID NO: 57039 - RNA, 23 nt, Artificial Sequence
  Synthetic
aaaugugaggagagcgagacaga

SEQ ID NO: 57040 - RNA, 24 nt, Artificial Sequence
  Synthetic
gaaaugugaggagagcgagacaga

SEQ ID NO: 57041 - RNA, 18 nt, Artificial Sequence
  Synthetic
aggagagcgagacagaga

SEQ ID NO: 57042 - RNA, 19 nt, Artificial Sequence
  Synthetic
gaggagagcgagacagaga

SEQ ID NO: 57043 - RNA, 20 nt, Artificial Sequence
  Synthetic
ugaggagagcgagacagaga

SEQ ID NO: 57044 - RNA, 21 nt, Artificial Sequence
  Synthetic
gugaggagagcgagacagaga

SEQ ID NO: 57045 - RNA, 22 nt, Artificial Sequence
  Synthetic
ugugaggagagcgagacagaga

SEQ ID NO: 57046 - RNA, 23 nt, Artificial Sequence
  Synthetic
augugaggagagcgagacagaga

SEQ ID NO: 57047 - RNA, 24 nt, Artificial Sequence
  Synthetic
aaugugaggagagcgagacagaga

SEQ ID NO: 57048 - RNA, 18 nt, Artificial Sequence
  Synthetic
gagagcgagacagagaga

SEQ ID NO: 57049 - RNA, 19 nt, Artificial Sequence
  Synthetic
ggagagcgagacagagaga

SEQ ID NO: 57050 - RNA, 20 nt, Artificial Sequence
  Synthetic
aggagagcgagacagagaga

SEQ ID NO: 57051 - RNA, 21 nt, Artificial Sequence
  Synthetic
gaggagagcgagacagagaga

SEQ ID NO: 57052 - RNA, 22 nt, Artificial Sequence
  Synthetic
ugaggagagcgagacagagaga

SEQ ID NO: 57053 - RNA, 23 nt, Artificial Sequence
  Synthetic
gugaggagagcgagacagagaga

SEQ ID NO: 57054 - RNA, 24 nt, Artificial Sequence
  Synthetic
ugugaggagagcgagacagagaga

SEQ ID NO: 57055 - RNA, 18 nt, Artificial Sequence
  Synthetic
gcgagacagagagagaga

SEQ ID NO: 57056 - RNA, 19 nt, Artificial Sequence
  Synthetic
agcgagacagagagagaga

SEQ ID NO: 57057 - RNA, 20 nt, Artificial Sequence
  Synthetic
gagcgagacagagagagaga

SEQ ID NO: 57058 - RNA, 21 nt, Artificial Sequence
  Synthetic
agagcgagacagagagagaga

SEQ ID NO: 57059 - RNA, 22 nt, Artificial Sequence
  Synthetic
gagagcgagacagagagagaga

SEQ ID NO: 57060 - RNA, 23 nt, Artificial Sequence
  Synthetic
ggagagcgagacagagagagaga

SEQ ID NO: 57061 - RNA, 24 nt, Artificial Sequence
  Synthetic
aggagagcgagacagagagagaga

SEQ ID NO: 57062 - RNA, 18 nt, Artificial Sequence
  Synthetic
aaugugaggagagcgaga

SEQ ID NO: 57063 - RNA, 19 nt, Artificial Sequence
  Synthetic
aaaugugaggagagcgaga

SEQ ID NO: 57064 - RNA, 20 nt, Artificial Sequence
  Synthetic
gaaaugugaggagagcgaga

SEQ ID NO: 57065 - RNA, 21 nt, Artificial Sequence
  Synthetic
ggaaaugugaggagagcgaga

SEQ ID NO: 57066 - RNA, 22 nt, Artificial Sequence
  Synthetic
gggaaaugugaggagagcgaga

SEQ ID NO: 57067 - RNA, 23 nt, Artificial Sequence
  Synthetic
ggggaaaugugaggagagcgaga

SEQ ID NO: 57068 - RNA, 24 nt, Artificial Sequence
  Synthetic
gggggaaaugugaggagagcgaga

SEQ ID NO: 57069 - RNA, 18 nt, Artificial Sequence
  Synthetic
cgggggaagacgaggaga

SEQ ID NO: 57070 - RNA, 19 nt, Artificial Sequence
  Synthetic
acgggggaagacgaggaga

SEQ ID NO: 57071 - RNA, 20 nt, Artificial Sequence
  Synthetic
gacgggggaagacgaggaga

SEQ ID NO: 57072 - RNA, 21 nt, Artificial Sequence
  Synthetic
ggacgggggaagacgaggaga

SEQ ID NO: 57073 - RNA, 22 nt, Artificial Sequence
  Synthetic
gggacgggggaagacgaggaga

SEQ ID NO: 57074 - RNA, 23 nt, Artificial Sequence
  Synthetic
cgggacgggggaagacgaggaga

SEQ ID NO: 57075 - RNA, 24 nt, Artificial Sequence
  Synthetic
gcgggacgggggaagacgaggaga

SEQ ID NO: 57076 - RNA, 18 nt, Artificial Sequence
  Synthetic
gggggaaaugugaggaga

SEQ ID NO: 57077 - RNA, 19 nt, Artificial Sequence
  Synthetic
ggggggaaaugugaggaga

SEQ ID NO: 57078 - RNA, 20 nt, Artificial Sequence
  Synthetic
gggggggaaaugugaggaga

SEQ ID NO: 57079 - RNA, 21 nt, Artificial Sequence
  Synthetic
ggggggggaaaugugaggaga

SEQ ID NO: 57080 - RNA, 22 nt, Artificial Sequence
  Synthetic
gggggggggaaaugugaggaga

SEQ ID NO: 57081 - RNA, 23 nt, Artificial Sequence
  Synthetic
ggggggggggaaaugugaggaga

SEQ ID NO: 57082 - RNA, 24 nt, Artificial Sequence
  Synthetic
gggggggggggaaaugugaggaga

SEQ ID NO: 57083 - RNA, 18 nt, Artificial Sequence
  Synthetic
cucgcggagggccggaga

SEQ ID NO: 57084 - RNA, 19 nt, Artificial Sequence
  Synthetic
acucgcggagggccggaga

SEQ ID NO: 57085 - RNA, 20 nt, Artificial Sequence
  Synthetic
gacucgcggagggccggaga

SEQ ID NO: 57086 - RNA, 21 nt, Artificial Sequence
  Synthetic
ggacucgcggagggccggaga

SEQ ID NO: 57087 - RNA, 22 nt, Artificial Sequence
  Synthetic
gggacucgcggagggccggaga

SEQ ID NO: 57088 - RNA, 23 nt, Artificial Sequence
  Synthetic
cgggacucgcggagggccggaga

SEQ ID NO: 57089 - RNA, 24 nt, Artificial Sequence
  Synthetic
ucgggacucgcggagggccggaga

SEQ ID NO: 57090 - RNA, 18 nt, Artificial Sequence
  Synthetic
ggggaugcaggaggagga

SEQ ID NO: 57091 - RNA, 19 nt, Artificial Sequence
  Synthetic
aggggaugcaggaggagga

SEQ ID NO: 57092 - RNA, 20 nt, Artificial Sequence
  Synthetic
gaggggaugcaggaggagga

SEQ ID NO: 57093 - RNA, 21 nt, Artificial Sequence
  Synthetic
cgaggggaugcaggaggagga

SEQ ID NO: 57094 - RNA, 22 nt, Artificial Sequence
  Synthetic
gcgaggggaugcaggaggagga

SEQ ID NO: 57095 - RNA, 23 nt, Artificial Sequence
  Synthetic
ggcgaggggaugcaggaggagga

SEQ ID NO: 57096 - RNA, 24 nt, Artificial Sequence
  Synthetic
aggcgaggggaugcaggaggagga

SEQ ID NO: 57097 - RNA, 18 nt, Artificial Sequence
  Synthetic
gaagacgaggagaaggga

SEQ ID NO: 57098 - RNA, 19 nt, Artificial Sequence
  Synthetic
ggaagacgaggagaaggga

SEQ ID NO: 57099 - RNA, 20 nt, Artificial Sequence
  Synthetic
gggaagacgaggagaaggga

SEQ ID NO: 57100 - RNA, 21 nt, Artificial Sequence
  Synthetic
ggggaagacgaggagaaggga

SEQ ID NO: 57101 - RNA, 22 nt, Artificial Sequence
  Synthetic
gggggaagacgaggagaaggga

SEQ ID NO: 57102 - RNA, 23 nt, Artificial Sequence
  Synthetic
cgggggaagacgaggagaaggga

SEQ ID NO: 57103 - RNA, 24 nt, Artificial Sequence
  Synthetic
acgggggaagacgaggagaaggga

SEQ ID NO: 57104 - RNA, 18 nt, Artificial Sequence
  Synthetic
agagagaaggaagaggga

SEQ ID NO: 57105 - RNA, 19 nt, Artificial Sequence
  Synthetic
gagagagaaggaagaggga

SEQ ID NO: 57106 - RNA, 20 nt, Artificial Sequence
  Synthetic
agagagagaaggaagaggga

SEQ ID NO: 57107 - RNA, 21 nt, Artificial Sequence
  Synthetic
gagagagagaaggaagaggga

SEQ ID NO: 57108 - RNA, 22 nt, Artificial Sequence
  Synthetic
agagagagagaaggaagaggga

SEQ ID NO: 57109 - RNA, 23 nt, Artificial Sequence
  Synthetic
cagagagagagaaggaagaggga

SEQ ID NO: 57110 - RNA, 24 nt, Artificial Sequence
  Synthetic
acagagagagagaaggaagaggga

SEQ ID NO: 57111 - RNA, 18 nt, Artificial Sequence
  Synthetic
ggaaggggcgcggcggga

SEQ ID NO: 57112 - RNA, 19 nt, Artificial Sequence
  Synthetic
gggaaggggcgcggcggga

SEQ ID NO: 57113 - RNA, 20 nt, Artificial Sequence
  Synthetic
agggaaggggcgcggcggga

SEQ ID NO: 57114 - RNA, 21 nt, Artificial Sequence
  Synthetic
gagggaaggggcgcggcggga

SEQ ID NO: 57115 - RNA, 22 nt, Artificial Sequence
  Synthetic
agagggaaggggcgcggcggga

SEQ ID NO: 57116 - RNA, 23 nt, Artificial Sequence
  Synthetic
aagagggaaggggcgcggcggga

SEQ ID NO: 57117 - RNA, 24 nt, Artificial Sequence
  Synthetic
gaagagggaaggggcgcggcggga

SEQ ID NO: 57118 - RNA, 18 nt, Artificial Sequence
  Synthetic
ccgccucguguuucuuga

SEQ ID NO: 57119 - RNA, 19 nt, Artificial Sequence
  Synthetic
cccgccucguguuucuuga

SEQ ID NO: 57120 - RNA, 20 nt, Artificial Sequence
  Synthetic
ccccgccucguguuucuuga

SEQ ID NO: 57121 - RNA, 21 nt, Artificial Sequence
  Synthetic
cccccgccucguguuucuuga

SEQ ID NO: 57122 - RNA, 22 nt, Artificial Sequence
  Synthetic
acccccgccucguguuucuuga

SEQ ID NO: 57123 - RNA, 23 nt, Artificial Sequence
  Synthetic
gacccccgccucguguuucuuga

SEQ ID NO: 57124 - RNA, 24 nt, Artificial Sequence
  Synthetic
ggacccccgccucguguuucuuga

SEQ ID NO: 57125 - RNA, 18 nt, Artificial Sequence
  Synthetic
aggggcgcgcucucucac

SEQ ID NO: 57126 - RNA, 19 nt, Artificial Sequence
  Synthetic
gaggggcgcgcucucucac

SEQ ID NO: 57127 - RNA, 20 nt, Artificial Sequence
  Synthetic
cgaggggcgcgcucucucac

SEQ ID NO: 57128 - RNA, 21 nt, Artificial Sequence
  Synthetic
ucgaggggcgcgcucucucac

SEQ ID NO: 57129 - RNA, 22 nt, Artificial Sequence
  Synthetic
uucgaggggcgcgcucucucac

SEQ ID NO: 57130 - RNA, 23 nt, Artificial Sequence
  Synthetic
guucgaggggcgcgcucucucac

SEQ ID NO: 57131 - RNA, 24 nt, Artificial Sequence
  Synthetic
cguucgaggggcgcgcucucucac

SEQ ID NO: 57132 - RNA, 18 nt, Artificial Sequence
  Synthetic
ggcgggacgggggaagac

SEQ ID NO: 57133 - RNA, 19 nt, Artificial Sequence
  Synthetic
cggcgggacgggggaagac

SEQ ID NO: 57134 - RNA, 20 nt, Artificial Sequence
  Synthetic
gcggcgggacgggggaagac

SEQ ID NO: 57135 - RNA, 21 nt, Artificial Sequence
  Synthetic
cgcggcgggacgggggaagac

SEQ ID NO: 57136 - RNA, 22 nt, Artificial Sequence
  Synthetic
gcgcggcgggacgggggaagac

SEQ ID NO: 57137 - RNA, 23 nt, Artificial Sequence
  Synthetic
ggcgcggcgggacgggggaagac

SEQ ID NO: 57138 - RNA, 24 nt, Artificial Sequence
  Synthetic
gggcgcggcgggacgggggaagac

SEQ ID NO: 57139 - RNA, 18 nt, Artificial Sequence
  Synthetic
gaaggggcgcggcgggac

SEQ ID NO: 57140 - RNA, 19 nt, Artificial Sequence
  Synthetic
ggaaggggcgcggcgggac

SEQ ID NO: 57141 - RNA, 20 nt, Artificial Sequence
  Synthetic
gggaaggggcgcggcgggac

SEQ ID NO: 57142 - RNA, 21 nt, Artificial Sequence
  Synthetic
agggaaggggcgcggcgggac

SEQ ID NO: 57143 - RNA, 22 nt, Artificial Sequence
  Synthetic
gagggaaggggcgcggcgggac

SEQ ID NO: 57144 - RNA, 23 nt, Artificial Sequence
  Synthetic
agagggaaggggcgcggcgggac

SEQ ID NO: 57145 - RNA, 24 nt, Artificial Sequence
  Synthetic
aagagggaaggggcgcggcgggac

SEQ ID NO: 57146 - RNA, 18 nt, Artificial Sequence
  Synthetic
gcggcgucucggugggac

SEQ ID NO: 57147 - RNA, 19 nt, Artificial Sequence
  Synthetic
cgcggcgucucggugggac

SEQ ID NO: 57148 - RNA, 20 nt, Artificial Sequence
  Synthetic
gcgcggcgucucggugggac

SEQ ID NO: 57149 - RNA, 21 nt, Artificial Sequence
  Synthetic
ggcgcggcgucucggugggac

SEQ ID NO: 57150 - RNA, 22 nt, Artificial Sequence
  Synthetic
cggcgcggcgucucggugggac

SEQ ID NO: 57151 - RNA, 23 nt, Artificial Sequence
  Synthetic
gcggcgcggcgucucggugggac

SEQ ID NO: 57152 - RNA, 24 nt, Artificial Sequence
  Synthetic
cgcggcgcggcgucucggugggac

SEQ ID NO: 57153 - RNA, 18 nt, Artificial Sequence
  Synthetic
aacaaaaacaaaaacacc

SEQ ID NO: 57154 - RNA, 19 nt, Artificial Sequence
  Synthetic
aaacaaaaacaaaaacacc

SEQ ID NO: 57155 - RNA, 20 nt, Artificial Sequence
  Synthetic
gaaacaaaaacaaaaacacc

SEQ ID NO: 57156 - RNA, 21 nt, Artificial Sequence
  Synthetic
agaaacaaaaacaaaaacacc

SEQ ID NO: 57157 - RNA, 22 nt, Artificial Sequence
  Synthetic
cagaaacaaaaacaaaaacacc

SEQ ID NO: 57158 - RNA, 23 nt, Artificial Sequence
  Synthetic
acagaaacaaaaacaaaaacacc

SEQ ID NO: 57159 - RNA, 24 nt, Artificial Sequence
  Synthetic
aacagaaacaaaaacaaaaacacc

SEQ ID NO: 57160 - RNA, 18 nt, Artificial Sequence
  Synthetic
gcaggcgccccccccccc

SEQ ID NO: 57161 - RNA, 19 nt, Artificial Sequence
  Synthetic
cgcaggcgccccccccccc

SEQ ID NO: 57162 - RNA, 20 nt, Artificial Sequence
  Synthetic
acgcaggcgccccccccccc

SEQ ID NO: 57163 - RNA, 21 nt, Artificial Sequence
  Synthetic
cacgcaggcgccccccccccc

SEQ ID NO: 57164 - RNA, 22 nt, Artificial Sequence
  Synthetic
acacgcaggcgccccccccccc

SEQ ID NO: 57165 - RNA, 23 nt, Artificial Sequence
  Synthetic
cacacgcaggcgccccccccccc

SEQ ID NO: 57166 - RNA, 24 nt, Artificial Sequence
  Synthetic
acacacgcaggcgccccccccccc

SEQ ID NO: 57167 - RNA, 18 nt, Artificial Sequence
  Synthetic
cgcaggcgcccccccccc

SEQ ID NO: 57168 - RNA, 19 nt, Artificial Sequence
  Synthetic
acgcaggcgcccccccccc

SEQ ID NO: 57169 - RNA, 20 nt, Artificial Sequence
  Synthetic
cacgcaggcgcccccccccc

SEQ ID NO: 57170 - RNA, 21 nt, Artificial Sequence
  Synthetic
acacgcaggcgcccccccccc

SEQ ID NO: 57171 - RNA, 22 nt, Artificial Sequence
  Synthetic
cacacgcaggcgcccccccccc

SEQ ID NO: 57172 - RNA, 23 nt, Artificial Sequence
  Synthetic
acacacgcaggcgcccccccccc

SEQ ID NO: 57173 - RNA, 24 nt, Artificial Sequence
  Synthetic
gacacacgcaggcgcccccccccc

SEQ ID NO: 57174 - RNA, 18 nt, Artificial Sequence
  Synthetic
ucgcccgcccgccucgcc

SEQ ID NO: 57175 - RNA, 19 nt, Artificial Sequence
  Synthetic
uucgcccgcccgccucgcc

SEQ ID NO: 57176 - RNA, 20 nt, Artificial Sequence
  Synthetic
cuucgcccgcccgccucgcc

SEQ ID NO: 57177 - RNA, 21 nt, Artificial Sequence
  Synthetic
ccuucgcccgcccgccucgcc

SEQ ID NO: 57178 - RNA, 22 nt, Artificial Sequence
  Synthetic
uccuucgcccgcccgccucgcc

SEQ ID NO: 57179 - RNA, 23 nt, Artificial Sequence
  Synthetic
uuccuucgcccgcccgccucgcc

SEQ ID NO: 57180 - RNA, 24 nt, Artificial Sequence
  Synthetic
cuuccuucgcccgcccgccucgcc

SEQ ID NO: 57181 - RNA, 18 nt, Artificial Sequence
  Synthetic
ggccggagaauggaaggc

SEQ ID NO: 57182 - RNA, 19 nt, Artificial Sequence
  Synthetic
gggccggagaauggaaggc

SEQ ID NO: 57183 - RNA, 20 nt, Artificial Sequence
  Synthetic
agggccggagaauggaaggc

SEQ ID NO: 57184 - RNA, 21 nt, Artificial Sequence
  Synthetic
gagggccggagaauggaaggc

SEQ ID NO: 57185 - RNA, 22 nt, Artificial Sequence
  Synthetic
ggagggccggagaauggaaggc

SEQ ID NO: 57186 - RNA, 23 nt, Artificial Sequence
  Synthetic
cggagggccggagaauggaaggc

SEQ ID NO: 57187 - RNA, 24 nt, Artificial Sequence
  Synthetic
gcggagggccggagaauggaaggc

SEQ ID NO: 57188 - RNA, 18 nt, Artificial Sequence
  Synthetic
gcagagggcggcggcggc

SEQ ID NO: 57189 - RNA, 19 nt, Artificial Sequence
  Synthetic
ggcagagggcggcggcggc

SEQ ID NO: 57190 - RNA, 20 nt, Artificial Sequence
  Synthetic
gggcagagggcggcggcggc

SEQ ID NO: 57191 - RNA, 21 nt, Artificial Sequence
  Synthetic
cgggcagagggcggcggcggc

SEQ ID NO: 57192 - RNA, 22 nt, Artificial Sequence
  Synthetic
gcgggcagagggcggcggcggc

SEQ ID NO: 57193 - RNA, 23 nt, Artificial Sequence
  Synthetic
cgcgggcagagggcggcggcggc

SEQ ID NO: 57194 - RNA, 24 nt, Artificial Sequence
  Synthetic
acgcgggcagagggcggcggcggc

SEQ ID NO: 57195 - RNA, 18 nt, Artificial Sequence
  Synthetic
ucuccuucgucgggcggc

SEQ ID NO: 57196 - RNA, 19 nt, Artificial Sequence
  Synthetic
gucuccuucgucgggcggc

SEQ ID NO: 57197 - RNA, 20 nt, Artificial Sequence
  Synthetic
ggucuccuucgucgggcggc

SEQ ID NO: 57198 - RNA, 21 nt, Artificial Sequence
  Synthetic
gggucuccuucgucgggcggc

SEQ ID NO: 57199 - RNA, 22 nt, Artificial Sequence
  Synthetic
ugggucuccuucgucgggcggc

SEQ ID NO: 57200 - RNA, 23 nt, Artificial Sequence
  Synthetic
uugggucuccuucgucgggcggc

SEQ ID NO: 57201 - RNA, 24 nt, Artificial Sequence
  Synthetic
cuugggucuccuucgucgggcggc

SEQ ID NO: 57202 - RNA, 18 nt, Artificial Sequence
  Synthetic
ucgggacucgcggagggc

SEQ ID NO: 57203 - RNA, 19 nt, Artificial Sequence
  Synthetic
gucgggacucgcggagggc

SEQ ID NO: 57204 - RNA, 20 nt, Artificial Sequence
  Synthetic
cgucgggacucgcggagggc

SEQ ID NO: 57205 - RNA, 21 nt, Artificial Sequence
  Synthetic
gcgucgggacucgcggagggc

SEQ ID NO: 57206 - RNA, 22 nt, Artificial Sequence
  Synthetic
ggcgucgggacucgcggagggc

SEQ ID NO: 57207 - RNA, 23 nt, Artificial Sequence
  Synthetic
gggcgucgggacucgcggagggc

SEQ ID NO: 57208 - RNA, 24 nt, Artificial Sequence
  Synthetic
ggggcgucgggacucgcggagggc

SEQ ID NO: 57209 - RNA, 18 nt, Artificial Sequence
  Synthetic
cugccggaggcugcgggc

SEQ ID NO: 57210 - RNA, 19 nt, Artificial Sequence
  Synthetic
gcugccggaggcugcgggc

SEQ ID NO: 57211 - RNA, 20 nt, Artificial Sequence
  Synthetic
ugcugccggaggcugcgggc

SEQ ID NO: 57212 - RNA, 21 nt, Artificial Sequence
  Synthetic
gugcugccggaggcugcgggc

SEQ ID NO: 57213 - RNA, 22 nt, Artificial Sequence
  Synthetic
cgugcugccggaggcugcgggc

SEQ ID NO: 57214 - RNA, 23 nt, Artificial Sequence
  Synthetic
gcgugcugccggaggcugcgggc

SEQ ID NO: 57215 - RNA, 24 nt, Artificial Sequence
  Synthetic
ggcgugcugccggaggcugcgggc

SEQ ID NO: 57216 - RNA, 18 nt, Artificial Sequence
  Synthetic
uggaaggcgaggggaugc

SEQ ID NO: 57217 - RNA, 19 nt, Artificial Sequence
  Synthetic
auggaaggcgaggggaugc

SEQ ID NO: 57218 - RNA, 20 nt, Artificial Sequence
  Synthetic
aauggaaggcgaggggaugc

SEQ ID NO: 57219 - RNA, 21 nt, Artificial Sequence
  Synthetic
gaauggaaggcgaggggaugc

SEQ ID NO: 57220 - RNA, 22 nt, Artificial Sequence
  Synthetic
agaauggaaggcgaggggaugc

SEQ ID NO: 57221 - RNA, 23 nt, Artificial Sequence
  Synthetic
gagaauggaaggcgaggggaugc

SEQ ID NO: 57222 - RNA, 24 nt, Artificial Sequence
  Synthetic
ggagaauggaaggcgaggggaugc

SEQ ID NO: 57223 - RNA, 18 nt, Artificial Sequence
  Synthetic
gacccuaaaccuaccugc

SEQ ID NO: 57224 - RNA, 19 nt, Artificial Sequence
  Synthetic
cgacccuaaaccuaccugc

SEQ ID NO: 57225 - RNA, 20 nt, Artificial Sequence
  Synthetic
acgacccuaaaccuaccugc

SEQ ID NO: 57226 - RNA, 21 nt, Artificial Sequence
  Synthetic
uacgacccuaaaccuaccugc

SEQ ID NO: 57227 - RNA, 22 nt, Artificial Sequence
  Synthetic
guacgacccuaaaccuaccugc

SEQ ID NO: 57228 - RNA, 23 nt, Artificial Sequence
  Synthetic
uguacgacccuaaaccuaccugc

SEQ ID NO: 57229 - RNA, 24 nt, Artificial Sequence
  Synthetic
cuguacgacccuaaaccuaccugc

SEQ ID NO: 57230 - RNA, 18 nt, Artificial Sequence
  Synthetic
cgguggucggcgugcugc

SEQ ID NO: 57231 - RNA, 19 nt, Artificial Sequence
  Synthetic
gcgguggucggcgugcugc

SEQ ID NO: 57232 - RNA, 20 nt, Artificial Sequence
  Synthetic
ggcgguggucggcgugcugc

SEQ ID NO: 57233 - RNA, 21 nt, Artificial Sequence
  Synthetic
cggcgguggucggcgugcugc

SEQ ID NO: 57234 - RNA, 22 nt, Artificial Sequence
  Synthetic
gcggcgguggucggcgugcugc

SEQ ID NO: 57235 - RNA, 23 nt, Artificial Sequence
  Synthetic
ggcggcgguggucggcgugcugc

SEQ ID NO: 57236 - RNA, 24 nt, Artificial Sequence
  Synthetic
uggcggcgguggucggcgugcugc

SEQ ID NO: 57237 - RNA, 18 nt, Artificial Sequence
  Synthetic
gggggggcgucgggacuc

SEQ ID NO: 57238 - RNA, 19 nt, Artificial Sequence
  Synthetic
ggggggggcgucgggacuc

SEQ ID NO: 57239 - RNA, 20 nt, Artificial Sequence
  Synthetic
gggggggggcgucgggacuc

SEQ ID NO: 57240 - RNA, 21 nt, Artificial Sequence
  Synthetic
ggggggggggcgucgggacuc

SEQ ID NO: 57241 - RNA, 22 nt, Artificial Sequence
  Synthetic
cggggggggggcgucgggacuc

SEQ ID NO: 57242 - RNA, 23 nt, Artificial Sequence
  Synthetic
gcggggggggggcgucgggacuc

SEQ ID NO: 57243 - RNA, 24 nt, Artificial Sequence
  Synthetic
ggcggggggggggcgucgggacuc

SEQ ID NO: 57244 - RNA, 18 nt, Artificial Sequence
  Synthetic
aaggauacggguuggcuc

SEQ ID NO: 57245 - RNA, 19 nt, Artificial Sequence
  Synthetic
aaaggauacggguuggcuc

SEQ ID NO: 57246 - RNA, 20 nt, Artificial Sequence
  Synthetic
aaaaggauacggguuggcuc

SEQ ID NO: 57247 - RNA, 21 nt, Artificial Sequence
  Synthetic
aaaaaggauacggguuggcuc

SEQ ID NO: 57248 - RNA, 22 nt, Artificial Sequence
  Synthetic
aaaaaaggauacggguuggcuc

SEQ ID NO: 57249 - RNA, 23 nt, Artificial Sequence
  Synthetic
aaaaaaaggauacggguuggcuc

SEQ ID NO: 57250 - RNA, 24 nt, Artificial Sequence
  Synthetic
gaaaaaaaggauacggguuggcuc

SEQ ID NO: 57251 - RNA, 18 nt, Artificial Sequence
  Synthetic
cgagaacgcgcggcguuc

SEQ ID NO: 57252 - RNA, 19 nt, Artificial Sequence
  Synthetic
gcgagaacgcgcggcguuc

SEQ ID NO: 57253 - RNA, 20 nt, Artificial Sequence
  Synthetic
ugcgagaacgcgcggcguuc

SEQ ID NO: 57254 - RNA, 21 nt, Artificial Sequence
  Synthetic
cugcgagaacgcgcggcguuc

SEQ ID NO: 57255 - RNA, 22 nt, Artificial Sequence
  Synthetic
ccugcgagaacgcgcggcguuc

SEQ ID NO: 57256 - RNA, 23 nt, Artificial Sequence
  Synthetic
accugcgagaacgcgcggcguuc

SEQ ID NO: 57257 - RNA, 24 nt, Artificial Sequence
  Synthetic
uaccugcgagaacgcgcggcguuc

SEQ ID NO: 57258 - RNA, 18 nt, Artificial Sequence
  Synthetic
ugaccugccugcccuuuc

SEQ ID NO: 57259 - RNA, 19 nt, Artificial Sequence
  Synthetic
cugaccugccugcccuuuc

SEQ ID NO: 57260 - RNA, 20 nt, Artificial Sequence
  Synthetic
gcugaccugccugcccuuuc

SEQ ID NO: 57261 - RNA, 21 nt, Artificial Sequence
  Synthetic
ggcugaccugccugcccuuuc

SEQ ID NO: 57262 - RNA, 22 nt, Artificial Sequence
  Synthetic
cggcugaccugccugcccuuuc

SEQ ID NO: 57263 - RNA, 23 nt, Artificial Sequence
  Synthetic
gcggcugaccugccugcccuuuc

SEQ ID NO: 57264 - RNA, 24 nt, Artificial Sequence
  Synthetic
ugcggcugaccugccugcccuuuc

SEQ ID NO: 57265 - RNA, 18 nt, Artificial Sequence
  Synthetic
acccccgccucguguuuc

SEQ ID NO: 57266 - RNA, 19 nt, Artificial Sequence
  Synthetic
gacccccgccucguguuuc

SEQ ID NO: 57267 - RNA, 20 nt, Artificial Sequence
  Synthetic
ggacccccgccucguguuuc

SEQ ID NO: 57268 - RNA, 21 nt, Artificial Sequence
  Synthetic
gggacccccgccucguguuuc

SEQ ID NO: 57269 - RNA, 22 nt, Artificial Sequence
  Synthetic
ugggacccccgccucguguuuc

SEQ ID NO: 57270 - RNA, 23 nt, Artificial Sequence
  Synthetic
cugggacccccgccucguguuuc

SEQ ID NO: 57271 - RNA, 24 nt, Artificial Sequence
  Synthetic
ucugggacccccgccucguguuuc

SEQ ID NO: 57272 - RNA, 18 nt, Artificial Sequence
  Synthetic
ccucguguuucuugaaag

SEQ ID NO: 57273 - RNA, 19 nt, Artificial Sequence
  Synthetic
gccucguguuucuugaaag

SEQ ID NO: 57274 - RNA, 20 nt, Artificial Sequence
  Synthetic
cgccucguguuucuugaaag

SEQ ID NO: 57275 - RNA, 21 nt, Artificial Sequence
  Synthetic
ccgccucguguuucuugaaag

SEQ ID NO: 57276 - RNA, 22 nt, Artificial Sequence
  Synthetic
cccgccucguguuucuugaaag

SEQ ID NO: 57277 - RNA, 23 nt, Artificial Sequence
  Synthetic
ccccgccucguguuucuugaaag

SEQ ID NO: 57278 - RNA, 24 nt, Artificial Sequence
  Synthetic
cccccgccucguguuucuugaaag

SEQ ID NO: 57279 - RNA, 18 nt, Artificial Sequence
  Synthetic
cagagagagagaaggaag

SEQ ID NO: 57280 - RNA, 19 nt, Artificial Sequence
  Synthetic
acagagagagagaaggaag

SEQ ID NO: 57281 - RNA, 20 nt, Artificial Sequence
  Synthetic
gacagagagagagaaggaag

SEQ ID NO: 57282 - RNA, 21 nt, Artificial Sequence
  Synthetic
agacagagagagagaaggaag

SEQ ID NO: 57283 - RNA, 22 nt, Artificial Sequence
  Synthetic
gagacagagagagagaaggaag

SEQ ID NO: 57284 - RNA, 23 nt, Artificial Sequence
  Synthetic
cgagacagagagagagaaggaag

SEQ ID NO: 57285 - RNA, 24 nt, Artificial Sequence
  Synthetic
gcgagacagagagagagaaggaag

SEQ ID NO: 57286 - RNA, 18 nt, Artificial Sequence
  Synthetic
gcggcgggacgggggaag

SEQ ID NO: 57287 - RNA, 19 nt, Artificial Sequence
  Synthetic
cgcggcgggacgggggaag

SEQ ID NO: 57288 - RNA, 20 nt, Artificial Sequence
  Synthetic
gcgcggcgggacgggggaag

SEQ ID NO: 57289 - RNA, 21 nt, Artificial Sequence
  Synthetic
ggcgcggcgggacgggggaag

SEQ ID NO: 57290 - RNA, 22 nt, Artificial Sequence
  Synthetic
gggcgcggcgggacgggggaag

SEQ ID NO: 57291 - RNA, 23 nt, Artificial Sequence
  Synthetic
ggggcgcggcgggacgggggaag

SEQ ID NO: 57292 - RNA, 24 nt, Artificial Sequence
  Synthetic
aggggcgcggcgggacgggggaag

SEQ ID NO: 57293 - RNA, 18 nt, Artificial Sequence
  Synthetic
agggccggagaauggaag

SEQ ID NO: 57294 - RNA, 19 nt, Artificial Sequence
  Synthetic
gagggccggagaauggaag

SEQ ID NO: 57295 - RNA, 20 nt, Artificial Sequence
  Synthetic
ggagggccggagaauggaag

SEQ ID NO: 57296 - RNA, 21 nt, Artificial Sequence
  Synthetic
cggagggccggagaauggaag

SEQ ID NO: 57297 - RNA, 22 nt, Artificial Sequence
  Synthetic
gcggagggccggagaauggaag

SEQ ID NO: 57298 - RNA, 23 nt, Artificial Sequence
  Synthetic
cgcggagggccggagaauggaag

SEQ ID NO: 57299 - RNA, 24 nt, Artificial Sequence
  Synthetic
ucgcggagggccggagaauggaag

SEQ ID NO: 57300 - RNA, 18 nt, Artificial Sequence
  Synthetic
gaaggcgaggggaugcag

SEQ ID NO: 57301 - RNA, 19 nt, Artificial Sequence
  Synthetic
ggaaggcgaggggaugcag

SEQ ID NO: 57302 - RNA, 20 nt, Artificial Sequence
  Synthetic
uggaaggcgaggggaugcag

SEQ ID NO: 57303 - RNA, 21 nt, Artificial Sequence
  Synthetic
auggaaggcgaggggaugcag

SEQ ID NO: 57304 - RNA, 22 nt, Artificial Sequence
  Synthetic
aauggaaggcgaggggaugcag

SEQ ID NO: 57305 - RNA, 23 nt, Artificial Sequence
  Synthetic
gaauggaaggcgaggggaugcag

SEQ ID NO: 57306 - RNA, 24 nt, Artificial Sequence
  Synthetic
agaauggaaggcgaggggaugcag

SEQ ID NO: 57307 - RNA, 18 nt, Artificial Sequence
  Synthetic
ccucucccgccgccucag

SEQ ID NO: 57308 - RNA, 19 nt, Artificial Sequence
  Synthetic
cccucucccgccgccucag

SEQ ID NO: 57309 - RNA, 20 nt, Artificial Sequence
  Synthetic
ccccucucccgccgccucag

SEQ ID NO: 57310 - RNA, 21 nt, Artificial Sequence
  Synthetic
cccccucucccgccgccucag

SEQ ID NO: 57311 - RNA, 22 nt, Artificial Sequence
  Synthetic
ccccccucucccgccgccucag

SEQ ID NO: 57312 - RNA, 23 nt, Artificial Sequence
  Synthetic
cccccccucucccgccgccucag

SEQ ID NO: 57313 - RNA, 24 nt, Artificial Sequence
  Synthetic
ccccccccucucccgccgccucag

SEQ ID NO: 57314 - RNA, 18 nt, Artificial Sequence
  Synthetic
agcgagacagagagagag

SEQ ID NO: 57315 - RNA, 19 nt, Artificial Sequence
  Synthetic
gagcgagacagagagagag

SEQ ID NO: 57316 - RNA, 20 nt, Artificial Sequence
  Synthetic
agagcgagacagagagagag

SEQ ID NO: 57317 - RNA, 21 nt, Artificial Sequence
  Synthetic
gagagcgagacagagagagag

SEQ ID NO: 57318 - RNA, 22 nt, Artificial Sequence
  Synthetic
ggagagcgagacagagagagag

SEQ ID NO: 57319 - RNA, 23 nt, Artificial Sequence
  Synthetic
aggagagcgagacagagagagag

SEQ ID NO: 57320 - RNA, 24 nt, Artificial Sequence
  Synthetic
gaggagagcgagacagagagagag

SEQ ID NO: 57321 - RNA, 18 nt, Artificial Sequence
  Synthetic
gggacgggggaagacgag

SEQ ID NO: 57322 - RNA, 19 nt, Artificial Sequence
  Synthetic
cgggacgggggaagacgag

SEQ ID NO: 57323 - RNA, 20 nt, Artificial Sequence
  Synthetic
gcgggacgggggaagacgag

SEQ ID NO: 57324 - RNA, 21 nt, Artificial Sequence
  Synthetic
ggcgggacgggggaagacgag

SEQ ID NO: 57325 - RNA, 22 nt, Artificial Sequence
  Synthetic
cggcgggacgggggaagacgag

SEQ ID NO: 57326 - RNA, 23 nt, Artificial Sequence
  Synthetic
gcggcgggacgggggaagacgag

SEQ ID NO: 57327 - RNA, 24 nt, Artificial Sequence
  Synthetic
cgcggcgggacgggggaagacgag

SEQ ID NO: 57328 - RNA, 18 nt, Artificial Sequence
  Synthetic
acgggggaagacgaggag

SEQ ID NO: 57329 - RNA, 19 nt, Artificial Sequence
  Synthetic
gacgggggaagacgaggag

SEQ ID NO: 57330 - RNA, 20 nt, Artificial Sequence
  Synthetic
ggacgggggaagacgaggag

SEQ ID NO: 57331 - RNA, 21 nt, Artificial Sequence
  Synthetic
gggacgggggaagacgaggag

SEQ ID NO: 57332 - RNA, 22 nt, Artificial Sequence
  Synthetic
cgggacgggggaagacgaggag

SEQ ID NO: 57333 - RNA, 23 nt, Artificial Sequence
  Synthetic
gcgggacgggggaagacgaggag

SEQ ID NO: 57334 - RNA, 24 nt, Artificial Sequence
  Synthetic
ggcgggacgggggaagacgaggag

SEQ ID NO: 57335 - RNA, 18 nt, Artificial Sequence
  Synthetic
gggggggggaaaugugag

SEQ ID NO: 57336 - RNA, 19 nt, Artificial Sequence
  Synthetic
ggggggggggaaaugugag

SEQ ID NO: 57337 - RNA, 20 nt, Artificial Sequence
  Synthetic
gggggggggggaaaugugag

SEQ ID NO: 57338 - RNA, 21 nt, Artificial Sequence
  Synthetic
ggggggggggggaaaugugag

SEQ ID NO: 57339 - RNA, 22 nt, Artificial Sequence
  Synthetic
gggggggggggggaaaugugag

SEQ ID NO: 57340 - RNA, 23 nt, Artificial Sequence
  Synthetic
cgggggggggggggaaaugugag

SEQ ID NO: 57341 - RNA, 24 nt, Artificial Sequence
  Synthetic
gcgggggggggggggaaaugugag

SEQ ID NO: 57342 - RNA, 18 nt, Artificial Sequence
  Synthetic
gcgggacgggggaagacg

SEQ ID NO: 57343 - RNA, 19 nt, Artificial Sequence
  Synthetic
ggcgggacgggggaagacg

SEQ ID NO: 57344 - RNA, 20 nt, Artificial Sequence
  Synthetic
cggcgggacgggggaagacg

SEQ ID NO: 57345 - RNA, 21 nt, Artificial Sequence
  Synthetic
gcggcgggacgggggaagacg

SEQ ID NO: 57346 - RNA, 22 nt, Artificial Sequence
  Synthetic
cgcggcgggacgggggaagacg

SEQ ID NO: 57347 - RNA, 23 nt, Artificial Sequence
  Synthetic
gcgcggcgggacgggggaagacg

SEQ ID NO: 57348 - RNA, 24 nt, Artificial Sequence
  Synthetic
ggcgcggcgggacgggggaagacg

SEQ ID NO: 57349 - RNA, 18 nt, Artificial Sequence
  Synthetic
aaggggcgcggcgggacg

SEQ ID NO: 57350 - RNA, 19 nt, Artificial Sequence
  Synthetic
gaaggggcgcggcgggacg

SEQ ID NO: 57351 - RNA, 20 nt, Artificial Sequence
  Synthetic
ggaaggggcgcggcgggacg

SEQ ID NO: 57352 - RNA, 21 nt, Artificial Sequence
  Synthetic
gggaaggggcgcggcgggacg

SEQ ID NO: 57353 - RNA, 22 nt, Artificial Sequence
  Synthetic
agggaaggggcgcggcgggacg

SEQ ID NO: 57354 - RNA, 23 nt, Artificial Sequence
  Synthetic
gagggaaggggcgcggcgggacg

SEQ ID NO: 57355 - RNA, 24 nt, Artificial Sequence
  Synthetic
agagggaaggggcgcggcgggacg

SEQ ID NO: 57356 - RNA, 18 nt, Artificial Sequence
  Synthetic
cggagccugggucccccg

SEQ ID NO: 57357 - RNA, 19 nt, Artificial Sequence
  Synthetic
ccggagccugggucccccg

SEQ ID NO: 57358 - RNA, 20 nt, Artificial Sequence
  Synthetic
cccggagccugggucccccg

SEQ ID NO: 57359 - RNA, 21 nt, Artificial Sequence
  Synthetic
ccccggagccugggucccccg

SEQ ID NO: 57360 - RNA, 22 nt, Artificial Sequence
  Synthetic
cccccggagccugggucccccg

SEQ ID NO: 57361 - RNA, 23 nt, Artificial Sequence
  Synthetic
ccccccggagccugggucccccg

SEQ ID NO: 57362 - RNA, 24 nt, Artificial Sequence
  Synthetic
cccccccggagccugggucccccg

SEQ ID NO: 57363 - RNA, 18 nt, Artificial Sequence
  Synthetic
cucgccgcgaucccgccg

SEQ ID NO: 57364 - RNA, 19 nt, Artificial Sequence
  Synthetic
ucucgccgcgaucccgccg

SEQ ID NO: 57365 - RNA, 20 nt, Artificial Sequence
  Synthetic
gucucgccgcgaucccgccg

SEQ ID NO: 57366 - RNA, 21 nt, Artificial Sequence
  Synthetic
cgucucgccgcgaucccgccg

SEQ ID NO: 57367 - RNA, 22 nt, Artificial Sequence
  Synthetic
gcgucucgccgcgaucccgccg

SEQ ID NO: 57368 - RNA, 23 nt, Artificial Sequence
  Synthetic
ugcgucucgccgcgaucccgccg

SEQ ID NO: 57369 - RNA, 24 nt, Artificial Sequence
  Synthetic
cugcgucucgccgcgaucccgccg

SEQ ID NO: 57370 - RNA, 18 nt, Artificial Sequence
  Synthetic
gaagagggaaggggcgcg

SEQ ID NO: 57371 - RNA, 19 nt, Artificial Sequence
  Synthetic
ggaagagggaaggggcgcg

SEQ ID NO: 57372 - RNA, 20 nt, Artificial Sequence
  Synthetic
aggaagagggaaggggcgcg

SEQ ID NO: 57373 - RNA, 21 nt, Artificial Sequence
  Synthetic
aaggaagagggaaggggcgcg

SEQ ID NO: 57374 - RNA, 22 nt, Artificial Sequence
  Synthetic
gaaggaagagggaaggggcgcg

SEQ ID NO: 57375 - RNA, 23 nt, Artificial Sequence
  Synthetic
agaaggaagagggaaggggcgcg

SEQ ID NO: 57376 - RNA, 24 nt, Artificial Sequence
  Synthetic
gagaaggaagagggaaggggcgcg

SEQ ID NO: 57377 - RNA, 18 nt, Artificial Sequence
  Synthetic
ggggcgucgggacucgcg

SEQ ID NO: 57378 - RNA, 19 nt, Artificial Sequence
  Synthetic
gggggcgucgggacucgcg

SEQ ID NO: 57379 - RNA, 20 nt, Artificial Sequence
  Synthetic
ggggggcgucgggacucgcg

SEQ ID NO: 57380 - RNA, 21 nt, Artificial Sequence
  Synthetic
gggggggcgucgggacucgcg

SEQ ID NO: 57381 - RNA, 22 nt, Artificial Sequence
  Synthetic
ggggggggcgucgggacucgcg

SEQ ID NO: 57382 - RNA, 23 nt, Artificial Sequence
  Synthetic
gggggggggcgucgggacucgcg

SEQ ID NO: 57383 - RNA, 24 nt, Artificial Sequence
  Synthetic
ggggggggggcgucgggacucgcg

SEQ ID NO: 57384 - RNA, 18 nt, Artificial Sequence
  Synthetic
gccggagaauggaaggcg

SEQ ID NO: 57385 - RNA, 19 nt, Artificial Sequence
  Synthetic
ggccggagaauggaaggcg

SEQ ID NO: 57386 - RNA, 20 nt, Artificial Sequence
  Synthetic
gggccggagaauggaaggcg

SEQ ID NO: 57387 - RNA, 21 nt, Artificial Sequence
  Synthetic
agggccggagaauggaaggcg

SEQ ID NO: 57388 - RNA, 22 nt, Artificial Sequence
  Synthetic
gagggccggagaauggaaggcg

SEQ ID NO: 57389 - RNA, 23 nt, Artificial Sequence
  Synthetic
ggagggccggagaauggaaggcg

SEQ ID NO: 57390 - RNA, 24 nt, Artificial Sequence
  Synthetic
cggagggccggagaauggaaggcg

SEQ ID NO: 57391 - RNA, 18 nt, Artificial Sequence
  Synthetic
cagagggcggcggcggcg

SEQ ID NO: 57392 - RNA, 19 nt, Artificial Sequence
  Synthetic
gcagagggcggcggcggcg

SEQ ID NO: 57393 - RNA, 20 nt, Artificial Sequence
  Synthetic
ggcagagggcggcggcggcg

SEQ ID NO: 57394 - RNA, 21 nt, Artificial Sequence
  Synthetic
gggcagagggcggcggcggcg

SEQ ID NO: 57395 - RNA, 22 nt, Artificial Sequence
  Synthetic
cgggcagagggcggcggcggcg

SEQ ID NO: 57396 - RNA, 23 nt, Artificial Sequence
  Synthetic
gcgggcagagggcggcggcggcg

SEQ ID NO: 57397 - RNA, 24 nt, Artificial Sequence
  Synthetic
cgcgggcagagggcggcggcggcg

SEQ ID NO: 57398 - RNA, 18 nt, Artificial Sequence
  Synthetic
gggcagagggcggcggcg

SEQ ID NO: 57399 - RNA, 19 nt, Artificial Sequence
  Synthetic
cgggcagagggcggcggcg

SEQ ID NO: 57400 - RNA, 20 nt, Artificial Sequence
  Synthetic
gcgggcagagggcggcggcg

SEQ ID NO: 57401 - RNA, 21 nt, Artificial Sequence
  Synthetic
cgcgggcagagggcggcggcg

SEQ ID NO: 57402 - RNA, 22 nt, Artificial Sequence
  Synthetic
acgcgggcagagggcggcggcg

SEQ ID NO: 57403 - RNA, 23 nt, Artificial Sequence
  Synthetic
gacgcgggcagagggcggcggcg

SEQ ID NO: 57404 - RNA, 24 nt, Artificial Sequence
  Synthetic
ggacgcgggcagagggcggcggcg

SEQ ID NO: 57405 - RNA, 18 nt, Artificial Sequence
  Synthetic
cuccuucgucgggcggcg

SEQ ID NO: 57406 - RNA, 19 nt, Artificial Sequence
  Synthetic
ucuccuucgucgggcggcg

SEQ ID NO: 57407 - RNA, 20 nt, Artificial Sequence
  Synthetic
gucuccuucgucgggcggcg

SEQ ID NO: 57408 - RNA, 21 nt, Artificial Sequence
  Synthetic
ggucuccuucgucgggcggcg

SEQ ID NO: 57409 - RNA, 22 nt, Artificial Sequence
  Synthetic
gggucuccuucgucgggcggcg

SEQ ID NO: 57410 - RNA, 23 nt, Artificial Sequence
  Synthetic
ugggucuccuucgucgggcggcg

SEQ ID NO: 57411 - RNA, 24 nt, Artificial Sequence
  Synthetic
uugggucuccuucgucgggcggcg

SEQ ID NO: 57412 - RNA, 18 nt, Artificial Sequence
  Synthetic
ggucuccuucgucgggcg

SEQ ID NO: 57413 - RNA, 19 nt, Artificial Sequence
  Synthetic
gggucuccuucgucgggcg

SEQ ID NO: 57414 - RNA, 20 nt, Artificial Sequence
  Synthetic
ugggucuccuucgucgggcg

SEQ ID NO: 57415 - RNA, 21 nt, Artificial Sequence
  Synthetic
uugggucuccuucgucgggcg

SEQ ID NO: 57416 - RNA, 22 nt, Artificial Sequence
  Synthetic
cuugggucuccuucgucgggcg

SEQ ID NO: 57417 - RNA, 23 nt, Artificial Sequence
  Synthetic
gcuugggucuccuucgucgggcg

SEQ ID NO: 57418 - RNA, 24 nt, Artificial Sequence
  Synthetic
ugcuugggucuccuucgucgggcg

SEQ ID NO: 57419 - RNA, 18 nt, Artificial Sequence
  Synthetic
ggcggcggggggggggcg

SEQ ID NO: 57420 - RNA, 19 nt, Artificial Sequence
  Synthetic
gggcggcggggggggggcg

SEQ ID NO: 57421 - RNA, 20 nt, Artificial Sequence
  Synthetic
cgggcggcggggggggggcg

SEQ ID NO: 57422 - RNA, 21 nt, Artificial Sequence
  Synthetic
ucgggcggcggggggggggcg

SEQ ID NO: 57423 - RNA, 22 nt, Artificial Sequence
  Synthetic
gucgggcggcggggggggggcg

SEQ ID NO: 57424 - RNA, 23 nt, Artificial Sequence
  Synthetic
cgucgggcggcggggggggggcg

SEQ ID NO: 57425 - RNA, 24 nt, Artificial Sequence
  Synthetic
ucgucgggcggcggggggggggcg

SEQ ID NO: 57426 - RNA, 18 nt, Artificial Sequence
  Synthetic
ggggggcgucgggacucg

SEQ ID NO: 57427 - RNA, 19 nt, Artificial Sequence
  Synthetic
gggggggcgucgggacucg

SEQ ID NO: 57428 - RNA, 20 nt, Artificial Sequence
  Synthetic
ggggggggcgucgggacucg

SEQ ID NO: 57429 - RNA, 21 nt, Artificial Sequence
  Synthetic
gggggggggcgucgggacucg

SEQ ID NO: 57430 - RNA, 22 nt, Artificial Sequence
  Synthetic
ggggggggggcgucgggacucg

SEQ ID NO: 57431 - RNA, 23 nt, Artificial Sequence
  Synthetic
cggggggggggcgucgggacucg

SEQ ID NO: 57432 - RNA, 24 nt, Artificial Sequence
  Synthetic
gcggggggggggcgucgggacucg

SEQ ID NO: 57433 - RNA, 18 nt, Artificial Sequence
  Synthetic
acgcggcgcggcgucucg

SEQ ID NO: 57434 - RNA, 19 nt, Artificial Sequence
  Synthetic
cacgcggcgcggcgucucg

SEQ ID NO: 57435 - RNA, 20 nt, Artificial Sequence
  Synthetic
ucacgcggcgcggcgucucg

SEQ ID NO: 57436 - RNA, 21 nt, Artificial Sequence
  Synthetic
cucacgcggcgcggcgucucg

SEQ ID NO: 57437 - RNA, 22 nt, Artificial Sequence
  Synthetic
gcucacgcggcgcggcgucucg

SEQ ID NO: 57438 - RNA, 23 nt, Artificial Sequence
  Synthetic
ggcucacgcggcgcggcgucucg

SEQ ID NO: 57439 - RNA, 24 nt, Artificial Sequence
  Synthetic
cggcucacgcggcgcggcgucucg

SEQ ID NO: 57440 - RNA, 18 nt, Artificial Sequence
  Synthetic
gugcuugggucuccuucg

SEQ ID NO: 57441 - RNA, 19 nt, Artificial Sequence
  Synthetic
ggugcuugggucuccuucg

SEQ ID NO: 57442 - RNA, 20 nt, Artificial Sequence
  Synthetic
cggugcuugggucuccuucg

SEQ ID NO: 57443 - RNA, 21 nt, Artificial Sequence
  Synthetic
gcggugcuugggucuccuucg

SEQ ID NO: 57444 - RNA, 22 nt, Artificial Sequence
  Synthetic
ugcggugcuugggucuccuucg

SEQ ID NO: 57445 - RNA, 23 nt, Artificial Sequence
  Synthetic
cugcggugcuugggucuccuucg

SEQ ID NO: 57446 - RNA, 24 nt, Artificial Sequence
  Synthetic
gcugcggugcuugggucuccuucg

SEQ ID NO: 57447 - RNA, 18 nt, Artificial Sequence
  Synthetic
gagaacgcgcggcguucg

SEQ ID NO: 57448 - RNA, 19 nt, Artificial Sequence
  Synthetic
cgagaacgcgcggcguucg

SEQ ID NO: 57449 - RNA, 20 nt, Artificial Sequence
  Synthetic
gcgagaacgcgcggcguucg

SEQ ID NO: 57450 - RNA, 21 nt, Artificial Sequence
  Synthetic
ugcgagaacgcgcggcguucg

SEQ ID NO: 57451 - RNA, 22 nt, Artificial Sequence
  Synthetic
cugcgagaacgcgcggcguucg

SEQ ID NO: 57452 - RNA, 23 nt, Artificial Sequence
  Synthetic
ccugcgagaacgcgcggcguucg

SEQ ID NO: 57453 - RNA, 24 nt, Artificial Sequence
  Synthetic
accugcgagaacgcgcggcguucg

SEQ ID NO: 57454 - RNA, 18 nt, Artificial Sequence
  Synthetic
cucguguuucuugaaagg

SEQ ID NO: 57455 - RNA, 19 nt, Artificial Sequence
  Synthetic
ccucguguuucuugaaagg

SEQ ID NO: 57456 - RNA, 20 nt, Artificial Sequence
  Synthetic
gccucguguuucuugaaagg

SEQ ID NO: 57457 - RNA, 21 nt, Artificial Sequence
  Synthetic
cgccucguguuucuugaaagg

SEQ ID NO: 57458 - RNA, 22 nt, Artificial Sequence
  Synthetic
ccgccucguguuucuugaaagg

SEQ ID NO: 57459 - RNA, 23 nt, Artificial Sequence
  Synthetic
cccgccucguguuucuugaaagg

SEQ ID NO: 57460 - RNA, 24 nt, Artificial Sequence
  Synthetic
ccccgccucguguuucuugaaagg

SEQ ID NO: 57461 - RNA, 18 nt, Artificial Sequence
  Synthetic
agacagagagagagaagg

SEQ ID NO: 57462 - RNA, 19 nt, Artificial Sequence
  Synthetic
gagacagagagagagaagg

SEQ ID NO: 57463 - RNA, 20 nt, Artificial Sequence
  Synthetic
cgagacagagagagagaagg

SEQ ID NO: 57464 - RNA, 21 nt, Artificial Sequence
  Synthetic
gcgagacagagagagagaagg

SEQ ID NO: 57465 - RNA, 22 nt, Artificial Sequence
  Synthetic
agcgagacagagagagagaagg

SEQ ID NO: 57466 - RNA, 23 nt, Artificial Sequence
  Synthetic
gagcgagacagagagagagaagg

SEQ ID NO: 57467 - RNA, 24 nt, Artificial Sequence
  Synthetic
agagcgagacagagagagagaagg

SEQ ID NO: 57468 - RNA, 18 nt, Artificial Sequence
  Synthetic
aaggcgaggggaugcagg

SEQ ID NO: 57469 - RNA, 19 nt, Artificial Sequence
  Synthetic
gaaggcgaggggaugcagg

SEQ ID NO: 57470 - RNA, 20 nt, Artificial Sequence
  Synthetic
ggaaggcgaggggaugcagg

SEQ ID NO: 57471 - RNA, 21 nt, Artificial Sequence
  Synthetic
uggaaggcgaggggaugcagg

SEQ ID NO: 57472 - RNA, 22 nt, Artificial Sequence
  Synthetic
auggaaggcgaggggaugcagg

SEQ ID NO: 57473 - RNA, 23 nt, Artificial Sequence
  Synthetic
aauggaaggcgaggggaugcagg

SEQ ID NO: 57474 - RNA, 24 nt, Artificial Sequence
  Synthetic
gaauggaaggcgaggggaugcagg

SEQ ID NO: 57475 - RNA, 18 nt, Artificial Sequence
  Synthetic
uuucuugaaagggggagg

SEQ ID NO: 57476 - RNA, 19 nt, Artificial Sequence
  Synthetic
guuucuugaaagggggagg

SEQ ID NO: 57477 - RNA, 20 nt, Artificial Sequence
  Synthetic
uguuucuugaaagggggagg

SEQ ID NO: 57478 - RNA, 21 nt, Artificial Sequence
  Synthetic
guguuucuugaaagggggagg

SEQ ID NO: 57479 - RNA, 22 nt, Artificial Sequence
  Synthetic
cguguuucuugaaagggggagg

SEQ ID NO: 57480 - RNA, 23 nt, Artificial Sequence
  Synthetic
ucguguuucuugaaagggggagg

SEQ ID NO: 57481 - RNA, 24 nt, Artificial Sequence
  Synthetic
cucguguuucuugaaagggggagg

SEQ ID NO: 57482 - RNA, 18 nt, Artificial Sequence
  Synthetic
aggggcgcggcgggacgg

SEQ ID NO: 57483 - RNA, 19 nt, Artificial Sequence
  Synthetic
aaggggcgcggcgggacgg

SEQ ID NO: 57484 - RNA, 20 nt, Artificial Sequence
  Synthetic
gaaggggcgcggcgggacgg

SEQ ID NO: 57485 - RNA, 21 nt, Artificial Sequence
  Synthetic
ggaaggggcgcggcgggacgg

SEQ ID NO: 57486 - RNA, 22 nt, Artificial Sequence
  Synthetic
gggaaggggcgcggcgggacgg

SEQ ID NO: 57487 - RNA, 23 nt, Artificial Sequence
  Synthetic
agggaaggggcgcggcgggacgg

SEQ ID NO: 57488 - RNA, 24 nt, Artificial Sequence
  Synthetic
gagggaaggggcgcggcgggacgg

SEQ ID NO: 57489 - RNA, 18 nt, Artificial Sequence
  Synthetic
ucgccgcgaucccgccgg

SEQ ID NO: 57490 - RNA, 19 nt, Artificial Sequence
  Synthetic
cucgccgcgaucccgccgg

SEQ ID NO: 57491 - RNA, 20 nt, Artificial Sequence
  Synthetic
ucucgccgcgaucccgccgg

SEQ ID NO: 57492 - RNA, 21 nt, Artificial Sequence
  Synthetic
gucucgccgcgaucccgccgg

SEQ ID NO: 57493 - RNA, 22 nt, Artificial Sequence
  Synthetic
cgucucgccgcgaucccgccgg

SEQ ID NO: 57494 - RNA, 23 nt, Artificial Sequence
  Synthetic
gcgucucgccgcgaucccgccgg

SEQ ID NO: 57495 - RNA, 24 nt, Artificial Sequence
  Synthetic
ugcgucucgccgcgaucccgccgg

SEQ ID NO: 57496 - RNA, 18 nt, Artificial Sequence
  Synthetic
aagagggaaggggcgcgg

SEQ ID NO: 57497 - RNA, 19 nt, Artificial Sequence
  Synthetic
gaagagggaaggggcgcgg

SEQ ID NO: 57498 - RNA, 20 nt, Artificial Sequence
  Synthetic
ggaagagggaaggggcgcgg

SEQ ID NO: 57499 - RNA, 21 nt, Artificial Sequence
  Synthetic
aggaagagggaaggggcgcgg

SEQ ID NO: 57500 - RNA, 22 nt, Artificial Sequence
  Synthetic
aaggaagagggaaggggcgcgg

SEQ ID NO: 57501 - RNA, 23 nt, Artificial Sequence
  Synthetic
gaaggaagagggaaggggcgcgg

SEQ ID NO: 57502 - RNA, 24 nt, Artificial Sequence
  Synthetic
agaaggaagagggaaggggcgcgg

SEQ ID NO: 57503 - RNA, 18 nt, Artificial Sequence
  Synthetic
gguggggcgcggcggcgg

SEQ ID NO: 57504 - RNA, 19 nt, Artificial Sequence
  Synthetic
cgguggggcgcggcggcgg

SEQ ID NO: 57505 - RNA, 20 nt, Artificial Sequence
  Synthetic
ccgguggggcgcggcggcgg

SEQ ID NO: 57506 - RNA, 21 nt, Artificial Sequence
  Synthetic
gccgguggggcgcggcggcgg

SEQ ID NO: 57507 - RNA, 22 nt, Artificial Sequence
  Synthetic
cgccgguggggcgcggcggcgg

SEQ ID NO: 57508 - RNA, 23 nt, Artificial Sequence
  Synthetic
ccgccgguggggcgcggcggcgg

SEQ ID NO: 57509 - RNA, 24 nt, Artificial Sequence
  Synthetic
cccgccgguggggcgcggcggcgg

SEQ ID NO: 57510 - RNA, 18 nt, Artificial Sequence
  Synthetic
agagggcggcggcggcgg

SEQ ID NO: 57511 - RNA, 19 nt, Artificial Sequence
  Synthetic
cagagggcggcggcggcgg

SEQ ID NO: 57512 - RNA, 20 nt, Artificial Sequence
  Synthetic
gcagagggcggcggcggcgg

SEQ ID NO: 57513 - RNA, 21 nt, Artificial Sequence
  Synthetic
ggcagagggcggcggcggcgg

SEQ ID NO: 57514 - RNA, 22 nt, Artificial Sequence
  Synthetic
gggcagagggcggcggcggcgg

SEQ ID NO: 57515 - RNA, 23 nt, Artificial Sequence
  Synthetic
cgggcagagggcggcggcggcgg

SEQ ID NO: 57516 - RNA, 24 nt, Artificial Sequence
  Synthetic
gcgggcagagggcggcggcggcgg

SEQ ID NO: 57517 - RNA, 18 nt, Artificial Sequence
  Synthetic
ggcagagggcggcggcgg

SEQ ID NO: 57518 - RNA, 19 nt, Artificial Sequence
  Synthetic
gggcagagggcggcggcgg

SEQ ID NO: 57519 - RNA, 20 nt, Artificial Sequence
  Synthetic
cgggcagagggcggcggcgg

SEQ ID NO: 57520 - RNA, 21 nt, Artificial Sequence
  Synthetic
gcgggcagagggcggcggcgg

SEQ ID NO: 57521 - RNA, 22 nt, Artificial Sequence
  Synthetic
cgcgggcagagggcggcggcgg

SEQ ID NO: 57522 - RNA, 23 nt, Artificial Sequence
  Synthetic
acgcgggcagagggcggcggcgg

SEQ ID NO: 57523 - RNA, 24 nt, Artificial Sequence
  Synthetic
gacgcgggcagagggcggcggcgg

SEQ ID NO: 57524 - RNA, 18 nt, Artificial Sequence
  Synthetic
uccuucgucgggcggcgg

SEQ ID NO: 57525 - RNA, 19 nt, Artificial Sequence
  Synthetic
cuccuucgucgggcggcgg

SEQ ID NO: 57526 - RNA, 20 nt, Artificial Sequence
  Synthetic
ucuccuucgucgggcggcgg

SEQ ID NO: 57527 - RNA, 21 nt, Artificial Sequence
  Synthetic
gucuccuucgucgggcggcgg

SEQ ID NO: 57528 - RNA, 22 nt, Artificial Sequence
  Synthetic
ggucuccuucgucgggcggcgg

SEQ ID NO: 57529 - RNA, 23 nt, Artificial Sequence
  Synthetic
gggucuccuucgucgggcggcgg

SEQ ID NO: 57530 - RNA, 24 nt, Artificial Sequence
  Synthetic
ugggucuccuucgucgggcggcgg

SEQ ID NO: 57531 - RNA, 18 nt, Artificial Sequence
  Synthetic
gucuccuucgucgggcgg

SEQ ID NO: 57532 - RNA, 19 nt, Artificial Sequence
  Synthetic
ggucuccuucgucgggcgg

SEQ ID NO: 57533 - RNA, 20 nt, Artificial Sequence
  Synthetic
gggucuccuucgucgggcgg

SEQ ID NO: 57534 - RNA, 21 nt, Artificial Sequence
  Synthetic
ugggucuccuucgucgggcgg

SEQ ID NO: 57535 - RNA, 22 nt, Artificial Sequence
  Synthetic
uugggucuccuucgucgggcgg

SEQ ID NO: 57536 - RNA, 23 nt, Artificial Sequence
  Synthetic
cuugggucuccuucgucgggcgg

SEQ ID NO: 57537 - RNA, 24 nt, Artificial Sequence
  Synthetic
gcuugggucuccuucgucgggcgg

SEQ ID NO: 57538 - RNA, 18 nt, Artificial Sequence
  Synthetic
cgcggcgcggcgucucgg

SEQ ID NO: 57539 - RNA, 19 nt, Artificial Sequence
  Synthetic
acgcggcgcggcgucucgg

SEQ ID NO: 57540 - RNA, 20 nt, Artificial Sequence
  Synthetic
cacgcggcgcggcgucucgg

SEQ ID NO: 57541 - RNA, 21 nt, Artificial Sequence
  Synthetic
ucacgcggcgcggcgucucgg

SEQ ID NO: 57542 - RNA, 22 nt, Artificial Sequence
  Synthetic
cucacgcggcgcggcgucucgg

SEQ ID NO: 57543 - RNA, 23 nt, Artificial Sequence
  Synthetic
gcucacgcggcgcggcgucucgg

SEQ ID NO: 57544 - RNA, 24 nt, Artificial Sequence
  Synthetic
ggcucacgcggcgcggcgucucgg

SEQ ID NO: 57545 - RNA, 18 nt, Artificial Sequence
  Synthetic
ggaagacgaggagaaggg

SEQ ID NO: 57546 - RNA, 19 nt, Artificial Sequence
  Synthetic
gggaagacgaggagaaggg

SEQ ID NO: 57547 - RNA, 20 nt, Artificial Sequence
  Synthetic
ggggaagacgaggagaaggg

SEQ ID NO: 57548 - RNA, 21 nt, Artificial Sequence
  Synthetic
gggggaagacgaggagaaggg

SEQ ID NO: 57549 - RNA, 22 nt, Artificial Sequence
  Synthetic
cgggggaagacgaggagaaggg

SEQ ID NO: 57550 - RNA, 23 nt, Artificial Sequence
  Synthetic
acgggggaagacgaggagaaggg

SEQ ID NO: 57551 - RNA, 24 nt, Artificial Sequence
  Synthetic
gacgggggaagacgaggagaaggg

SEQ ID NO: 57552 - RNA, 18 nt, Artificial Sequence
  Synthetic
acgaggagaagggaaggg

SEQ ID NO: 57553 - RNA, 19 nt, Artificial Sequence
  Synthetic
gacgaggagaagggaaggg

SEQ ID NO: 57554 - RNA, 20 nt, Artificial Sequence
  Synthetic
agacgaggagaagggaaggg

SEQ ID NO: 57555 - RNA, 21 nt, Artificial Sequence
  Synthetic
aagacgaggagaagggaaggg

SEQ ID NO: 57556 - RNA, 22 nt, Artificial Sequence
  Synthetic
gaagacgaggagaagggaaggg

SEQ ID NO: 57557 - RNA, 23 nt, Artificial Sequence
  Synthetic
ggaagacgaggagaagggaaggg

SEQ ID NO: 57558 - RNA, 24 nt, Artificial Sequence
  Synthetic
gggaagacgaggagaagggaaggg

SEQ ID NO: 57559 - RNA, 18 nt, Artificial Sequence
  Synthetic
gagagagaaggaagaggg

SEQ ID NO: 57560 - RNA, 19 nt, Artificial Sequence
  Synthetic
agagagagaaggaagaggg

SEQ ID NO: 57561 - RNA, 20 nt, Artificial Sequence
  Synthetic
gagagagagaaggaagaggg

SEQ ID NO: 57562 - RNA, 21 nt, Artificial Sequence
  Synthetic
agagagagagaaggaagaggg

SEQ ID NO: 57563 - RNA, 22 nt, Artificial Sequence
  Synthetic
cagagagagagaaggaagaggg

SEQ ID NO: 57564 - RNA, 23 nt, Artificial Sequence
  Synthetic
acagagagagagaaggaagaggg

SEQ ID NO: 57565 - RNA, 24 nt, Artificial Sequence
  Synthetic
gacagagagagagaaggaagaggg

SEQ ID NO: 57566 - RNA, 18 nt, Artificial Sequence
  Synthetic
gucgggacucgcggaggg

SEQ ID NO: 57567 - RNA, 19 nt, Artificial Sequence
  Synthetic
cgucgggacucgcggaggg

SEQ ID NO: 57568 - RNA, 20 nt, Artificial Sequence
  Synthetic
gcgucgggacucgcggaggg

SEQ ID NO: 57569 - RNA, 21 nt, Artificial Sequence
  Synthetic
ggcgucgggacucgcggaggg

SEQ ID NO: 57570 - RNA, 22 nt, Artificial Sequence
  Synthetic
gggcgucgggacucgcggaggg

SEQ ID NO: 57571 - RNA, 23 nt, Artificial Sequence
  Synthetic
ggggcgucgggacucgcggaggg

SEQ ID NO: 57572 - RNA, 24 nt, Artificial Sequence
  Synthetic
gggggcgucgggacucgcggaggg

SEQ ID NO: 57573 - RNA, 18 nt, Artificial Sequence
  Synthetic
gucucggugggacgcggg

SEQ ID NO: 57574 - RNA, 19 nt, Artificial Sequence
  Synthetic
cgucucggugggacgcggg

SEQ ID NO: 57575 - RNA, 20 nt, Artificial Sequence
  Synthetic
gcgucucggugggacgcggg

SEQ ID NO: 57576 - RNA, 21 nt, Artificial Sequence
  Synthetic
ggcgucucggugggacgcggg

SEQ ID NO: 57577 - RNA, 22 nt, Artificial Sequence
  Synthetic
cggcgucucggugggacgcggg

SEQ ID NO: 57578 - RNA, 23 nt, Artificial Sequence
  Synthetic
gcggcgucucggugggacgcggg

SEQ ID NO: 57579 - RNA, 24 nt, Artificial Sequence
  Synthetic
cgcggcgucucggugggacgcggg

SEQ ID NO: 57580 - RNA, 18 nt, Artificial Sequence
  Synthetic
gggaaggggcgcggcggg

SEQ ID NO: 57581 - RNA, 19 nt, Artificial Sequence
  Synthetic
agggaaggggcgcggcggg

SEQ ID NO: 57582 - RNA, 20 nt, Artificial Sequence
  Synthetic
gagggaaggggcgcggcggg

SEQ ID NO: 57583 - RNA, 21 nt, Artificial Sequence
  Synthetic
agagggaaggggcgcggcggg

SEQ ID NO: 57584 - RNA, 22 nt, Artificial Sequence
  Synthetic
aagagggaaggggcgcggcggg

SEQ ID NO: 57585 - RNA, 23 nt, Artificial Sequence
  Synthetic
gaagagggaaggggcgcggcggg

SEQ ID NO: 57586 - RNA, 24 nt, Artificial Sequence
  Synthetic
ggaagagggaaggggcgcggcggg

SEQ ID NO: 57587 - RNA, 18 nt, Artificial Sequence
  Synthetic
gagggcggcggcggcggg

SEQ ID NO: 57588 - RNA, 19 nt, Artificial Sequence
  Synthetic
agagggcggcggcggcggg

SEQ ID NO: 57589 - RNA, 20 nt, Artificial Sequence
  Synthetic
cagagggcggcggcggcggg

SEQ ID NO: 57590 - RNA, 21 nt, Artificial Sequence
  Synthetic
gcagagggcggcggcggcggg

SEQ ID NO: 57591 - RNA, 22 nt, Artificial Sequence
  Synthetic
ggcagagggcggcggcggcggg

SEQ ID NO: 57592 - RNA, 23 nt, Artificial Sequence
  Synthetic
gggcagagggcggcggcggcggg

SEQ ID NO: 57593 - RNA, 24 nt, Artificial Sequence
  Synthetic
cgggcagagggcggcggcggcggg

SEQ ID NO: 57594 - RNA, 18 nt, Artificial Sequence
  Synthetic
ccuucgucgggcggcggg

SEQ ID NO: 57595 - RNA, 19 nt, Artificial Sequence
  Synthetic
uccuucgucgggcggcggg

SEQ ID NO: 57596 - RNA, 20 nt, Artificial Sequence
  Synthetic
cuccuucgucgggcggcggg

SEQ ID NO: 57597 - RNA, 21 nt, Artificial Sequence
  Synthetic
ucuccuucgucgggcggcggg

SEQ ID NO: 57598 - RNA, 22 nt, Artificial Sequence
  Synthetic
gucuccuucgucgggcggcggg

SEQ ID NO: 57599 - RNA, 23 nt, Artificial Sequence
  Synthetic
ggucuccuucgucgggcggcggg

SEQ ID NO: 57600 - RNA, 24 nt, Artificial Sequence
  Synthetic
gggucuccuucgucgggcggcggg

SEQ ID NO: 57601 - RNA, 18 nt, Artificial Sequence
  Synthetic
ggcgcggcggcggucggg

SEQ ID NO: 57602 - RNA, 19 nt, Artificial Sequence
  Synthetic
gggcgcggcggcggucggg

SEQ ID NO: 57603 - RNA, 20 nt, Artificial Sequence
  Synthetic
ggggcgcggcggcggucggg

SEQ ID NO: 57604 - RNA, 21 nt, Artificial Sequence
  Synthetic
uggggcgcggcggcggucggg

SEQ ID NO: 57605 - RNA, 22 nt, Artificial Sequence
  Synthetic
guggggcgcggcggcggucggg

SEQ ID NO: 57606 - RNA, 23 nt, Artificial Sequence
  Synthetic
gguggggcgcggcggcggucggg

SEQ ID NO: 57607 - RNA, 24 nt, Artificial Sequence
  Synthetic
cgguggggcgcggcggcggucggg

SEQ ID NO: 57608 - RNA, 18 nt, Artificial Sequence
  Synthetic
cguguuucuugaaagggg

SEQ ID NO: 57609 - RNA, 19 nt, Artificial Sequence
  Synthetic
ucguguuucuugaaagggg

SEQ ID NO: 57610 - RNA, 20 nt, Artificial Sequence
  Synthetic
cucguguuucuugaaagggg

SEQ ID NO: 57611 - RNA, 21 nt, Artificial Sequence
  Synthetic
ccucguguuucuugaaagggg

SEQ ID NO: 57612 - RNA, 22 nt, Artificial Sequence
  Synthetic
gccucguguuucuugaaagggg

SEQ ID NO: 57613 - RNA, 23 nt, Artificial Sequence
  Synthetic
cgccucguguuucuugaaagggg

SEQ ID NO: 57614 - RNA, 24 nt, Artificial Sequence
  Synthetic
ccgccucguguuucuugaaagggg

SEQ ID NO: 57615 - RNA, 18 nt, Artificial Sequence
  Synthetic
agggcggcggcggcgggg

SEQ ID NO: 57616 - RNA, 19 nt, Artificial Sequence
  Synthetic
gagggcggcggcggcgggg

SEQ ID NO: 57617 - RNA, 20 nt, Artificial Sequence
  Synthetic
agagggcggcggcggcgggg

SEQ ID NO: 57618 - RNA, 21 nt, Artificial Sequence
  Synthetic
cagagggcggcggcggcgggg

SEQ ID NO: 57619 - RNA, 22 nt, Artificial Sequence
  Synthetic
gcagagggcggcggcggcgggg

SEQ ID NO: 57620 - RNA, 23 nt, Artificial Sequence
  Synthetic
ggcagagggcggcggcggcgggg

SEQ ID NO: 57621 - RNA, 24 nt, Artificial Sequence
  Synthetic
gggcagagggcggcggcggcgggg

SEQ ID NO: 57622 - RNA, 18 nt, Artificial Sequence
  Synthetic
cuucgucgggcggcgggg

SEQ ID NO: 57623 - RNA, 19 nt, Artificial Sequence
  Synthetic
ccuucgucgggcggcgggg

SEQ ID NO: 57624 - RNA, 20 nt, Artificial Sequence
  Synthetic
uccuucgucgggcggcgggg

SEQ ID NO: 57625 - RNA, 21 nt, Artificial Sequence
  Synthetic
cuccuucgucgggcggcgggg

SEQ ID NO: 57626 - RNA, 22 nt, Artificial Sequence
  Synthetic
ucuccuucgucgggcggcgggg

SEQ ID NO: 57627 - RNA, 23 nt, Artificial Sequence
  Synthetic
gucuccuucgucgggcggcgggg

SEQ ID NO: 57628 - RNA, 24 nt, Artificial Sequence
  Synthetic
ggucuccuucgucgggcggcgggg

SEQ ID NO: 57629 - RNA, 21 nt, Artificial Sequence
  Synthetic
ggggcgcggcggcggucgggg

SEQ ID NO: 57630 - RNA, 22 nt, Artificial Sequence
  Synthetic
uggggcgcggcggcggucgggg

SEQ ID NO: 57631 - RNA, 23 nt, Artificial Sequence
  Synthetic
guggggcgcggcggcggucgggg

SEQ ID NO: 57632 - RNA, 24 nt, Artificial Sequence
  Synthetic
gguggggcgcggcggcggucgggg

SEQ ID NO: 57633 - RNA, 18 nt, Artificial Sequence
  Synthetic
guguuucuugaaaggggg

SEQ ID NO: 57634 - RNA, 19 nt, Artificial Sequence
  Synthetic
cguguuucuugaaaggggg

SEQ ID NO: 57635 - RNA, 20 nt, Artificial Sequence
  Synthetic
ucguguuucuugaaaggggg

SEQ ID NO: 57636 - RNA, 21 nt, Artificial Sequence
  Synthetic
cucguguuucuugaaaggggg

SEQ ID NO: 57637 - RNA, 22 nt, Artificial Sequence
  Synthetic
ccucguguuucuugaaaggggg

SEQ ID NO: 57638 - RNA, 23 nt, Artificial Sequence
  Synthetic
gccucguguuucuugaaaggggg

SEQ ID NO: 57639 - RNA, 24 nt, Artificial Sequence
  Synthetic
cgccucguguuucuugaaaggggg

SEQ ID NO: 57640 - RNA, 18 nt, Artificial Sequence
  Synthetic
gggcggcggcggcggggg

SEQ ID NO: 57641 - RNA, 19 nt, Artificial Sequence
  Synthetic
agggcggcggcggcggggg

SEQ ID NO: 57642 - RNA, 20 nt, Artificial Sequence
  Synthetic
gagggcggcggcggcggggg

SEQ ID NO: 57643 - RNA, 21 nt, Artificial Sequence
  Synthetic
agagggcggcggcggcggggg

SEQ ID NO: 57644 - RNA, 22 nt, Artificial Sequence
  Synthetic
cagagggcggcggcggcggggg

SEQ ID NO: 57645 - RNA, 23 nt, Artificial Sequence
  Synthetic
gcagagggcggcggcggcggggg

SEQ ID NO: 57646 - RNA, 24 nt, Artificial Sequence
  Synthetic
ggcagagggcggcggcggcggggg

SEQ ID NO: 57647 - RNA, 18 nt, Artificial Sequence
  Synthetic
uucgucgggcggcggggg

SEQ ID NO: 57648 - RNA, 19 nt, Artificial Sequence
  Synthetic
cuucgucgggcggcggggg

SEQ ID NO: 57649 - RNA, 20 nt, Artificial Sequence
  Synthetic
ccuucgucgggcggcggggg

SEQ ID NO: 57650 - RNA, 21 nt, Artificial Sequence
  Synthetic
uccuucgucgggcggcggggg

SEQ ID NO: 57651 - RNA, 22 nt, Artificial Sequence
  Synthetic
cuccuucgucgggcggcggggg

SEQ ID NO: 57652 - RNA, 23 nt, Artificial Sequence
  Synthetic
ucuccuucgucgggcggcggggg

SEQ ID NO: 57653 - RNA, 24 nt, Artificial Sequence
  Synthetic
gucuccuucgucgggcggcggggg

SEQ ID NO: 57654 - RNA, 18 nt, Artificial Sequence
  Synthetic
ggcggcggcggcgggggg

SEQ ID NO: 57655 - RNA, 19 nt, Artificial Sequence
  Synthetic
gggcggcggcggcgggggg

SEQ ID NO: 57656 - RNA, 20 nt, Artificial Sequence
  Synthetic
agggcggcggcggcgggggg

SEQ ID NO: 57657 - RNA, 21 nt, Artificial Sequence
  Synthetic
gagggcggcggcggcgggggg

SEQ ID NO: 57658 - RNA, 22 nt, Artificial Sequence
  Synthetic
agagggcggcggcggcgggggg

SEQ ID NO: 57659 - RNA, 23 nt, Artificial Sequence
  Synthetic
cagagggcggcggcggcgggggg

SEQ ID NO: 57660 - RNA, 24 nt, Artificial Sequence
  Synthetic
gcagagggcggcggcggcgggggg

SEQ ID NO: 57661 - RNA, 18 nt, Artificial Sequence
  Synthetic
gcggcggcggcggggggg

SEQ ID NO: 57662 - RNA, 19 nt, Artificial Sequence
  Synthetic
ggcggcggcggcggggggg

SEQ ID NO: 57663 - RNA, 20 nt, Artificial Sequence
  Synthetic
gggcggcggcggcggggggg

SEQ ID NO: 57664 - RNA, 21 nt, Artificial Sequence
  Synthetic
agggcggcggcggcggggggg

SEQ ID NO: 57665 - RNA, 22 nt, Artificial Sequence
  Synthetic
gagggcggcggcggcggggggg

SEQ ID NO: 57666 - RNA, 23 nt, Artificial Sequence
  Synthetic
agagggcggcggcggcggggggg

SEQ ID NO: 57667 - RNA, 24 nt, Artificial Sequence
  Synthetic
cagagggcggcggcggcggggggg

SEQ ID NO: 57668 - RNA, 18 nt, Artificial Sequence
  Synthetic
cggcggcggcgggggggg

SEQ ID NO: 57669 - RNA, 19 nt, Artificial Sequence
  Synthetic
gcggcggcggcgggggggg

SEQ ID NO: 57670 - RNA, 20 nt, Artificial Sequence
  Synthetic
ggcggcggcggcgggggggg

SEQ ID NO: 57671 - RNA, 21 nt, Artificial Sequence
  Synthetic
gggcggcggcggcgggggggg

SEQ ID NO: 57672 - RNA, 22 nt, Artificial Sequence
  Synthetic
agggcggcggcggcgggggggg

SEQ ID NO: 57673 - RNA, 23 nt, Artificial Sequence
  Synthetic
gagggcggcggcggcgggggggg

SEQ ID NO: 57674 - RNA, 24 nt, Artificial Sequence
  Synthetic
agagggcggcggcggcgggggggg

SEQ ID NO: 57675 - RNA, 18 nt, Artificial Sequence
  Synthetic
ggcggcggcggggggggg

SEQ ID NO: 57676 - RNA, 19 nt, Artificial Sequence
  Synthetic
cggcggcggcggggggggg

SEQ ID NO: 57677 - RNA, 20 nt, Artificial Sequence
  Synthetic
gcggcggcggcggggggggg

SEQ ID NO: 57678 - RNA, 21 nt, Artificial Sequence
  Synthetic
ggcggcggcggcggggggggg

SEQ ID NO: 57679 - RNA, 22 nt, Artificial Sequence
  Synthetic
gggcggcggcggcggggggggg

SEQ ID NO: 57680 - RNA, 23 nt, Artificial Sequence
  Synthetic
agggcggcggcggcggggggggg

SEQ ID NO: 57681 - RNA, 24 nt, Artificial Sequence
  Synthetic
gagggcggcggcggcggggggggg

SEQ ID NO: 57682 - RNA, 18 nt, Artificial Sequence
  Synthetic
gcggcggcgggggggggg

SEQ ID NO: 57683 - RNA, 19 nt, Artificial Sequence
  Synthetic
ggcggcggcgggggggggg

SEQ ID NO: 57684 - RNA, 20 nt, Artificial Sequence
  Synthetic
cggcggcggcgggggggggg

SEQ ID NO: 57685 - RNA, 21 nt, Artificial Sequence
  Synthetic
gcggcggcggcgggggggggg

SEQ ID NO: 57686 - RNA, 22 nt, Artificial Sequence
  Synthetic
ggcggcggcggcgggggggggg

SEQ ID NO: 57687 - RNA, 23 nt, Artificial Sequence
  Synthetic
gggcggcggcggcgggggggggg

SEQ ID NO: 57688 - RNA, 24 nt, Artificial Sequence
  Synthetic
agggcggcggcggcgggggggggg

SEQ ID NO: 57689 - RNA, 18 nt, Artificial Sequence
  Synthetic
ggugggcggguggugggg

SEQ ID NO: 57690 - RNA, 19 nt, Artificial Sequence
  Synthetic
gggugggcggguggugggg

SEQ ID NO: 57691 - RNA, 20 nt, Artificial Sequence
  Synthetic
ugggugggcggguggugggg

SEQ ID NO: 57692 - RNA, 21 nt, Artificial Sequence
  Synthetic
gugggugggcggguggugggg

SEQ ID NO: 57693 - RNA, 22 nt, Artificial Sequence
  Synthetic
ggugggugggcggguggugggg

SEQ ID NO: 57694 - RNA, 23 nt, Artificial Sequence
  Synthetic
aggugggugggcggguggugggg

SEQ ID NO: 57695 - RNA, 24 nt, Artificial Sequence
  Synthetic
uaggugggugggcggguggugggg

SEQ ID NO: 57696 - RNA, 18 nt, Artificial Sequence
  Synthetic
ggcggcggucgggguggg

SEQ ID NO: 57697 - RNA, 19 nt, Artificial Sequence
  Synthetic
cggcggcggucgggguggg

SEQ ID NO: 57698 - RNA, 20 nt, Artificial Sequence
  Synthetic
gcggcggcggucgggguggg

SEQ ID NO: 57699 - RNA, 21 nt, Artificial Sequence
  Synthetic
cgcggcggcggucgggguggg

SEQ ID NO: 57700 - RNA, 22 nt, Artificial Sequence
  Synthetic
gcgcggcggcggucgggguggg

SEQ ID NO: 57701 - RNA, 23 nt, Artificial Sequence
  Synthetic
ggcgcggcggcggucgggguggg

SEQ ID NO: 57702 - RNA, 24 nt, Artificial Sequence
  Synthetic
gggcgcggcggcggucgggguggg

SEQ ID NO: 57703 - RNA, 18 nt, Artificial Sequence
  Synthetic
gggugggcgggugguggg

SEQ ID NO: 57704 - RNA, 19 nt, Artificial Sequence
  Synthetic
ugggugggcgggugguggg

SEQ ID NO: 57705 - RNA, 20 nt, Artificial Sequence
  Synthetic
gugggugggcgggugguggg

SEQ ID NO: 57706 - RNA, 21 nt, Artificial Sequence
  Synthetic
ggugggugggcgggugguggg

SEQ ID NO: 57707 - RNA, 22 nt, Artificial Sequence
  Synthetic
aggugggugggcgggugguggg

SEQ ID NO: 57708 - RNA, 23 nt, Artificial Sequence
  Synthetic
uaggugggugggcgggugguggg

SEQ ID NO: 57709 - RNA, 24 nt, Artificial Sequence
  Synthetic
guaggugggugggcgggugguggg

SEQ ID NO: 57710 - RNA, 18 nt, Artificial Sequence
  Synthetic
cgggcgcgggguaggugg

SEQ ID NO: 57711 - RNA, 19 nt, Artificial Sequence
  Synthetic
gcgggcgcgggguaggugg

SEQ ID NO: 57712 - RNA, 20 nt, Artificial Sequence
  Synthetic
ugcgggcgcgggguaggugg

SEQ ID NO: 57713 - RNA, 21 nt, Artificial Sequence
  Synthetic
cugcgggcgcgggguaggugg

SEQ ID NO: 57714 - RNA, 22 nt, Artificial Sequence
  Synthetic
gcugcgggcgcgggguaggugg

SEQ ID NO: 57715 - RNA, 23 nt, Artificial Sequence
  Synthetic
ggcugcgggcgcgggguaggugg

SEQ ID NO: 57716 - RNA, 24 nt, Artificial Sequence
  Synthetic
aggcugcgggcgcgggguaggugg

SEQ ID NO: 57717 - RNA, 18 nt, Artificial Sequence
  Synthetic
aggugggugggcgggugg

SEQ ID NO: 57718 - RNA, 19 nt, Artificial Sequence
  Synthetic
uaggugggugggcgggugg

SEQ ID NO: 57719 - RNA, 20 nt, Artificial Sequence
  Synthetic
guaggugggugggcgggugg

SEQ ID NO: 57720 - RNA, 21 nt, Artificial Sequence
  Synthetic
gguaggugggugggcgggugg

SEQ ID NO: 57721 - RNA, 22 nt, Artificial Sequence
  Synthetic
ggguaggugggugggcgggugg

SEQ ID NO: 57722 - RNA, 23 nt, Artificial Sequence
  Synthetic
gggguaggugggugggcgggugg

SEQ ID NO: 57723 - RNA, 24 nt, Artificial Sequence
  Synthetic
cgggguaggugggugggcgggugg

SEQ ID NO: 57724 - RNA, 18 nt, Artificial Sequence
  Synthetic
cggcggcggucggggugg

SEQ ID NO: 57725 - RNA, 19 nt, Artificial Sequence
  Synthetic
gcggcggcggucggggugg

SEQ ID NO: 57726 - RNA, 20 nt, Artificial Sequence
  Synthetic
cgcggcggcggucggggugg

SEQ ID NO: 57727 - RNA, 21 nt, Artificial Sequence
  Synthetic
gcgcggcggcggucggggugg

SEQ ID NO: 57728 - RNA, 22 nt, Artificial Sequence
  Synthetic
ggcgcggcggcggucggggugg

SEQ ID NO: 57729 - RNA, 23 nt, Artificial Sequence
  Synthetic
gggcgcggcggcggucggggugg

SEQ ID NO: 57730 - RNA, 24 nt, Artificial Sequence
  Synthetic
ggggcgcggcggcggucggggugg

SEQ ID NO: 57731 - RNA, 18 nt, Artificial Sequence
  Synthetic
ugggugggcggguggugg

SEQ ID NO: 57732 - RNA, 19 nt, Artificial Sequence
  Synthetic
gugggugggcggguggugg

SEQ ID NO: 57733 - RNA, 20 nt, Artificial Sequence
  Synthetic
ggugggugggcggguggugg

SEQ ID NO: 57734 - RNA, 21 nt, Artificial Sequence
  Synthetic
aggugggugggcggguggugg

SEQ ID NO: 57735 - RNA, 22 nt, Artificial Sequence
  Synthetic
uaggugggugggcggguggugg

SEQ ID NO: 57736 - RNA, 23 nt, Artificial Sequence
  Synthetic
guaggugggugggcggguggugg

SEQ ID NO: 57737 - RNA, 24 nt, Artificial Sequence
  Synthetic
gguaggugggugggcggguggugg

SEQ ID NO: 57738 - RNA, 18 nt, Artificial Sequence
  Synthetic
auggaaggcgaggggaug

SEQ ID NO: 57739 - RNA, 19 nt, Artificial Sequence
  Synthetic
aauggaaggcgaggggaug

SEQ ID NO: 57740 - RNA, 20 nt, Artificial Sequence
  Synthetic
gaauggaaggcgaggggaug

SEQ ID NO: 57741 - RNA, 21 nt, Artificial Sequence
  Synthetic
agaauggaaggcgaggggaug

SEQ ID NO: 57742 - RNA, 22 nt, Artificial Sequence
  Synthetic
gagaauggaaggcgaggggaug

SEQ ID NO: 57743 - RNA, 23 nt, Artificial Sequence
  Synthetic
ggagaauggaaggcgaggggaug

SEQ ID NO: 57744 - RNA, 24 nt, Artificial Sequence
  Synthetic
cggagaauggaaggcgaggggaug

SEQ ID NO: 57745 - RNA, 18 nt, Artificial Sequence
  Synthetic
gcgguggucggcgugcug

SEQ ID NO: 57746 - RNA, 19 nt, Artificial Sequence
  Synthetic
ggcgguggucggcgugcug

SEQ ID NO: 57747 - RNA, 20 nt, Artificial Sequence
  Synthetic
cggcgguggucggcgugcug

SEQ ID NO: 57748 - RNA, 21 nt, Artificial Sequence
  Synthetic
gcggcgguggucggcgugcug

SEQ ID NO: 57749 - RNA, 22 nt, Artificial Sequence
  Synthetic
ggcggcgguggucggcgugcug

SEQ ID NO: 57750 - RNA, 23 nt, Artificial Sequence
  Synthetic
uggcggcgguggucggcgugcug

SEQ ID NO: 57751 - RNA, 24 nt, Artificial Sequence
  Synthetic
guggcggcgguggucggcgugcug

SEQ ID NO: 57752 - RNA, 18 nt, Artificial Sequence
  Synthetic
uaggugggugggcgggug

SEQ ID NO: 57753 - RNA, 19 nt, Artificial Sequence
  Synthetic
guaggugggugggcgggug

SEQ ID NO: 57754 - RNA, 20 nt, Artificial Sequence
  Synthetic
gguaggugggugggcgggug

SEQ ID NO: 57755 - RNA, 21 nt, Artificial Sequence
  Synthetic
ggguaggugggugggcgggug

SEQ ID NO: 57756 - RNA, 22 nt, Artificial Sequence
  Synthetic
gggguaggugggugggcgggug

SEQ ID NO: 57757 - RNA, 23 nt, Artificial Sequence
  Synthetic
cgggguaggugggugggcgggug

SEQ ID NO: 57758 - RNA, 24 nt, Artificial Sequence
  Synthetic
gcgggguaggugggugggcgggug

SEQ ID NO: 57759 - RNA, 18 nt, Artificial Sequence
  Synthetic
gcggcggcggucggggug

SEQ ID NO: 57760 - RNA, 19 nt, Artificial Sequence
  Synthetic
cgcggcggcggucggggug

SEQ ID NO: 57761 - RNA, 20 nt, Artificial Sequence
  Synthetic
gcgcggcggcggucggggug

SEQ ID NO: 57762 - RNA, 21 nt, Artificial Sequence
  Synthetic
ggcgcggcggcggucggggug

SEQ ID NO: 57763 - RNA, 22 nt, Artificial Sequence
  Synthetic
gggcgcggcggcggucggggug

SEQ ID NO: 57764 - RNA, 23 nt, Artificial Sequence
  Synthetic
ggggcgcggcggcggucggggug

SEQ ID NO: 57765 - RNA, 24 nt, Artificial Sequence
  Synthetic
uggggcgcggcggcggucggggug

SEQ ID NO: 57766 - RNA, 18 nt, Artificial Sequence
  Synthetic
gugggugggcggguggug

SEQ ID NO: 57767 - RNA, 19 nt, Artificial Sequence
  Synthetic
ggugggugggcggguggug

SEQ ID NO: 57768 - RNA, 20 nt, Artificial Sequence
  Synthetic
aggugggugggcggguggug

SEQ ID NO: 57769 - RNA, 21 nt, Artificial Sequence
  Synthetic
uaggugggugggcggguggug

SEQ ID NO: 57770 - RNA, 22 nt, Artificial Sequence
  Synthetic
guaggugggugggcggguggug

SEQ ID NO: 57771 - RNA, 23 nt, Artificial Sequence
  Synthetic
gguaggugggugggcggguggug

SEQ ID NO: 57772 - RNA, 24 nt, Artificial Sequence
  Synthetic
ggguaggugggugggcggguggug

SEQ ID NO: 57773 - RNA, 18 nt, Artificial Sequence
  Synthetic
gggggggggggaaaugug

SEQ ID NO: 57774 - RNA, 19 nt, Artificial Sequence
  Synthetic
ggggggggggggaaaugug

SEQ ID NO: 57775 - RNA, 20 nt, Artificial Sequence
  Synthetic
gggggggggggggaaaugug

SEQ ID NO: 57776 - RNA, 21 nt, Artificial Sequence
  Synthetic
cgggggggggggggaaaugug

SEQ ID NO: 57777 - RNA, 22 nt, Artificial Sequence
  Synthetic
gcgggggggggggggaaaugug

SEQ ID NO: 57778 - RNA, 23 nt, Artificial Sequence
  Synthetic
ggcgggggggggggggaaaugug

SEQ ID NO: 57779 - RNA, 24 nt, Artificial Sequence
  Synthetic
cggcgggggggggggggaaaugug

SEQ ID NO: 57780 - RNA, 18 nt, Artificial Sequence
  Synthetic
cgggggggggggggaaau

SEQ ID NO: 57781 - RNA, 19 nt, Artificial Sequence
  Synthetic
gcgggggggggggggaaau

SEQ ID NO: 57782 - RNA, 20 nt, Artificial Sequence
  Synthetic
ggcgggggggggggggaaau

SEQ ID NO: 57783 - RNA, 21 nt, Artificial Sequence
  Synthetic
cggcgggggggggggggaaau

SEQ ID NO: 57784 - RNA, 22 nt, Artificial Sequence
  Synthetic
gcggcgggggggggggggaaau

SEQ ID NO: 57785 - RNA, 23 nt, Artificial Sequence
  Synthetic
ggcggcgggggggggggggaaau

SEQ ID NO: 57786 - RNA, 24 nt, Artificial Sequence
  Synthetic
cggcggcgggggggggggggaaau

SEQ ID NO: 57787 - RNA, 18 nt, Artificial Sequence
  Synthetic
gggaugcaggaggaggau

SEQ ID NO: 57788 - RNA, 19 nt, Artificial Sequence
  Synthetic
ggggaugcaggaggaggau

SEQ ID NO: 57789 - RNA, 20 nt, Artificial Sequence
  Synthetic
aggggaugcaggaggaggau

SEQ ID NO: 57790 - RNA, 21 nt, Artificial Sequence
  Synthetic
gaggggaugcaggaggaggau

SEQ ID NO: 57791 - RNA, 22 nt, Artificial Sequence
  Synthetic
cgaggggaugcaggaggaggau

SEQ ID NO: 57792 - RNA, 23 nt, Artificial Sequence
  Synthetic
gcgaggggaugcaggaggaggau

SEQ ID NO: 57793 - RNA, 24 nt, Artificial Sequence
  Synthetic
ggcgaggggaugcaggaggaggau

SEQ ID NO: 57794 - RNA, 18 nt, Artificial Sequence
  Synthetic
acgacccuaaaccuaccu

SEQ ID NO: 57795 - RNA, 19 nt, Artificial Sequence
  Synthetic
uacgacccuaaaccuaccu

SEQ ID NO: 57796 - RNA, 20 nt, Artificial Sequence
  Synthetic
guacgacccuaaaccuaccu

SEQ ID NO: 57797 - RNA, 21 nt, Artificial Sequence
  Synthetic
uguacgacccuaaaccuaccu

SEQ ID NO: 57798 - RNA, 22 nt, Artificial Sequence
  Synthetic
cuguacgacccuaaaccuaccu

SEQ ID NO: 57799 - RNA, 23 nt, Artificial Sequence
  Synthetic
ccuguacgacccuaaaccuaccu

SEQ ID NO: 57800 - RNA, 24 nt, Artificial Sequence
  Synthetic
accuguacgacccuaaaccuaccu

SEQ ID NO: 57801 - RNA, 18 nt, Artificial Sequence
  Synthetic
ggcgugcugccggaggcu

SEQ ID NO: 57802 - RNA, 19 nt, Artificial Sequence
  Synthetic
cggcgugcugccggaggcu

SEQ ID NO: 57803 - RNA, 20 nt, Artificial Sequence
  Synthetic
ucggcgugcugccggaggcu

SEQ ID NO: 57804 - RNA, 21 nt, Artificial Sequence
  Synthetic
gucggcgugcugccggaggcu

SEQ ID NO: 57805 - RNA, 22 nt, Artificial Sequence
  Synthetic
ggucggcgugcugccggaggcu

SEQ ID NO: 57806 - RNA, 23 nt, Artificial Sequence
  Synthetic
uggucggcgugcugccggaggcu

SEQ ID NO: 57807 - RNA, 24 nt, Artificial Sequence
  Synthetic
guggucggcgugcugccggaggcu

SEQ ID NO: 57808 - RNA, 18 nt, Artificial Sequence
  Synthetic
ugcgagaacgcgcggcgu

SEQ ID NO: 57809 - RNA, 19 nt, Artificial Sequence
  Synthetic
cugcgagaacgcgcggcgu

SEQ ID NO: 57810 - RNA, 20 nt, Artificial Sequence
  Synthetic
ccugcgagaacgcgcggcgu

SEQ ID NO: 57811 - RNA, 21 nt, Artificial Sequence
  Synthetic
accugcgagaacgcgcggcgu

SEQ ID NO: 57812 - RNA, 22 nt, Artificial Sequence
  Synthetic
uaccugcgagaacgcgcggcgu

SEQ ID NO: 57813 - RNA, 23 nt, Artificial Sequence
  Synthetic
cuaccugcgagaacgcgcggcgu

SEQ ID NO: 57814 - RNA, 24 nt, Artificial Sequence
  Synthetic
ccuaccugcgagaacgcgcggcgu

SEQ ID NO: 57815 - RNA, 18 nt, Artificial Sequence
  Synthetic
gcggcggggggggggcgu

SEQ ID NO: 57816 - RNA, 19 nt, Artificial Sequence
  Synthetic
ggcggcggggggggggcgu

SEQ ID NO: 57817 - RNA, 20 nt, Artificial Sequence
  Synthetic
gggcggcggggggggggcgu

SEQ ID NO: 57818 - RNA, 21 nt, Artificial Sequence
  Synthetic
cgggcggcggggggggggcgu

SEQ ID NO: 57819 - RNA, 22 nt, Artificial Sequence
  Synthetic
ucgggcggcggggggggggcgu

SEQ ID NO: 57820 - RNA, 23 nt, Artificial Sequence
  Synthetic
gucgggcggcggggggggggcgu

SEQ ID NO: 57821 - RNA, 24 nt, Artificial Sequence
  Synthetic
cgucgggcggcggggggggggcgu

SEQ ID NO: 57822 - RNA, 21 nt, Artificial Sequence
  Synthetic
gggcgcggcggcggucggggu

SEQ ID NO: 57823 - RNA, 22 nt, Artificial Sequence
  Synthetic
ggggcgcggcggcggucggggu

SEQ ID NO: 57824 - RNA, 23 nt, Artificial Sequence
  Synthetic
uggggcgcggcggcggucggggu

SEQ ID NO: 57825 - RNA, 24 nt, Artificial Sequence
  Synthetic
guggggcgcggcggcggucggggu

SEQ ID NO: 57826 - RNA, 18 nt, Artificial Sequence
  Synthetic
ggugggugggcggguggu

SEQ ID NO: 57827 - RNA, 19 nt, Artificial Sequence
  Synthetic
aggugggugggcggguggu

SEQ ID NO: 57828 - RNA, 20 nt, Artificial Sequence
  Synthetic
uaggugggugggcggguggu

SEQ ID NO: 57829 - RNA, 21 nt, Artificial Sequence
  Synthetic
guaggugggugggcggguggu

SEQ ID NO: 57830 - RNA, 22 nt, Artificial Sequence
  Synthetic
gguaggugggugggcggguggu

SEQ ID NO: 57831 - RNA, 23 nt, Artificial Sequence
  Synthetic
ggguaggugggugggcggguggu

SEQ ID NO: 57832 - RNA, 24 nt, Artificial Sequence
  Synthetic
gggguaggugggugggcggguggu

SEQ ID NO: 57833 - RNA, 18 nt, Artificial Sequence
  Synthetic
ggggggggggggaaaugu

SEQ ID NO: 57834 - RNA, 19 nt, Artificial Sequence
  Synthetic
gggggggggggggaaaugu

SEQ ID NO: 57835 - RNA, 20 nt, Artificial Sequence
  Synthetic
cgggggggggggggaaaugu

SEQ ID NO: 57836 - RNA, 21 nt, Artificial Sequence
  Synthetic
gcgggggggggggggaaaugu

SEQ ID NO: 57837 - RNA, 22 nt, Artificial Sequence
  Synthetic
ggcgggggggggggggaaaugu

SEQ ID NO: 57838 - RNA, 23 nt, Artificial Sequence
  Synthetic
cggcgggggggggggggaaaugu

SEQ ID NO: 57839 - RNA, 24 nt, Artificial Sequence
  Synthetic
gcggcgggggggggggggaaaugu

SEQ ID NO: 57840 - RNA, 18 nt, Artificial Sequence
  Synthetic
ccaccgcgccuuggcugu

SEQ ID NO: 57841 - RNA, 19 nt, Artificial Sequence
  Synthetic
cccaccgcgccuuggcugu

SEQ ID NO: 57842 - RNA, 20 nt, Artificial Sequence
  Synthetic
ccccaccgcgccuuggcugu

SEQ ID NO: 57843 - RNA, 21 nt, Artificial Sequence
  Synthetic
cccccaccgcgccuuggcugu

SEQ ID NO: 57844 - RNA, 22 nt, Artificial Sequence
  Synthetic
ccccccaccgcgccuuggcugu

SEQ ID NO: 57845 - RNA, 23 nt, Artificial Sequence
  Synthetic
gccccccaccgcgccuuggcugu

SEQ ID NO: 57846 - RNA, 24 nt, Artificial Sequence
  Synthetic
cgccccccaccgcgccuuggcugu

SEQ ID NO: 57847 - RNA, 18 nt, Artificial Sequence
  Synthetic
caccgcgccuuggcuguu

SEQ ID NO: 57848 - RNA, 19 nt, Artificial Sequence
  Synthetic
ccaccgcgccuuggcuguu

SEQ ID NO: 57849 - RNA, 20 nt, Artificial Sequence
  Synthetic
cccaccgcgccuuggcuguu

SEQ ID NO: 57850 - RNA, 21 nt, Artificial Sequence
  Synthetic
ccccaccgcgccuuggcuguu

SEQ ID NO: 57851 - RNA, 22 nt, Artificial Sequence
  Synthetic
cccccaccgcgccuuggcuguu

SEQ ID NO: 57852 - RNA, 23 nt, Artificial Sequence
  Synthetic
ccccccaccgcgccuuggcuguu

SEQ ID NO: 57853 - RNA, 24 nt, Artificial Sequence
  Synthetic
gccccccaccgcgccuuggcuguu

SEQ ID NO: 57854 - RNA, 18 nt, Artificial Sequence
  Synthetic
cugaccugccugcccuuu

SEQ ID NO: 57855 - RNA, 19 nt, Artificial Sequence
  Synthetic
gcugaccugccugcccuuu

SEQ ID NO: 57856 - RNA, 20 nt, Artificial Sequence
  Synthetic
ggcugaccugccugcccuuu

SEQ ID NO: 57857 - RNA, 21 nt, Artificial Sequence
  Synthetic
cggcugaccugccugcccuuu

SEQ ID NO: 57858 - RNA, 22 nt, Artificial Sequence
  Synthetic
gcggcugaccugccugcccuuu

SEQ ID NO: 57859 - RNA, 23 nt, Artificial Sequence
  Synthetic
ugcggcugaccugccugcccuuu

SEQ ID NO: 57860 - RNA, 24 nt, Artificial Sequence
  Synthetic
gugcggcugaccugccugcccuuu

SEQ ID NO: 57861 - RNA, 18 nt, Artificial Sequence
  Synthetic
accgcgccuuggcuguuu

SEQ ID NO: 57862 - RNA, 19 nt, Artificial Sequence
  Synthetic
caccgcgccuuggcuguuu

SEQ ID NO: 57863 - RNA, 20 nt, Artificial Sequence
  Synthetic
ccaccgcgccuuggcuguuu

SEQ ID NO: 57864 - RNA, 21 nt, Artificial Sequence
  Synthetic
cccaccgcgccuuggcuguuu

SEQ ID NO: 57865 - RNA, 22 nt, Artificial Sequence
  Synthetic
ccccaccgcgccuuggcuguuu

SEQ ID NO: 57866 - RNA, 23 nt, Artificial Sequence
  Synthetic
cccccaccgcgccuuggcuguuu

SEQ ID NO: 57867 - RNA, 24 nt, Artificial Sequence
  Synthetic
ccccccaccgcgccuuggcuguuu

SEQ ID NO: 57868 - RNA, 18 nt, Artificial Sequence
  Synthetic
cgguggaaagcggaaaaa

SEQ ID NO: 57869 - RNA, 19 nt, Artificial Sequence
  Synthetic
gcgguggaaagcggaaaaa

SEQ ID NO: 57870 - RNA, 20 nt, Artificial Sequence
  Synthetic
ggcgguggaaagcggaaaaa

SEQ ID NO: 57871 - RNA, 21 nt, Artificial Sequence
  Synthetic
cggcgguggaaagcggaaaaa

SEQ ID NO: 57872 - RNA, 22 nt, Artificial Sequence
  Synthetic
gcggcgguggaaagcggaaaaa

SEQ ID NO: 57873 - RNA, 23 nt, Artificial Sequence
  Synthetic
ggcggcgguggaaagcggaaaaa

SEQ ID NO: 57874 - RNA, 24 nt, Artificial Sequence
  Synthetic
cggcggcgguggaaagcggaaaaa

SEQ ID NO: 57875 - RNA, 18 nt, Artificial Sequence
  Synthetic
gcgguggaaagcggaaaa

SEQ ID NO: 57876 - RNA, 19 nt, Artificial Sequence
  Synthetic
ggcgguggaaagcggaaaa

SEQ ID NO: 57877 - RNA, 20 nt, Artificial Sequence
  Synthetic
cggcgguggaaagcggaaaa

SEQ ID NO: 57878 - RNA, 21 nt, Artificial Sequence
  Synthetic
gcggcgguggaaagcggaaaa

SEQ ID NO: 57879 - RNA, 22 nt, Artificial Sequence
  Synthetic
ggcggcgguggaaagcggaaaa

SEQ ID NO: 57880 - RNA, 23 nt, Artificial Sequence
  Synthetic
cggcggcgguggaaagcggaaaa

SEQ ID NO: 57881 - RNA, 24 nt, Artificial Sequence
  Synthetic
gcggcggcgguggaaagcggaaaa

SEQ ID NO: 57882 - RNA, 18 nt, Artificial Sequence
  Synthetic
uggcggcggcgguggaaa

SEQ ID NO: 57883 - RNA, 19 nt, Artificial Sequence
  Synthetic
guggcggcggcgguggaaa

SEQ ID NO: 57884 - RNA, 20 nt, Artificial Sequence
  Synthetic
gguggcggcggcgguggaaa

SEQ ID NO: 57885 - RNA, 21 nt, Artificial Sequence
  Synthetic
ugguggcggcggcgguggaaa

SEQ ID NO: 57886 - RNA, 22 nt, Artificial Sequence
  Synthetic
gugguggcggcggcgguggaaa

SEQ ID NO: 57887 - RNA, 23 nt, Artificial Sequence
  Synthetic
ggugguggcggcggcgguggaaa

SEQ ID NO: 57888 - RNA, 24 nt, Artificial Sequence
  Synthetic
gggugguggcggcggcgguggaaa

SEQ ID NO: 57889 - RNA, 18 nt, Artificial Sequence
  Synthetic
ggcgggcggaagagagaa

SEQ ID NO: 57890 - RNA, 19 nt, Artificial Sequence
  Synthetic
gggcgggcggaagagagaa

SEQ ID NO: 57891 - RNA, 20 nt, Artificial Sequence
  Synthetic
ggggcgggcggaagagagaa

SEQ ID NO: 57892 - RNA, 21 nt, Artificial Sequence
  Synthetic
gggggcgggcggaagagagaa

SEQ ID NO: 57893 - RNA, 22 nt, Artificial Sequence
  Synthetic
ggggggcgggcggaagagagaa

SEQ ID NO: 57894 - RNA, 23 nt, Artificial Sequence
  Synthetic
gggggggcgggcggaagagagaa

SEQ ID NO: 57895 - RNA, 24 nt, Artificial Sequence
  Synthetic
ggggggggcgggcggaagagagaa

SEQ ID NO: 57896 - RNA, 18 nt, Artificial Sequence
  Synthetic
ggcgggcgggcgaaggaa

SEQ ID NO: 57897 - RNA, 19 nt, Artificial Sequence
  Synthetic
aggcgggcgggcgaaggaa

SEQ ID NO: 57898 - RNA, 20 nt, Artificial Sequence
  Synthetic
gaggcgggcgggcgaaggaa

SEQ ID NO: 57899 - RNA, 21 nt, Artificial Sequence
  Synthetic
cgaggcgggcgggcgaaggaa

SEQ ID NO: 57900 - RNA, 22 nt, Artificial Sequence
  Synthetic
gcgaggcgggcgggcgaaggaa

SEQ ID NO: 57901 - RNA, 23 nt, Artificial Sequence
  Synthetic
ggcgaggcgggcgggcgaaggaa

SEQ ID NO: 57902 - RNA, 24 nt, Artificial Sequence
  Synthetic
gggcgaggcgggcgggcgaaggaa

SEQ ID NO: 57903 - RNA, 18 nt, Artificial Sequence
  Synthetic
gggggggggcgggcggaa

SEQ ID NO: 57904 - RNA, 19 nt, Artificial Sequence
  Synthetic
ggggggggggcgggcggaa

SEQ ID NO: 57905 - RNA, 20 nt, Artificial Sequence
  Synthetic
gggggggggggcgggcggaa

SEQ ID NO: 57906 - RNA, 21 nt, Artificial Sequence
  Synthetic
agggggggggggcgggcggaa

SEQ ID NO: 57907 - RNA, 22 nt, Artificial Sequence
  Synthetic
gagggggggggggcgggcggaa

SEQ ID NO: 57908 - RNA, 23 nt, Artificial Sequence
  Synthetic
agagggggggggggcgggcggaa

SEQ ID NO: 57909 - RNA, 24 nt, Artificial Sequence
  Synthetic
gagagggggggggggcgggcggaa

SEQ ID NO: 57910 - RNA, 18 nt, Artificial Sequence
  Synthetic
ugaacgauggggggaaca

SEQ ID NO: 57911 - RNA, 19 nt, Artificial Sequence
  Synthetic
gugaacgauggggggaaca

SEQ ID NO: 57912 - RNA, 20 nt, Artificial Sequence
  Synthetic
ggugaacgauggggggaaca

SEQ ID NO: 57913 - RNA, 21 nt, Artificial Sequence
  Synthetic
uggugaacgauggggggaaca

SEQ ID NO: 57914 - RNA, 22 nt, Artificial Sequence
  Synthetic
guggugaacgauggggggaaca

SEQ ID NO: 57915 - RNA, 23 nt, Artificial Sequence
  Synthetic
gguggugaacgauggggggaaca

SEQ ID NO: 57916 - RNA, 24 nt, Artificial Sequence
  Synthetic
ugguggugaacgauggggggaaca

SEQ ID NO: 57917 - RNA, 18 nt, Artificial Sequence
  Synthetic
cccucugcccgcguccca

SEQ ID NO: 57918 - RNA, 19 nt, Artificial Sequence
  Synthetic
gcccucugcccgcguccca

SEQ ID NO: 57919 - RNA, 20 nt, Artificial Sequence
  Synthetic
cgcccucugcccgcguccca

SEQ ID NO: 57920 - RNA, 21 nt, Artificial Sequence
  Synthetic
ccgcccucugcccgcguccca

SEQ ID NO: 57921 - RNA, 22 nt, Artificial Sequence
  Synthetic
gccgcccucugcccgcguccca

SEQ ID NO: 57922 - RNA, 23 nt, Artificial Sequence
  Synthetic
cgccgcccucugcccgcguccca

SEQ ID NO: 57923 - RNA, 24 nt, Artificial Sequence
  Synthetic
ccgccgcccucugcccgcguccca

SEQ ID NO: 57924 - RNA, 18 nt, Artificial Sequence
  Synthetic
ggauggaagggcagaaga

SEQ ID NO: 57925 - RNA, 19 nt, Artificial Sequence
  Synthetic
aggauggaagggcagaaga

SEQ ID NO: 57926 - RNA, 20 nt, Artificial Sequence
  Synthetic
gaggauggaagggcagaaga

SEQ ID NO: 57927 - RNA, 21 nt, Artificial Sequence
  Synthetic
ggaggauggaagggcagaaga

SEQ ID NO: 57928 - RNA, 22 nt, Artificial Sequence
  Synthetic
cggaggauggaagggcagaaga

SEQ ID NO: 57929 - RNA, 23 nt, Artificial Sequence
  Synthetic
acggaggauggaagggcagaaga

SEQ ID NO: 57930 - RNA, 24 nt, Artificial Sequence
  Synthetic
aacggaggauggaagggcagaaga

SEQ ID NO: 57931 - RNA, 18 nt, Artificial Sequence
  Synthetic
gggggggcgggcggaaga

SEQ ID NO: 57932 - RNA, 19 nt, Artificial Sequence
  Synthetic
ggggggggcgggcggaaga

SEQ ID NO: 57933 - RNA, 20 nt, Artificial Sequence
  Synthetic
gggggggggcgggcggaaga

SEQ ID NO: 57934 - RNA, 21 nt, Artificial Sequence
  Synthetic
ggggggggggcgggcggaaga

SEQ ID NO: 57935 - RNA, 22 nt, Artificial Sequence
  Synthetic
gggggggggggcgggcggaaga

SEQ ID NO: 57936 - RNA, 23 nt, Artificial Sequence
  Synthetic
agggggggggggcgggcggaaga

SEQ ID NO: 57937 - RNA, 24 nt, Artificial Sequence
  Synthetic
gagggggggggggcgggcggaaga

SEQ ID NO: 57938 - RNA, 18 nt, Artificial Sequence
  Synthetic
cgaggcgggggucccaga

SEQ ID NO: 57939 - RNA, 19 nt, Artificial Sequence
  Synthetic
acgaggcgggggucccaga

SEQ ID NO: 57940 - RNA, 20 nt, Artificial Sequence
  Synthetic
cacgaggcgggggucccaga

SEQ ID NO: 57941 - RNA, 21 nt, Artificial Sequence
  Synthetic
acacgaggcgggggucccaga

SEQ ID NO: 57942 - RNA, 22 nt, Artificial Sequence
  Synthetic
aacacgaggcgggggucccaga

SEQ ID NO: 57943 - RNA, 23 nt, Artificial Sequence
  Synthetic
aaacacgaggcgggggucccaga

SEQ ID NO: 57944 - RNA, 24 nt, Artificial Sequence
  Synthetic
gaaacacgaggcgggggucccaga

SEQ ID NO: 57945 - RNA, 18 nt, Artificial Sequence
  Synthetic
ugcugaggcggcgggaga

SEQ ID NO: 57946 - RNA, 19 nt, Artificial Sequence
  Synthetic
cugcugaggcggcgggaga

SEQ ID NO: 57947 - RNA, 20 nt, Artificial Sequence
  Synthetic
ucugcugaggcggcgggaga

SEQ ID NO: 57948 - RNA, 21 nt, Artificial Sequence
  Synthetic
uucugcugaggcggcgggaga

SEQ ID NO: 57949 - RNA, 22 nt, Artificial Sequence
  Synthetic
cuucugcugaggcggcgggaga

SEQ ID NO: 57950 - RNA, 23 nt, Artificial Sequence
  Synthetic
gcuucugcugaggcggcgggaga

SEQ ID NO: 57951 - RNA, 24 nt, Artificial Sequence
  Synthetic
agcuucugcugaggcggcgggaga

SEQ ID NO: 57952 - RNA, 18 nt, Artificial Sequence
  Synthetic
gggcgugguggugaacga

SEQ ID NO: 57953 - RNA, 19 nt, Artificial Sequence
  Synthetic
ggggcgugguggugaacga

SEQ ID NO: 57954 - RNA, 20 nt, Artificial Sequence
  Synthetic
gggggcgugguggugaacga

SEQ ID NO: 57955 - RNA, 21 nt, Artificial Sequence
  Synthetic
ggggggcgugguggugaacga

SEQ ID NO: 57956 - RNA, 22 nt, Artificial Sequence
  Synthetic
uggggggcgugguggugaacga

SEQ ID NO: 57957 - RNA, 23 nt, Artificial Sequence
  Synthetic
guggggggcgugguggugaacga

SEQ ID NO: 57958 - RNA, 24 nt, Artificial Sequence
  Synthetic
gguggggggcgugguggugaacga

SEQ ID NO: 57959 - RNA, 18 nt, Artificial Sequence
  Synthetic
ccccccgccgcccgacga

SEQ ID NO: 57960 - RNA, 19 nt, Artificial Sequence
  Synthetic
cccccccgccgcccgacga

SEQ ID NO: 57961 - RNA, 20 nt, Artificial Sequence
  Synthetic
ccccccccgccgcccgacga

SEQ ID NO: 57962 - RNA, 21 nt, Artificial Sequence
  Synthetic
cccccccccgccgcccgacga

SEQ ID NO: 57963 - RNA, 22 nt, Artificial Sequence
  Synthetic
ccccccccccgccgcccgacga

SEQ ID NO: 57964 - RNA, 23 nt, Artificial Sequence
  Synthetic
gccccccccccgccgcccgacga

SEQ ID NO: 57965 - RNA, 24 nt, Artificial Sequence
  Synthetic
cgccccccccccgccgcccgacga

SEQ ID NO: 57966 - RNA, 18 nt, Artificial Sequence
  Synthetic
cgcagccggagaggccga

SEQ ID NO: 57967 - RNA, 19 nt, Artificial Sequence
  Synthetic
ccgcagccggagaggccga

SEQ ID NO: 57968 - RNA, 20 nt, Artificial Sequence
  Synthetic
accgcagccggagaggccga

SEQ ID NO: 57969 - RNA, 21 nt, Artificial Sequence
  Synthetic
caccgcagccggagaggccga

SEQ ID NO: 57970 - RNA, 22 nt, Artificial Sequence
  Synthetic
gcaccgcagccggagaggccga

SEQ ID NO: 57971 - RNA, 23 nt, Artificial Sequence
  Synthetic
agcaccgcagccggagaggccga

SEQ ID NO: 57972 - RNA, 24 nt, Artificial Sequence
  Synthetic
aagcaccgcagccggagaggccga

SEQ ID NO: 57973 - RNA, 18 nt, Artificial Sequence
  Synthetic
ggcgaggcgggcgggcga

SEQ ID NO: 57974 - RNA, 19 nt, Artificial Sequence
  Synthetic
gggcgaggcgggcgggcga

SEQ ID NO: 57975 - RNA, 20 nt, Artificial Sequence
  Synthetic
ggggcgaggcgggcgggcga

SEQ ID NO: 57976 - RNA, 21 nt, Artificial Sequence
  Synthetic
cggggcgaggcgggcgggcga

SEQ ID NO: 57977 - RNA, 22 nt, Artificial Sequence
  Synthetic
ccggggcgaggcgggcgggcga

SEQ ID NO: 57978 - RNA, 23 nt, Artificial Sequence
  Synthetic
uccggggcgaggcgggcgggcga

SEQ ID NO: 57979 - RNA, 24 nt, Artificial Sequence
  Synthetic
guccggggcgaggcgggcgggcga

SEQ ID NO: 57980 - RNA, 18 nt, Artificial Sequence
  Synthetic
aggcgggcgggcgaagga

SEQ ID NO: 57981 - RNA, 19 nt, Artificial Sequence
  Synthetic
gaggcgggcgggcgaagga

SEQ ID NO: 57982 - RNA, 20 nt, Artificial Sequence
  Synthetic
cgaggcgggcgggcgaagga

SEQ ID NO: 57983 - RNA, 21 nt, Artificial Sequence
  Synthetic
gcgaggcgggcgggcgaagga

SEQ ID NO: 57984 - RNA, 22 nt, Artificial Sequence
  Synthetic
ggcgaggcgggcgggcgaagga

SEQ ID NO: 57985 - RNA, 23 nt, Artificial Sequence
  Synthetic
gggcgaggcgggcgggcgaagga

SEQ ID NO: 57986 - RNA, 24 nt, Artificial Sequence
  Synthetic
ggggcgaggcgggcgggcgaagga

SEQ ID NO: 57987 - RNA, 18 nt, Artificial Sequence
  Synthetic
aagcggaaaaacggagga

SEQ ID NO: 57988 - RNA, 19 nt, Artificial Sequence
  Synthetic
aaagcggaaaaacggagga

SEQ ID NO: 57989 - RNA, 20 nt, Artificial Sequence
  Synthetic
gaaagcggaaaaacggagga

SEQ ID NO: 57990 - RNA, 21 nt, Artificial Sequence
  Synthetic
ggaaagcggaaaaacggagga

SEQ ID NO: 57991 - RNA, 22 nt, Artificial Sequence
  Synthetic
uggaaagcggaaaaacggagga

SEQ ID NO: 57992 - RNA, 23 nt, Artificial Sequence
  Synthetic
guggaaagcggaaaaacggagga

SEQ ID NO: 57993 - RNA, 24 nt, Artificial Sequence
  Synthetic
gguggaaagcggaaaaacggagga

SEQ ID NO: 57994 - RNA, 18 nt, Artificial Sequence
  Synthetic
ucugcugaggcggcggga

SEQ ID NO: 57995 - RNA, 19 nt, Artificial Sequence
  Synthetic
uucugcugaggcggcggga

SEQ ID NO: 57996 - RNA, 20 nt, Artificial Sequence
  Synthetic
cuucugcugaggcggcggga

SEQ ID NO: 57997 - RNA, 21 nt, Artificial Sequence
  Synthetic
gcuucugcugaggcggcggga

SEQ ID NO: 57998 - RNA, 22 nt, Artificial Sequence
  Synthetic
agcuucugcugaggcggcggga

SEQ ID NO: 57999 - RNA, 23 nt, Artificial Sequence
  Synthetic
gagcuucugcugaggcggcggga

SEQ ID NO: 58000 - RNA, 24 nt, Artificial Sequence
  Synthetic
ugagcuucugcugaggcggcggga

SEQ ID NO: 58001 - RNA, 18 nt, Artificial Sequence
  Synthetic
ggagaggccgagcgggga

SEQ ID NO: 58002 - RNA, 19 nt, Artificial Sequence
  Synthetic
cggagaggccgagcgggga

SEQ ID NO: 58003 - RNA, 20 nt, Artificial Sequence
  Synthetic
ccggagaggccgagcgggga

SEQ ID NO: 58004 - RNA, 21 nt, Artificial Sequence
  Synthetic
gccggagaggccgagcgggga

SEQ ID NO: 58005 - RNA, 22 nt, Artificial Sequence
  Synthetic
agccggagaggccgagcgggga

SEQ ID NO: 58006 - RNA, 23 nt, Artificial Sequence
  Synthetic
cagccggagaggccgagcgggga

SEQ ID NO: 58007 - RNA, 24 nt, Artificial Sequence
  Synthetic
gcagccggagaggccgagcgggga

SEQ ID NO: 58008 - RNA, 18 nt, Artificial Sequence
  Synthetic
ugcgugugucucguguga

SEQ ID NO: 58009 - RNA, 19 nt, Artificial Sequence
  Synthetic
cugcgugugucucguguga

SEQ ID NO: 58010 - RNA, 20 nt, Artificial Sequence
  Synthetic
ccugcgugugucucguguga

SEQ ID NO: 58011 - RNA, 21 nt, Artificial Sequence
  Synthetic
gccugcgugugucucguguga

SEQ ID NO: 58012 - RNA, 22 nt, Artificial Sequence
  Synthetic
cgccugcgugugucucguguga

SEQ ID NO: 58013 - RNA, 23 nt, Artificial Sequence
  Synthetic
gcgccugcgugugucucguguga

SEQ ID NO: 58014 - RNA, 24 nt, Artificial Sequence
  Synthetic
ggcgccugcgugugucucguguga

SEQ ID NO: 58015 - RNA, 18 nt, Artificial Sequence
  Synthetic
cucccccuuucaagaaac

SEQ ID NO: 58016 - RNA, 19 nt, Artificial Sequence
  Synthetic
ccucccccuuucaagaaac

SEQ ID NO: 58017 - RNA, 20 nt, Artificial Sequence
  Synthetic
uccucccccuuucaagaaac

SEQ ID NO: 58018 - RNA, 21 nt, Artificial Sequence
  Synthetic
uuccucccccuuucaagaaac

SEQ ID NO: 58019 - RNA, 22 nt, Artificial Sequence
  Synthetic
cuuccucccccuuucaagaaac

SEQ ID NO: 58020 - RNA, 23 nt, Artificial Sequence
  Synthetic
ucuuccucccccuuucaagaaac

SEQ ID NO: 58021 - RNA, 24 nt, Artificial Sequence
  Synthetic
uucuuccucccccuuucaagaaac

SEQ ID NO: 58022 - RNA, 18 nt, Artificial Sequence
  Synthetic
gugaacgauggggggaac

SEQ ID NO: 58023 - RNA, 19 nt, Artificial Sequence
  Synthetic
ggugaacgauggggggaac

SEQ ID NO: 58024 - RNA, 20 nt, Artificial Sequence
  Synthetic
uggugaacgauggggggaac

SEQ ID NO: 58025 - RNA, 21 nt, Artificial Sequence
  Synthetic
guggugaacgauggggggaac

SEQ ID NO: 58026 - RNA, 22 nt, Artificial Sequence
  Synthetic
gguggugaacgauggggggaac

SEQ ID NO: 58027 - RNA, 23 nt, Artificial Sequence
  Synthetic
ugguggugaacgauggggggaac

SEQ ID NO: 58028 - RNA, 24 nt, Artificial Sequence
  Synthetic
gugguggugaacgauggggggaac

SEQ ID NO: 58029 - RNA, 18 nt, Artificial Sequence
  Synthetic
gaacgauggggggaacac

SEQ ID NO: 58030 - RNA, 19 nt, Artificial Sequence
  Synthetic
ugaacgauggggggaacac

SEQ ID NO: 58031 - RNA, 20 nt, Artificial Sequence
  Synthetic
gugaacgauggggggaacac

SEQ ID NO: 58032 - RNA, 21 nt, Artificial Sequence
  Synthetic
ggugaacgauggggggaacac

SEQ ID NO: 58033 - RNA, 22 nt, Artificial Sequence
  Synthetic
uggugaacgauggggggaacac

SEQ ID NO: 58034 - RNA, 23 nt, Artificial Sequence
  Synthetic
guggugaacgauggggggaacac

SEQ ID NO: 58035 - RNA, 24 nt, Artificial Sequence
  Synthetic
gguggugaacgauggggggaacac

SEQ ID NO: 58036 - RNA, 18 nt, Artificial Sequence
  Synthetic
ggagugguggugggggac

SEQ ID NO: 58037 - RNA, 19 nt, Artificial Sequence
  Synthetic
gggagugguggugggggac

SEQ ID NO: 58038 - RNA, 20 nt, Artificial Sequence
  Synthetic
ugggagugguggugggggac

SEQ ID NO: 58039 - RNA, 21 nt, Artificial Sequence
  Synthetic
gugggagugguggugggggac

SEQ ID NO: 58040 - RNA, 22 nt, Artificial Sequence
  Synthetic
ggugggagugguggugggggac

SEQ ID NO: 58041 - RNA, 23 nt, Artificial Sequence
  Synthetic
gggugggagugguggugggggac

SEQ ID NO: 58042 - RNA, 24 nt, Artificial Sequence
  Synthetic
ggggugggagugguggugggggac

SEQ ID NO: 58043 - RNA, 18 nt, Artificial Sequence
  Synthetic
ugugagagagcgcgcccc

SEQ ID NO: 58044 - RNA, 19 nt, Artificial Sequence
  Synthetic
gugugagagagcgcgcccc

SEQ ID NO: 58045 - RNA, 20 nt, Artificial Sequence
  Synthetic
cgugugagagagcgcgcccc

SEQ ID NO: 58046 - RNA, 21 nt, Artificial Sequence
  Synthetic
ucgugugagagagcgcgcccc

SEQ ID NO: 58047 - RNA, 22 nt, Artificial Sequence
  Synthetic
cucgugugagagagcgcgcccc

SEQ ID NO: 58048 - RNA, 23 nt, Artificial Sequence
  Synthetic
ucucgugugagagagcgcgcccc

SEQ ID NO: 58049 - RNA, 24 nt, Artificial Sequence
  Synthetic
gucucgugugagagagcgcgcccc

SEQ ID NO: 58050 - RNA, 18 nt, Artificial Sequence
  Synthetic
aggucagccgcaccgccc

SEQ ID NO: 58051 - RNA, 19 nt, Artificial Sequence
  Synthetic
caggucagccgcaccgccc

SEQ ID NO: 58052 - RNA, 20 nt, Artificial Sequence
  Synthetic
gcaggucagccgcaccgccc

SEQ ID NO: 58053 - RNA, 21 nt, Artificial Sequence
  Synthetic
ggcaggucagccgcaccgccc

SEQ ID NO: 58054 - RNA, 22 nt, Artificial Sequence
  Synthetic
aggcaggucagccgcaccgccc

SEQ ID NO: 58055 - RNA, 23 nt, Artificial Sequence
  Synthetic
caggcaggucagccgcaccgccc

SEQ ID NO: 58056 - RNA, 24 nt, Artificial Sequence
  Synthetic
gcaggcaggucagccgcaccgccc

SEQ ID NO: 58057 - RNA, 18 nt, Artificial Sequence
  Synthetic
ccgcgugagccguccgcc

SEQ ID NO: 58058 - RNA, 19 nt, Artificial Sequence
  Synthetic
gccgcgugagccguccgcc

SEQ ID NO: 58059 - RNA, 20 nt, Artificial Sequence
  Synthetic
cgccgcgugagccguccgcc

SEQ ID NO: 58060 - RNA, 21 nt, Artificial Sequence
  Synthetic
gcgccgcgugagccguccgcc

SEQ ID NO: 58061 - RNA, 22 nt, Artificial Sequence
  Synthetic
cgcgccgcgugagccguccgcc

SEQ ID NO: 58062 - RNA, 23 nt, Artificial Sequence
  Synthetic
ccgcgccgcgugagccguccgcc

SEQ ID NO: 58063 - RNA, 24 nt, Artificial Sequence
  Synthetic
gccgcgccgcgugagccguccgcc

SEQ ID NO: 58064 - RNA, 18 nt, Artificial Sequence
  Synthetic
ccgggggacccaggcucc

SEQ ID NO: 58065 - RNA, 19 nt, Artificial Sequence
  Synthetic
gccgggggacccaggcucc

SEQ ID NO: 58066 - RNA, 20 nt, Artificial Sequence
  Synthetic
cgccgggggacccaggcucc

SEQ ID NO: 58067 - RNA, 21 nt, Artificial Sequence
  Synthetic
ccgccgggggacccaggcucc

SEQ ID NO: 58068 - RNA, 22 nt, Artificial Sequence
  Synthetic
uccgccgggggacccaggcucc

SEQ ID NO: 58069 - RNA, 23 nt, Artificial Sequence
  Synthetic
guccgccgggggacccaggcucc

SEQ ID NO: 58070 - RNA, 24 nt, Artificial Sequence
  Synthetic
cguccgccgggggacccaggcucc

SEQ ID NO: 58071 - RNA, 18 nt, Artificial Sequence
  Synthetic
aacacgaggcgggggucc

SEQ ID NO: 58072 - RNA, 19 nt, Artificial Sequence
  Synthetic
aaacacgaggcgggggucc

SEQ ID NO: 58073 - RNA, 20 nt, Artificial Sequence
  Synthetic
gaaacacgaggcgggggucc

SEQ ID NO: 58074 - RNA, 21 nt, Artificial Sequence
  Synthetic
agaaacacgaggcgggggucc

SEQ ID NO: 58075 - RNA, 22 nt, Artificial Sequence
  Synthetic
aagaaacacgaggcgggggucc

SEQ ID NO: 58076 - RNA, 23 nt, Artificial Sequence
  Synthetic
caagaaacacgaggcgggggucc

SEQ ID NO: 58077 - RNA, 24 nt, Artificial Sequence
  Synthetic
ucaagaaacacgaggcgggggucc

SEQ ID NO: 58078 - RNA, 18 nt, Artificial Sequence
  Synthetic
agacccaagcaccgcagc

SEQ ID NO: 58079 - RNA, 19 nt, Artificial Sequence
  Synthetic
gagacccaagcaccgcagc

SEQ ID NO: 58080 - RNA, 20 nt, Artificial Sequence
  Synthetic
ggagacccaagcaccgcagc

SEQ ID NO: 58081 - RNA, 21 nt, Artificial Sequence
  Synthetic
aggagacccaagcaccgcagc

SEQ ID NO: 58082 - RNA, 22 nt, Artificial Sequence
  Synthetic
aaggagacccaagcaccgcagc

SEQ ID NO: 58083 - RNA, 23 nt, Artificial Sequence
  Synthetic
gaaggagacccaagcaccgcagc

SEQ ID NO: 58084 - RNA, 24 nt, Artificial Sequence
  Synthetic
cgaaggagacccaagcaccgcagc

SEQ ID NO: 58085 - RNA, 18 nt, Artificial Sequence
  Synthetic
cagccggagaggccgagc

SEQ ID NO: 58086 - RNA, 19 nt, Artificial Sequence
  Synthetic
gcagccggagaggccgagc

SEQ ID NO: 58087 - RNA, 20 nt, Artificial Sequence
  Synthetic
cgcagccggagaggccgagc

SEQ ID NO: 58088 - RNA, 21 nt, Artificial Sequence
  Synthetic
ccgcagccggagaggccgagc

SEQ ID NO: 58089 - RNA, 22 nt, Artificial Sequence
  Synthetic
accgcagccggagaggccgagc

SEQ ID NO: 58090 - RNA, 23 nt, Artificial Sequence
  Synthetic
caccgcagccggagaggccgagc

SEQ ID NO: 58091 - RNA, 24 nt, Artificial Sequence
  Synthetic
gcaccgcagccggagaggccgagc

SEQ ID NO: 58092 - RNA, 18 nt, Artificial Sequence
  Synthetic
accgagacgccgcgccgc

SEQ ID NO: 58093 - RNA, 19 nt, Artificial Sequence
  Synthetic
caccgagacgccgcgccgc

SEQ ID NO: 58094 - RNA, 20 nt, Artificial Sequence
  Synthetic
ccaccgagacgccgcgccgc

SEQ ID NO: 58095 - RNA, 21 nt, Artificial Sequence
  Synthetic
cccaccgagacgccgcgccgc

SEQ ID NO: 58096 - RNA, 22 nt, Artificial Sequence
  Synthetic
ucccaccgagacgccgcgccgc

SEQ ID NO: 58097 - RNA, 23 nt, Artificial Sequence
  Synthetic
gucccaccgagacgccgcgccgc

SEQ ID NO: 58098 - RNA, 24 nt, Artificial Sequence
  Synthetic
cgucccaccgagacgccgcgccgc

SEQ ID NO: 58099 - RNA, 18 nt, Artificial Sequence
  Synthetic
gccgcgugagccguccgc

SEQ ID NO: 58100 - RNA, 19 nt, Artificial Sequence
  Synthetic
cgccgcgugagccguccgc

SEQ ID NO: 58101 - RNA, 20 nt, Artificial Sequence
  Synthetic
gcgccgcgugagccguccgc

SEQ ID NO: 58102 - RNA, 21 nt, Artificial Sequence
  Synthetic
cgcgccgcgugagccguccgc

SEQ ID NO: 58103 - RNA, 22 nt, Artificial Sequence
  Synthetic
ccgcgccgcgugagccguccgc

SEQ ID NO: 58104 - RNA, 23 nt, Artificial Sequence
  Synthetic
gccgcgccgcgugagccguccgc

SEQ ID NO: 58105 - RNA, 24 nt, Artificial Sequence
  Synthetic
cgccgcgccgcgugagccguccgc

SEQ ID NO: 58106 - RNA, 18 nt, Artificial Sequence
  Synthetic
agcuucugcugaggcggc

SEQ ID NO: 58107 - RNA, 19 nt, Artificial Sequence
  Synthetic
gagcuucugcugaggcggc

SEQ ID NO: 58108 - RNA, 20 nt, Artificial Sequence
  Synthetic
ugagcuucugcugaggcggc

SEQ ID NO: 58109 - RNA, 21 nt, Artificial Sequence
  Synthetic
gugagcuucugcugaggcggc

SEQ ID NO: 58110 - RNA, 22 nt, Artificial Sequence
  Synthetic
ggugagcuucugcugaggcggc

SEQ ID NO: 58111 - RNA, 23 nt, Artificial Sequence
  Synthetic
aggugagcuucugcugaggcggc

SEQ ID NO: 58112 - RNA, 24 nt, Artificial Sequence
  Synthetic
caggugagcuucugcugaggcggc

SEQ ID NO: 58113 - RNA, 18 nt, Artificial Sequence
  Synthetic
gccgggggacccaggcuc

SEQ ID NO: 58114 - RNA, 19 nt, Artificial Sequence
  Synthetic
cgccgggggacccaggcuc

SEQ ID NO: 58115 - RNA, 20 nt, Artificial Sequence
  Synthetic
ccgccgggggacccaggcuc

SEQ ID NO: 58116 - RNA, 21 nt, Artificial Sequence
  Synthetic
uccgccgggggacccaggcuc

SEQ ID NO: 58117 - RNA, 22 nt, Artificial Sequence
  Synthetic
guccgccgggggacccaggcuc

SEQ ID NO: 58118 - RNA, 23 nt, Artificial Sequence
  Synthetic
cguccgccgggggacccaggcuc

SEQ ID NO: 58119 - RNA, 24 nt, Artificial Sequence
  Synthetic
ccguccgccgggggacccaggcuc

SEQ ID NO: 58120 - RNA, 18 nt, Artificial Sequence
  Synthetic
acacgggggggagggguc

SEQ ID NO: 58121 - RNA, 19 nt, Artificial Sequence
  Synthetic
aacacgggggggagggguc

SEQ ID NO: 58122 - RNA, 20 nt, Artificial Sequence
  Synthetic
gaacacgggggggagggguc

SEQ ID NO: 58123 - RNA, 21 nt, Artificial Sequence
  Synthetic
ggaacacgggggggagggguc

SEQ ID NO: 58124 - RNA, 22 nt, Artificial Sequence
  Synthetic
gggaacacgggggggagggguc

SEQ ID NO: 58125 - RNA, 23 nt, Artificial Sequence
  Synthetic
ggggaacacgggggggagggguc

SEQ ID NO: 58126 - RNA, 24 nt, Artificial Sequence
  Synthetic
gggggaacacgggggggagggguc

SEQ ID NO: 58127 - RNA, 18 nt, Artificial Sequence
  Synthetic
guucuuccucccccuuuc

SEQ ID NO: 58128 - RNA, 19 nt, Artificial Sequence
  Synthetic
uguucuuccucccccuuuc

SEQ ID NO: 58129 - RNA, 20 nt, Artificial Sequence
  Synthetic
cuguucuuccucccccuuuc

SEQ ID NO: 58130 - RNA, 21 nt, Artificial Sequence
  Synthetic
acuguucuuccucccccuuuc

SEQ ID NO: 58131 - RNA, 22 nt, Artificial Sequence
  Synthetic
aacuguucuuccucccccuuuc

SEQ ID NO: 58132 - RNA, 23 nt, Artificial Sequence
  Synthetic
gaacuguucuuccucccccuuuc

SEQ ID NO: 58133 - RNA, 24 nt, Artificial Sequence
  Synthetic
agaacuguucuuccucccccuuuc

SEQ ID NO: 58134 - RNA, 18 nt, Artificial Sequence
  Synthetic
ggcggcggcgguggaaag

SEQ ID NO: 58135 - RNA, 19 nt, Artificial Sequence
  Synthetic
uggcggcggcgguggaaag

SEQ ID NO: 58136 - RNA, 20 nt, Artificial Sequence
  Synthetic
guggcggcggcgguggaaag

SEQ ID NO: 58137 - RNA, 21 nt, Artificial Sequence
  Synthetic
gguggcggcggcgguggaaag

SEQ ID NO: 58138 - RNA, 22 nt, Artificial Sequence
  Synthetic
ugguggcggcggcgguggaaag

SEQ ID NO: 58139 - RNA, 23 nt, Artificial Sequence
  Synthetic
gugguggcggcggcgguggaaag

SEQ ID NO: 58140 - RNA, 24 nt, Artificial Sequence
  Synthetic
ggugguggcggcggcgguggaaag

SEQ ID NO: 58141 - RNA, 18 nt, Artificial Sequence
  Synthetic
aggauggaagggcagaag

SEQ ID NO: 58142 - RNA, 19 nt, Artificial Sequence
  Synthetic
gaggauggaagggcagaag

SEQ ID NO: 58143 - RNA, 20 nt, Artificial Sequence
  Synthetic
ggaggauggaagggcagaag

SEQ ID NO: 58144 - RNA, 21 nt, Artificial Sequence
  Synthetic
cggaggauggaagggcagaag

SEQ ID NO: 58145 - RNA, 22 nt, Artificial Sequence
  Synthetic
acggaggauggaagggcagaag

SEQ ID NO: 58146 - RNA, 23 nt, Artificial Sequence
  Synthetic
aacggaggauggaagggcagaag

SEQ ID NO: 58147 - RNA, 24 nt, Artificial Sequence
  Synthetic
aaacggaggauggaagggcagaag

SEQ ID NO: 58148 - RNA, 18 nt, Artificial Sequence
  Synthetic
gcgggcgggcgaaggaag

SEQ ID NO: 58149 - RNA, 19 nt, Artificial Sequence
  Synthetic
ggcgggcgggcgaaggaag

SEQ ID NO: 58150 - RNA, 20 nt, Artificial Sequence
  Synthetic
aggcgggcgggcgaaggaag

SEQ ID NO: 58151 - RNA, 21 nt, Artificial Sequence
  Synthetic
gaggcgggcgggcgaaggaag

SEQ ID NO: 58152 - RNA, 22 nt, Artificial Sequence
  Synthetic
cgaggcgggcgggcgaaggaag

SEQ ID NO: 58153 - RNA, 23 nt, Artificial Sequence
  Synthetic
gcgaggcgggcgggcgaaggaag

SEQ ID NO: 58154 - RNA, 24 nt, Artificial Sequence
  Synthetic
ggcgaggcgggcgggcgaaggaag

SEQ ID NO: 58155 - RNA, 18 nt, Artificial Sequence
  Synthetic
agguuuagggucguacag

SEQ ID NO: 58156 - RNA, 19 nt, Artificial Sequence
  Synthetic
uagguuuagggucguacag

SEQ ID NO: 58157 - RNA, 20 nt, Artificial Sequence
  Synthetic
guagguuuagggucguacag

SEQ ID NO: 58158 - RNA, 21 nt, Artificial Sequence
  Synthetic
gguagguuuagggucguacag

SEQ ID NO: 58159 - RNA, 22 nt, Artificial Sequence
  Synthetic
agguagguuuagggucguacag

SEQ ID NO: 58160 - RNA, 23 nt, Artificial Sequence
  Synthetic
cagguagguuuagggucguacag

SEQ ID NO: 58161 - RNA, 24 nt, Artificial Sequence
  Synthetic
gcagguagguuuagggucguacag

SEQ ID NO: 58162 - RNA, 18 nt, Artificial Sequence
  Synthetic
gaucgcggcgagacgcag

SEQ ID NO: 58163 - RNA, 19 nt, Artificial Sequence
  Synthetic
ggaucgcggcgagacgcag

SEQ ID NO: 58164 - RNA, 20 nt, Artificial Sequence
  Synthetic
gggaucgcggcgagacgcag

SEQ ID NO: 58165 - RNA, 21 nt, Artificial Sequence
  Synthetic
cgggaucgcggcgagacgcag

SEQ ID NO: 58166 - RNA, 22 nt, Artificial Sequence
  Synthetic
gcgggaucgcggcgagacgcag

SEQ ID NO: 58167 - RNA, 23 nt, Artificial Sequence
  Synthetic
ggcgggaucgcggcgagacgcag

SEQ ID NO: 58168 - RNA, 24 nt, Artificial Sequence
  Synthetic
cggcgggaucgcggcgagacgcag

SEQ ID NO: 58169 - RNA, 18 nt, Artificial Sequence
  Synthetic
gagacccaagcaccgcag

SEQ ID NO: 58170 - RNA, 19 nt, Artificial Sequence
  Synthetic
ggagacccaagcaccgcag

SEQ ID NO: 58171 - RNA, 20 nt, Artificial Sequence
  Synthetic
aggagacccaagcaccgcag

SEQ ID NO: 58172 - RNA, 21 nt, Artificial Sequence
  Synthetic
aaggagacccaagcaccgcag

SEQ ID NO: 58173 - RNA, 22 nt, Artificial Sequence
  Synthetic
gaaggagacccaagcaccgcag

SEQ ID NO: 58174 - RNA, 23 nt, Artificial Sequence
  Synthetic
cgaaggagacccaagcaccgcag

SEQ ID NO: 58175 - RNA, 24 nt, Artificial Sequence
  Synthetic
acgaaggagacccaagcaccgcag

SEQ ID NO: 58176 - RNA, 18 nt, Artificial Sequence
  Synthetic
gcggaagagagaagagag

SEQ ID NO: 58177 - RNA, 19 nt, Artificial Sequence
  Synthetic
ggcggaagagagaagagag

SEQ ID NO: 58178 - RNA, 20 nt, Artificial Sequence
  Synthetic
gggcggaagagagaagagag

SEQ ID NO: 58179 - RNA, 21 nt, Artificial Sequence
  Synthetic
cgggcggaagagagaagagag

SEQ ID NO: 58180 - RNA, 22 nt, Artificial Sequence
  Synthetic
gcgggcggaagagagaagagag

SEQ ID NO: 58181 - RNA, 23 nt, Artificial Sequence
  Synthetic
ggcgggcggaagagagaagagag

SEQ ID NO: 58182 - RNA, 24 nt, Artificial Sequence
  Synthetic
gggcgggcggaagagagaagagag

SEQ ID NO: 58183 - RNA, 18 nt, Artificial Sequence
  Synthetic
ggggcgggcggaagagag

SEQ ID NO: 58184 - RNA, 19 nt, Artificial Sequence
  Synthetic
gggggcgggcggaagagag

SEQ ID NO: 58185 - RNA, 20 nt, Artificial Sequence
  Synthetic
ggggggcgggcggaagagag

SEQ ID NO: 58186 - RNA, 21 nt, Artificial Sequence
  Synthetic
gggggggcgggcggaagagag

SEQ ID NO: 58187 - RNA, 22 nt, Artificial Sequence
  Synthetic
ggggggggcgggcggaagagag

SEQ ID NO: 58188 - RNA, 23 nt, Artificial Sequence
  Synthetic
gggggggggcgggcggaagagag

SEQ ID NO: 58189 - RNA, 24 nt, Artificial Sequence
  Synthetic
ggggggggggcgggcggaagagag

SEQ ID NO: 58190 - RNA, 18 nt, Artificial Sequence
  Synthetic
gcugaggcggcgggagag

SEQ ID NO: 58191 - RNA, 19 nt, Artificial Sequence
  Synthetic
ugcugaggcggcgggagag

SEQ ID NO: 58192 - RNA, 20 nt, Artificial Sequence
  Synthetic
cugcugaggcggcgggagag

SEQ ID NO: 58193 - RNA, 21 nt, Artificial Sequence
  Synthetic
ucugcugaggcggcgggagag

SEQ ID NO: 58194 - RNA, 22 nt, Artificial Sequence
  Synthetic
uucugcugaggcggcgggagag

SEQ ID NO: 58195 - RNA, 23 nt, Artificial Sequence
  Synthetic
cuucugcugaggcggcgggagag

SEQ ID NO: 58196 - RNA, 24 nt, Artificial Sequence
  Synthetic
gcuucugcugaggcggcgggagag

SEQ ID NO: 58197 - RNA, 18 nt, Artificial Sequence
  Synthetic
ccuuucaagaaacacgag

SEQ ID NO: 58198 - RNA, 19 nt, Artificial Sequence
  Synthetic
cccuuucaagaaacacgag

SEQ ID NO: 58199 - RNA, 20 nt, Artificial Sequence
  Synthetic
ccccuuucaagaaacacgag

SEQ ID NO: 58200 - RNA, 21 nt, Artificial Sequence
  Synthetic
cccccuuucaagaaacacgag

SEQ ID NO: 58201 - RNA, 22 nt, Artificial Sequence
  Synthetic
ucccccuuucaagaaacacgag

SEQ ID NO: 58202 - RNA, 23 nt, Artificial Sequence
  Synthetic
cucccccuuucaagaaacacgag

SEQ ID NO: 58203 - RNA, 24 nt, Artificial Sequence
  Synthetic
ccucccccuuucaagaaacacgag

SEQ ID NO: 58204 - RNA, 18 nt, Artificial Sequence
  Synthetic
gcagccggagaggccgag

SEQ ID NO: 58205 - RNA, 19 nt, Artificial Sequence
  Synthetic
cgcagccggagaggccgag

SEQ ID NO: 58206 - RNA, 20 nt, Artificial Sequence
  Synthetic
ccgcagccggagaggccgag

SEQ ID NO: 58207 - RNA, 21 nt, Artificial Sequence
  Synthetic
accgcagccggagaggccgag

SEQ ID NO: 58208 - RNA, 22 nt, Artificial Sequence
  Synthetic
caccgcagccggagaggccgag

SEQ ID NO: 58209 - RNA, 23 nt, Artificial Sequence
  Synthetic
gcaccgcagccggagaggccgag

SEQ ID NO: 58210 - RNA, 24 nt, Artificial Sequence
  Synthetic
agcaccgcagccggagaggccgag

SEQ ID NO: 58211 - RNA, 18 nt, Artificial Sequence
  Synthetic
ggagggguccggggcgag

SEQ ID NO: 58212 - RNA, 19 nt, Artificial Sequence
  Synthetic
gggagggguccggggcgag

SEQ ID NO: 58213 - RNA, 20 nt, Artificial Sequence
  Synthetic
ggggagggguccggggcgag

SEQ ID NO: 58214 - RNA, 21 nt, Artificial Sequence
  Synthetic
gggggagggguccggggcgag

SEQ ID NO: 58215 - RNA, 22 nt, Artificial Sequence
  Synthetic
ggggggagggguccggggcgag

SEQ ID NO: 58216 - RNA, 23 nt, Artificial Sequence
  Synthetic
gggggggagggguccggggcgag

SEQ ID NO: 58217 - RNA, 24 nt, Artificial Sequence
  Synthetic
cgggggggagggguccggggcgag

SEQ ID NO: 58218 - RNA, 18 nt, Artificial Sequence
  Synthetic
cugcugaggcggcgggag

SEQ ID NO: 58219 - RNA, 19 nt, Artificial Sequence
  Synthetic
ucugcugaggcggcgggag

SEQ ID NO: 58220 - RNA, 20 nt, Artificial Sequence
  Synthetic
uucugcugaggcggcgggag

SEQ ID NO: 58221 - RNA, 21 nt, Artificial Sequence
  Synthetic
cuucugcugaggcggcgggag

SEQ ID NO: 58222 - RNA, 22 nt, Artificial Sequence
  Synthetic
gcuucugcugaggcggcgggag

SEQ ID NO: 58223 - RNA, 23 nt, Artificial Sequence
  Synthetic
agcuucugcugaggcggcgggag

SEQ ID NO: 58224 - RNA, 24 nt, Artificial Sequence
  Synthetic
gagcuucugcugaggcggcgggag

SEQ ID NO: 58225 - RNA, 18 nt, Artificial Sequence
  Synthetic
ggggcgugguggugaacg

SEQ ID NO: 58226 - RNA, 19 nt, Artificial Sequence
  Synthetic
gggggcgugguggugaacg

SEQ ID NO: 58227 - RNA, 20 nt, Artificial Sequence
  Synthetic
ggggggcgugguggugaacg

SEQ ID NO: 58228 - RNA, 21 nt, Artificial Sequence
  Synthetic
uggggggcgugguggugaacg

SEQ ID NO: 58229 - RNA, 22 nt, Artificial Sequence
  Synthetic
guggggggcgugguggugaacg

SEQ ID NO: 58230 - RNA, 23 nt, Artificial Sequence
  Synthetic
gguggggggcgugguggugaacg

SEQ ID NO: 58231 - RNA, 24 nt, Artificial Sequence
  Synthetic
cgguggggggcgugguggugaacg

SEQ ID NO: 58232 - RNA, 18 nt, Artificial Sequence
  Synthetic
aacgauggggggaacacg

SEQ ID NO: 58233 - RNA, 19 nt, Artificial Sequence
  Synthetic
gaacgauggggggaacacg

SEQ ID NO: 58234 - RNA, 20 nt, Artificial Sequence
  Synthetic
ugaacgauggggggaacacg

SEQ ID NO: 58235 - RNA, 21 nt, Artificial Sequence
  Synthetic
gugaacgauggggggaacacg

SEQ ID NO: 58236 - RNA, 22 nt, Artificial Sequence
  Synthetic
ggugaacgauggggggaacacg

SEQ ID NO: 58237 - RNA, 23 nt, Artificial Sequence
  Synthetic
uggugaacgauggggggaacacg

SEQ ID NO: 58238 - RNA, 24 nt, Artificial Sequence
  Synthetic
guggugaacgauggggggaacacg

SEQ ID NO: 58239 - RNA, 18 nt, Artificial Sequence
  Synthetic
cccccccgccgcccgacg

SEQ ID NO: 58240 - RNA, 19 nt, Artificial Sequence
  Synthetic
ccccccccgccgcccgacg

SEQ ID NO: 58241 - RNA, 20 nt, Artificial Sequence
  Synthetic
cccccccccgccgcccgacg

SEQ ID NO: 58242 - RNA, 21 nt, Artificial Sequence
  Synthetic
ccccccccccgccgcccgacg

SEQ ID NO: 58243 - RNA, 22 nt, Artificial Sequence
  Synthetic
gccccccccccgccgcccgacg

SEQ ID NO: 58244 - RNA, 23 nt, Artificial Sequence
  Synthetic
cgccccccccccgccgcccgacg

SEQ ID NO: 58245 - RNA, 24 nt, Artificial Sequence
  Synthetic
acgccccccccccgccgcccgacg

SEQ ID NO: 58246 - RNA, 18 nt, Artificial Sequence
  Synthetic
cgccgccgcgccccaccg

SEQ ID NO: 58247 - RNA, 19 nt, Artificial Sequence
  Synthetic
ccgccgccgcgccccaccg

SEQ ID NO: 58248 - RNA, 20 nt, Artificial Sequence
  Synthetic
accgccgccgcgccccaccg

SEQ ID NO: 58249 - RNA, 21 nt, Artificial Sequence
  Synthetic
gaccgccgccgcgccccaccg

SEQ ID NO: 58250 - RNA, 22 nt, Artificial Sequence
  Synthetic
cgaccgccgccgcgccccaccg

SEQ ID NO: 58251 - RNA, 23 nt, Artificial Sequence
  Synthetic
ccgaccgccgccgcgccccaccg

SEQ ID NO: 58252 - RNA, 24 nt, Artificial Sequence
  Synthetic
cccgaccgccgccgcgccccaccg

SEQ ID NO: 58253 - RNA, 18 nt, Artificial Sequence
  Synthetic
ccccccccccgccgcccg

SEQ ID NO: 58254 - RNA, 19 nt, Artificial Sequence
  Synthetic
gccccccccccgccgcccg

SEQ ID NO: 58255 - RNA, 20 nt, Artificial Sequence
  Synthetic
cgccccccccccgccgcccg

SEQ ID NO: 58256 - RNA, 21 nt, Artificial Sequence
  Synthetic
acgccccccccccgccgcccg

SEQ ID NO: 58257 - RNA, 22 nt, Artificial Sequence
  Synthetic
gacgccccccccccgccgcccg

SEQ ID NO: 58258 - RNA, 23 nt, Artificial Sequence
  Synthetic
cgacgccccccccccgccgcccg

SEQ ID NO: 58259 - RNA, 24 nt, Artificial Sequence
  Synthetic
ccgacgccccccccccgccgcccg

SEQ ID NO: 58260 - RNA, 18 nt, Artificial Sequence
  Synthetic
acccaagcaccgcagccg

SEQ ID NO: 58261 - RNA, 19 nt, Artificial Sequence
  Synthetic
gacccaagcaccgcagccg

SEQ ID NO: 58262 - RNA, 20 nt, Artificial Sequence
  Synthetic
agacccaagcaccgcagccg

SEQ ID NO: 58263 - RNA, 21 nt, Artificial Sequence
  Synthetic
gagacccaagcaccgcagccg

SEQ ID NO: 58264 - RNA, 22 nt, Artificial Sequence
  Synthetic
ggagacccaagcaccgcagccg

SEQ ID NO: 58265 - RNA, 23 nt, Artificial Sequence
  Synthetic
aggagacccaagcaccgcagccg

SEQ ID NO: 58266 - RNA, 24 nt, Artificial Sequence
  Synthetic
aaggagacccaagcaccgcagccg

SEQ ID NO: 58267 - RNA, 18 nt, Artificial Sequence
  Synthetic
cgcgugagccguccgccg

SEQ ID NO: 58268 - RNA, 19 nt, Artificial Sequence
  Synthetic
ccgcgugagccguccgccg

SEQ ID NO: 58269 - RNA, 20 nt, Artificial Sequence
  Synthetic
gccgcgugagccguccgccg

SEQ ID NO: 58270 - RNA, 21 nt, Artificial Sequence
  Synthetic
cgccgcgugagccguccgccg

SEQ ID NO: 58271 - RNA, 22 nt, Artificial Sequence
  Synthetic
gcgccgcgugagccguccgccg

SEQ ID NO: 58272 - RNA, 23 nt, Artificial Sequence
  Synthetic
cgcgccgcgugagccguccgccg

SEQ ID NO: 58273 - RNA, 24 nt, Artificial Sequence
  Synthetic
ccgcgccgcgugagccguccgccg

SEQ ID NO: 58274 - RNA, 18 nt, Artificial Sequence
  Synthetic
cgggggacccaggcuccg

SEQ ID NO: 58275 - RNA, 19 nt, Artificial Sequence
  Synthetic
ccgggggacccaggcuccg

SEQ ID NO: 58276 - RNA, 20 nt, Artificial Sequence
  Synthetic
gccgggggacccaggcuccg

SEQ ID NO: 58277 - RNA, 21 nt, Artificial Sequence
  Synthetic
cgccgggggacccaggcuccg

SEQ ID NO: 58278 - RNA, 22 nt, Artificial Sequence
  Synthetic
ccgccgggggacccaggcuccg

SEQ ID NO: 58279 - RNA, 23 nt, Artificial Sequence
  Synthetic
uccgccgggggacccaggcuccg

SEQ ID NO: 58280 - RNA, 24 nt, Artificial Sequence
  Synthetic
guccgccgggggacccaggcuccg

SEQ ID NO: 58281 - RNA, 18 nt, Artificial Sequence
  Synthetic
cgccgcgugagccguccg

SEQ ID NO: 58282 - RNA, 19 nt, Artificial Sequence
  Synthetic
gcgccgcgugagccguccg

SEQ ID NO: 58283 - RNA, 20 nt, Artificial Sequence
  Synthetic
cgcgccgcgugagccguccg

SEQ ID NO: 58284 - RNA, 21 nt, Artificial Sequence
  Synthetic
ccgcgccgcgugagccguccg

SEQ ID NO: 58285 - RNA, 22 nt, Artificial Sequence
  Synthetic
gccgcgccgcgugagccguccg

SEQ ID NO: 58286 - RNA, 23 nt, Artificial Sequence
  Synthetic
cgccgcgccgcgugagccguccg

SEQ ID NO: 58287 - RNA, 24 nt, Artificial Sequence
  Synthetic
acgccgcgccgcgugagccguccg

SEQ ID NO: 58288 - RNA, 18 nt, Artificial Sequence
  Synthetic
ccaaacagccaaggcgcg

SEQ ID NO: 58289 - RNA, 19 nt, Artificial Sequence
  Synthetic
cccaaacagccaaggcgcg

SEQ ID NO: 58290 - RNA, 20 nt, Artificial Sequence
  Synthetic
ccccaaacagccaaggcgcg

SEQ ID NO: 58291 - RNA, 21 nt, Artificial Sequence
  Synthetic
cccccaaacagccaaggcgcg

SEQ ID NO: 58292 - RNA, 22 nt, Artificial Sequence
  Synthetic
ccccccaaacagccaaggcgcg

SEQ ID NO: 58293 - RNA, 23 nt, Artificial Sequence
  Synthetic
accccccaaacagccaaggcgcg

SEQ ID NO: 58294 - RNA, 24 nt, Artificial Sequence
  Synthetic
caccccccaaacagccaaggcgcg

SEQ ID NO: 58295 - RNA, 18 nt, Artificial Sequence
  Synthetic
cccaccggcgggaucgcg

SEQ ID NO: 58296 - RNA, 19 nt, Artificial Sequence
  Synthetic
ccccaccggcgggaucgcg

SEQ ID NO: 58297 - RNA, 20 nt, Artificial Sequence
  Synthetic
gccccaccggcgggaucgcg

SEQ ID NO: 58298 - RNA, 21 nt, Artificial Sequence
  Synthetic
cgccccaccggcgggaucgcg

SEQ ID NO: 58299 - RNA, 22 nt, Artificial Sequence
  Synthetic
gcgccccaccggcgggaucgcg

SEQ ID NO: 58300 - RNA, 23 nt, Artificial Sequence
  Synthetic
cgcgccccaccggcgggaucgcg

SEQ ID NO: 58301 - RNA, 24 nt, Artificial Sequence
  Synthetic
ccgcgccccaccggcgggaucgcg

SEQ ID NO: 58302 - RNA, 18 nt, Artificial Sequence
  Synthetic
ugagcuucugcugaggcg

SEQ ID NO: 58303 - RNA, 19 nt, Artificial Sequence
  Synthetic
gugagcuucugcugaggcg

SEQ ID NO: 58304 - RNA, 20 nt, Artificial Sequence
  Synthetic
ggugagcuucugcugaggcg

SEQ ID NO: 58305 - RNA, 21 nt, Artificial Sequence
  Synthetic
aggugagcuucugcugaggcg

SEQ ID NO: 58306 - RNA, 22 nt, Artificial Sequence
  Synthetic
caggugagcuucugcugaggcg

SEQ ID NO: 58307 - RNA, 23 nt, Artificial Sequence
  Synthetic
acaggugagcuucugcugaggcg

SEQ ID NO: 58308 - RNA, 24 nt, Artificial Sequence
  Synthetic
uacaggugagcuucugcugaggcg

SEQ ID NO: 58309 - RNA, 18 nt, Artificial Sequence
  Synthetic
ggggugguggcggcggcg

SEQ ID NO: 58310 - RNA, 19 nt, Artificial Sequence
  Synthetic
gggggugguggcggcggcg

SEQ ID NO: 58311 - RNA, 20 nt, Artificial Sequence
  Synthetic
ggggggugguggcggcggcg

SEQ ID NO: 58312 - RNA, 21 nt, Artificial Sequence
  Synthetic
gggggggugguggcggcggcg

SEQ ID NO: 58313 - RNA, 22 nt, Artificial Sequence
  Synthetic
agggggggugguggcggcggcg

SEQ ID NO: 58314 - RNA, 23 nt, Artificial Sequence
  Synthetic
aagggggggugguggcggcggcg

SEQ ID NO: 58315 - RNA, 24 nt, Artificial Sequence
  Synthetic
gaagggggggugguggcggcggcg

SEQ ID NO: 58316 - RNA, 18 nt, Artificial Sequence
  Synthetic
gggcgaggcgggcgggcg

SEQ ID NO: 58317 - RNA, 19 nt, Artificial Sequence
  Synthetic
ggggcgaggcgggcgggcg

SEQ ID NO: 58318 - RNA, 20 nt, Artificial Sequence
  Synthetic
cggggcgaggcgggcgggcg

SEQ ID NO: 58319 - RNA, 21 nt, Artificial Sequence
  Synthetic
ccggggcgaggcgggcgggcg

SEQ ID NO: 58320 - RNA, 22 nt, Artificial Sequence
  Synthetic
uccggggcgaggcgggcgggcg

SEQ ID NO: 58321 - RNA, 23 nt, Artificial Sequence
  Synthetic
guccggggcgaggcgggcgggcg

SEQ ID NO: 58322 - RNA, 24 nt, Artificial Sequence
  Synthetic
gguccggggcgaggcgggcgggcg

SEQ ID NO: 58323 - RNA, 18 nt, Artificial Sequence
  Synthetic
gaggcgggcgggcgaagg

SEQ ID NO: 58324 - RNA, 19 nt, Artificial Sequence
  Synthetic
cgaggcgggcgggcgaagg

SEQ ID NO: 58325 - RNA, 20 nt, Artificial Sequence
  Synthetic
gcgaggcgggcgggcgaagg

SEQ ID NO: 58326 - RNA, 21 nt, Artificial Sequence
  Synthetic
ggcgaggcgggcgggcgaagg

SEQ ID NO: 58327 - RNA, 22 nt, Artificial Sequence
  Synthetic
gggcgaggcgggcgggcgaagg

SEQ ID NO: 58328 - RNA, 23 nt, Artificial Sequence
  Synthetic
ggggcgaggcgggcgggcgaagg

SEQ ID NO: 58329 - RNA, 24 nt, Artificial Sequence
  Synthetic
cggggcgaggcgggcgggcgaagg

SEQ ID NO: 58330 - RNA, 18 nt, Artificial Sequence
  Synthetic
gcaccgcagccggagagg

SEQ ID NO: 58331 - RNA, 19 nt, Artificial Sequence
  Synthetic
agcaccgcagccggagagg

SEQ ID NO: 58332 - RNA, 20 nt, Artificial Sequence
  Synthetic
aagcaccgcagccggagagg

SEQ ID NO: 58333 - RNA, 21 nt, Artificial Sequence
  Synthetic
caagcaccgcagccggagagg

SEQ ID NO: 58334 - RNA, 22 nt, Artificial Sequence
  Synthetic
ccaagcaccgcagccggagagg

SEQ ID NO: 58335 - RNA, 23 nt, Artificial Sequence
  Synthetic
cccaagcaccgcagccggagagg

SEQ ID NO: 58336 - RNA, 24 nt, Artificial Sequence
  Synthetic
acccaagcaccgcagccggagagg

SEQ ID NO: 58337 - RNA, 18 nt, Artificial Sequence
  Synthetic
cugaggcggcgggagagg

SEQ ID NO: 58338 - RNA, 19 nt, Artificial Sequence
  Synthetic
gcugaggcggcgggagagg

SEQ ID NO: 58339 - RNA, 20 nt, Artificial Sequence
  Synthetic
ugcugaggcggcgggagagg

SEQ ID NO: 58340 - RNA, 21 nt, Artificial Sequence
  Synthetic
cugcugaggcggcgggagagg

SEQ ID NO: 58341 - RNA, 22 nt, Artificial Sequence
  Synthetic
ucugcugaggcggcgggagagg

SEQ ID NO: 58342 - RNA, 23 nt, Artificial Sequence
  Synthetic
uucugcugaggcggcgggagagg

SEQ ID NO: 58343 - RNA, 24 nt, Artificial Sequence
  Synthetic
cuucugcugaggcggcgggagagg

SEQ ID NO: 58344 - RNA, 18 nt, Artificial Sequence
  Synthetic
cuuucaagaaacacgagg

SEQ ID NO: 58345 - RNA, 19 nt, Artificial Sequence
  Synthetic
ccuuucaagaaacacgagg

SEQ ID NO: 58346 - RNA, 20 nt, Artificial Sequence
  Synthetic
cccuuucaagaaacacgagg

SEQ ID NO: 58347 - RNA, 21 nt, Artificial Sequence
  Synthetic
ccccuuucaagaaacacgagg

SEQ ID NO: 58348 - RNA, 22 nt, Artificial Sequence
  Synthetic
cccccuuucaagaaacacgagg

SEQ ID NO: 58349 - RNA, 23 nt, Artificial Sequence
  Synthetic
ucccccuuucaagaaacacgagg

SEQ ID NO: 58350 - RNA, 24 nt, Artificial Sequence
  Synthetic
cucccccuuucaagaaacacgagg

SEQ ID NO: 58351 - RNA, 18 nt, Artificial Sequence
  Synthetic
aaagcggaaaaacggagg

SEQ ID NO: 58352 - RNA, 19 nt, Artificial Sequence
  Synthetic
gaaagcggaaaaacggagg

SEQ ID NO: 58353 - RNA, 20 nt, Artificial Sequence
  Synthetic
ggaaagcggaaaaacggagg

SEQ ID NO: 58354 - RNA, 21 nt, Artificial Sequence
  Synthetic
uggaaagcggaaaaacggagg

SEQ ID NO: 58355 - RNA, 22 nt, Artificial Sequence
  Synthetic
guggaaagcggaaaaacggagg

SEQ ID NO: 58356 - RNA, 23 nt, Artificial Sequence
  Synthetic
gguggaaagcggaaaaacggagg

SEQ ID NO: 58357 - RNA, 24 nt, Artificial Sequence
  Synthetic
cgguggaaagcggaaaaacggagg

SEQ ID NO: 58358 - RNA, 18 nt, Artificial Sequence
  Synthetic
acgauggggggaacacgg

SEQ ID NO: 58359 - RNA, 19 nt, Artificial Sequence
  Synthetic
aacgauggggggaacacgg

SEQ ID NO: 58360 - RNA, 20 nt, Artificial Sequence
  Synthetic
gaacgauggggggaacacgg

SEQ ID NO: 58361 - RNA, 21 nt, Artificial Sequence
  Synthetic
ugaacgauggggggaacacgg

SEQ ID NO: 58362 - RNA, 22 nt, Artificial Sequence
  Synthetic
gugaacgauggggggaacacgg

SEQ ID NO: 58363 - RNA, 23 nt, Artificial Sequence
  Synthetic
ggugaacgauggggggaacacgg

SEQ ID NO: 58364 - RNA, 24 nt, Artificial Sequence
  Synthetic
uggugaacgauggggggaacacgg

SEQ ID NO: 58365 - RNA, 18 nt, Artificial Sequence
  Synthetic
cggggagugggcggccgg

SEQ ID NO: 58366 - RNA, 19 nt, Artificial Sequence
  Synthetic
gcggggagugggcggccgg

SEQ ID NO: 58367 - RNA, 20 nt, Artificial Sequence
  Synthetic
agcggggagugggcggccgg

SEQ ID NO: 58368 - RNA, 21 nt, Artificial Sequence
  Synthetic
gagcggggagugggcggccgg

SEQ ID NO: 58369 - RNA, 22 nt, Artificial Sequence
  Synthetic
cgagcggggagugggcggccgg

SEQ ID NO: 58370 - RNA, 23 nt, Artificial Sequence
  Synthetic
ccgagcggggagugggcggccgg

SEQ ID NO: 58371 - RNA, 24 nt, Artificial Sequence
  Synthetic
gccgagcggggagugggcggccgg

SEQ ID NO: 58372 - RNA, 18 nt, Artificial Sequence
  Synthetic
gggggacccaggcuccgg

SEQ ID NO: 58373 - RNA, 19 nt, Artificial Sequence
  Synthetic
cgggggacccaggcuccgg

SEQ ID NO: 58374 - RNA, 20 nt, Artificial Sequence
  Synthetic
ccgggggacccaggcuccgg

SEQ ID NO: 58375 - RNA, 21 nt, Artificial Sequence
  Synthetic
gccgggggacccaggcuccgg

SEQ ID NO: 58376 - RNA, 22 nt, Artificial Sequence
  Synthetic
cgccgggggacccaggcuccgg

SEQ ID NO: 58377 - RNA, 23 nt, Artificial Sequence
  Synthetic
ccgccgggggacccaggcuccgg

SEQ ID NO: 58378 - RNA, 24 nt, Artificial Sequence
  Synthetic
uccgccgggggacccaggcuccgg

SEQ ID NO: 58379 - RNA, 18 nt, Artificial Sequence
  Synthetic
caaacagccaaggcgcgg

SEQ ID NO: 58380 - RNA, 19 nt, Artificial Sequence
  Synthetic
ccaaacagccaaggcgcgg

SEQ ID NO: 58381 - RNA, 20 nt, Artificial Sequence
  Synthetic
cccaaacagccaaggcgcgg

SEQ ID NO: 58382 - RNA, 21 nt, Artificial Sequence
  Synthetic
ccccaaacagccaaggcgcgg

SEQ ID NO: 58383 - RNA, 22 nt, Artificial Sequence
  Synthetic
cccccaaacagccaaggcgcgg

SEQ ID NO: 58384 - RNA, 23 nt, Artificial Sequence
  Synthetic
ccccccaaacagccaaggcgcgg

SEQ ID NO: 58385 - RNA, 24 nt, Artificial Sequence
  Synthetic
accccccaaacagccaaggcgcgg

SEQ ID NO: 58386 - RNA, 18 nt, Artificial Sequence
  Synthetic
ggguccggggcgaggcgg

SEQ ID NO: 58387 - RNA, 19 nt, Artificial Sequence
  Synthetic
gggguccggggcgaggcgg

SEQ ID NO: 58388 - RNA, 20 nt, Artificial Sequence
  Synthetic
agggguccggggcgaggcgg

SEQ ID NO: 58389 - RNA, 21 nt, Artificial Sequence
  Synthetic
gagggguccggggcgaggcgg

SEQ ID NO: 58390 - RNA, 22 nt, Artificial Sequence
  Synthetic
ggagggguccggggcgaggcgg

SEQ ID NO: 58391 - RNA, 23 nt, Artificial Sequence
  Synthetic
gggagggguccggggcgaggcgg

SEQ ID NO: 58392 - RNA, 24 nt, Artificial Sequence
  Synthetic
ggggagggguccggggcgaggcgg

SEQ ID NO: 58393 - RNA, 18 nt, Artificial Sequence
  Synthetic
gagcuucugcugaggcgg

SEQ ID NO: 58394 - RNA, 19 nt, Artificial Sequence
  Synthetic
ugagcuucugcugaggcgg

SEQ ID NO: 58395 - RNA, 20 nt, Artificial Sequence
  Synthetic
gugagcuucugcugaggcgg

SEQ ID NO: 58396 - RNA, 21 nt, Artificial Sequence
  Synthetic
ggugagcuucugcugaggcgg

SEQ ID NO: 58397 - RNA, 22 nt, Artificial Sequence
  Synthetic
aggugagcuucugcugaggcgg

SEQ ID NO: 58398 - RNA, 23 nt, Artificial Sequence
  Synthetic
caggugagcuucugcugaggcgg

SEQ ID NO: 58399 - RNA, 24 nt, Artificial Sequence
  Synthetic
acaggugagcuucugcugaggcgg

SEQ ID NO: 58400 - RNA, 18 nt, Artificial Sequence
  Synthetic
cuucugcugaggcggcgg

SEQ ID NO: 58401 - RNA, 19 nt, Artificial Sequence
  Synthetic
gcuucugcugaggcggcgg

SEQ ID NO: 58402 - RNA, 20 nt, Artificial Sequence
  Synthetic
agcuucugcugaggcggcgg

SEQ ID NO: 58403 - RNA, 21 nt, Artificial Sequence
  Synthetic
gagcuucugcugaggcggcgg

SEQ ID NO: 58404 - RNA, 22 nt, Artificial Sequence
  Synthetic
ugagcuucugcugaggcggcgg

SEQ ID NO: 58405 - RNA, 23 nt, Artificial Sequence
  Synthetic
gugagcuucugcugaggcggcgg

SEQ ID NO: 58406 - RNA, 24 nt, Artificial Sequence
  Synthetic
ggugagcuucugcugaggcggcgg

SEQ ID NO: 58407 - RNA, 18 nt, Artificial Sequence
  Synthetic
gggugguggcggcggcgg

SEQ ID NO: 58408 - RNA, 19 nt, Artificial Sequence
  Synthetic
ggggugguggcggcggcgg

SEQ ID NO: 58409 - RNA, 20 nt, Artificial Sequence
  Synthetic
gggggugguggcggcggcgg

SEQ ID NO: 58410 - RNA, 21 nt, Artificial Sequence
  Synthetic
ggggggugguggcggcggcgg

SEQ ID NO: 58411 - RNA, 22 nt, Artificial Sequence
  Synthetic
gggggggugguggcggcggcgg

SEQ ID NO: 58412 - RNA, 23 nt, Artificial Sequence
  Synthetic
agggggggugguggcggcggcgg

SEQ ID NO: 58413 - RNA, 24 nt, Artificial Sequence
  Synthetic
aagggggggugguggcggcggcgg

SEQ ID NO: 58414 - RNA, 18 nt, Artificial Sequence
  Synthetic
ccggggcgaggcgggcgg

SEQ ID NO: 58415 - RNA, 19 nt, Artificial Sequence
  Synthetic
uccggggcgaggcgggcgg

SEQ ID NO: 58416 - RNA, 20 nt, Artificial Sequence
  Synthetic
guccggggcgaggcgggcgg

SEQ ID NO: 58417 - RNA, 21 nt, Artificial Sequence
  Synthetic
gguccggggcgaggcgggcgg

SEQ ID NO: 58418 - RNA, 22 nt, Artificial Sequence
  Synthetic
ggguccggggcgaggcgggcgg

SEQ ID NO: 58419 - RNA, 23 nt, Artificial Sequence
  Synthetic
gggguccggggcgaggcgggcgg

SEQ ID NO: 58420 - RNA, 24 nt, Artificial Sequence
  Synthetic
agggguccggggcgaggcgggcgg

SEQ ID NO: 58421 - RNA, 18 nt, Artificial Sequence
  Synthetic
gggggggggggcgggcgg

SEQ ID NO: 58422 - RNA, 19 nt, Artificial Sequence
  Synthetic
agggggggggggcgggcgg

SEQ ID NO: 58423 - RNA, 20 nt, Artificial Sequence
  Synthetic
gagggggggggggcgggcgg

SEQ ID NO: 58424 - RNA, 21 nt, Artificial Sequence
  Synthetic
agagggggggggggcgggcgg

SEQ ID NO: 58425 - RNA, 22 nt, Artificial Sequence
  Synthetic
gagagggggggggggcgggcgg

SEQ ID NO: 58426 - RNA, 23 nt, Artificial Sequence
  Synthetic
ggagagggggggggggcgggcgg

SEQ ID NO: 58427 - RNA, 24 nt, Artificial Sequence
  Synthetic
gggagagggggggggggcgggcgg

SEQ ID NO: 58428 - RNA, 18 nt, Artificial Sequence
  Synthetic
gagagggggggggggcgg

SEQ ID NO: 58429 - RNA, 19 nt, Artificial Sequence
  Synthetic
ggagagggggggggggcgg

SEQ ID NO: 58430 - RNA, 20 nt, Artificial Sequence
  Synthetic
gggagagggggggggggcgg

SEQ ID NO: 58431 - RNA, 21 nt, Artificial Sequence
  Synthetic
cgggagagggggggggggcgg

SEQ ID NO: 58432 - RNA, 22 nt, Artificial Sequence
  Synthetic
gcgggagagggggggggggcgg

SEQ ID NO: 58433 - RNA, 23 nt, Artificial Sequence
  Synthetic
ggcgggagagggggggggggcgg

SEQ ID NO: 58434 - RNA, 24 nt, Artificial Sequence
  Synthetic
cggcgggagagggggggggggcgg

SEQ ID NO: 58435 - RNA, 18 nt, Artificial Sequence
  Synthetic
cgagcggggagugggcgg

SEQ ID NO: 58436 - RNA, 19 nt, Artificial Sequence
  Synthetic
ccgagcggggagugggcgg

SEQ ID NO: 58437 - RNA, 20 nt, Artificial Sequence
  Synthetic
gccgagcggggagugggcgg

SEQ ID NO: 58438 - RNA, 21 nt, Artificial Sequence
  Synthetic
ggccgagcggggagugggcgg

SEQ ID NO: 58439 - RNA, 22 nt, Artificial Sequence
  Synthetic
aggccgagcggggagugggcgg

SEQ ID NO: 58440 - RNA, 23 nt, Artificial Sequence
  Synthetic
gaggccgagcggggagugggcgg

SEQ ID NO: 58441 - RNA, 24 nt, Artificial Sequence
  Synthetic
agaggccgagcggggagugggcgg

SEQ ID NO: 58442 - RNA, 18 nt, Artificial Sequence
  Synthetic
aaacggaggauggaaggg

SEQ ID NO: 58443 - RNA, 19 nt, Artificial Sequence
  Synthetic
aaaacggaggauggaaggg

SEQ ID NO: 58444 - RNA, 20 nt, Artificial Sequence
  Synthetic
aaaaacggaggauggaaggg

SEQ ID NO: 58445 - RNA, 21 nt, Artificial Sequence
  Synthetic
gaaaaacggaggauggaaggg

SEQ ID NO: 58446 - RNA, 22 nt, Artificial Sequence
  Synthetic
ggaaaaacggaggauggaaggg

SEQ ID NO: 58447 - RNA, 23 nt, Artificial Sequence
  Synthetic
cggaaaaacggaggauggaaggg

SEQ ID NO: 58448 - RNA, 24 nt, Artificial Sequence
  Synthetic
gcggaaaaacggaggauggaaggg

SEQ ID NO: 58449 - RNA, 18 nt, Artificial Sequence
  Synthetic
ugaggcggcgggagaggg

SEQ ID NO: 58450 - RNA, 19 nt, Artificial Sequence
  Synthetic
cugaggcggcgggagaggg

SEQ ID NO: 58451 - RNA, 20 nt, Artificial Sequence
  Synthetic
gcugaggcggcgggagaggg

SEQ ID NO: 58452 - RNA, 21 nt, Artificial Sequence
  Synthetic
ugcugaggcggcgggagaggg

SEQ ID NO: 58453 - RNA, 22 nt, Artificial Sequence
  Synthetic
cugcugaggcggcgggagaggg

SEQ ID NO: 58454 - RNA, 23 nt, Artificial Sequence
  Synthetic
ucugcugaggcggcgggagaggg

SEQ ID NO: 58455 - RNA, 24 nt, Artificial Sequence
  Synthetic
uucugcugaggcggcgggagaggg

SEQ ID NO: 58456 - RNA, 18 nt, Artificial Sequence
  Synthetic
cgauggggggaacacggg

SEQ ID NO: 58457 - RNA, 19 nt, Artificial Sequence
  Synthetic
acgauggggggaacacggg

SEQ ID NO: 58458 - RNA, 20 nt, Artificial Sequence
  Synthetic
aacgauggggggaacacggg

SEQ ID NO: 58459 - RNA, 21 nt, Artificial Sequence
  Synthetic
gaacgauggggggaacacggg

SEQ ID NO: 58460 - RNA, 22 nt, Artificial Sequence
  Synthetic
ugaacgauggggggaacacggg

SEQ ID NO: 58461 - RNA, 23 nt, Artificial Sequence
  Synthetic
gugaacgauggggggaacacggg

SEQ ID NO: 58462 - RNA, 24 nt, Artificial Sequence
  Synthetic
ggugaacgauggggggaacacggg

SEQ ID NO: 58463 - RNA, 18 nt, Artificial Sequence
  Synthetic
ggggagugggcggccggg

SEQ ID NO: 58464 - RNA, 19 nt, Artificial Sequence
  Synthetic
cggggagugggcggccggg

SEQ ID NO: 58465 - RNA, 20 nt, Artificial Sequence
  Synthetic
gcggggagugggcggccggg

SEQ ID NO: 58466 - RNA, 21 nt, Artificial Sequence
  Synthetic
agcggggagugggcggccggg

SEQ ID NO: 58467 - RNA, 22 nt, Artificial Sequence
  Synthetic
gagcggggagugggcggccggg

SEQ ID NO: 58468 - RNA, 23 nt, Artificial Sequence
  Synthetic
cgagcggggagugggcggccggg

SEQ ID NO: 58469 - RNA, 24 nt, Artificial Sequence
  Synthetic
ccgagcggggagugggcggccggg

SEQ ID NO: 58470 - RNA, 18 nt, Artificial Sequence
  Synthetic
ggggacccaggcuccggg

SEQ ID NO: 58471 - RNA, 19 nt, Artificial Sequence
  Synthetic
gggggacccaggcuccggg

SEQ ID NO: 58472 - RNA, 20 nt, Artificial Sequence
  Synthetic
cgggggacccaggcuccggg

SEQ ID NO: 58473 - RNA, 21 nt, Artificial Sequence
  Synthetic
ccgggggacccaggcuccggg

SEQ ID NO: 58474 - RNA, 22 nt, Artificial Sequence
  Synthetic
gccgggggacccaggcuccggg

SEQ ID NO: 58475 - RNA, 23 nt, Artificial Sequence
  Synthetic
cgccgggggacccaggcuccggg

SEQ ID NO: 58476 - RNA, 24 nt, Artificial Sequence
  Synthetic
ccgccgggggacccaggcuccggg

SEQ ID NO: 58477 - RNA, 18 nt, Artificial Sequence
  Synthetic
gggggggagggguccggg

SEQ ID NO: 58478 - RNA, 19 nt, Artificial Sequence
  Synthetic
cgggggggagggguccggg

SEQ ID NO: 58479 - RNA, 20 nt, Artificial Sequence
  Synthetic
acgggggggagggguccggg

SEQ ID NO: 58480 - RNA, 21 nt, Artificial Sequence
  Synthetic
cacgggggggagggguccggg

SEQ ID NO: 58481 - RNA, 22 nt, Artificial Sequence
  Synthetic
acacgggggggagggguccggg

SEQ ID NO: 58482 - RNA, 23 nt, Artificial Sequence
  Synthetic
aacacgggggggagggguccggg

SEQ ID NO: 58483 - RNA, 24 nt, Artificial Sequence
  Synthetic
gaacacgggggggagggguccggg

SEQ ID NO: 58484 - RNA, 18 nt, Artificial Sequence
  Synthetic
agagggggggggggcggg

SEQ ID NO: 58485 - RNA, 19 nt, Artificial Sequence
  Synthetic
gagagggggggggggcggg

SEQ ID NO: 58486 - RNA, 20 nt, Artificial Sequence
  Synthetic
ggagagggggggggggcggg

SEQ ID NO: 58487 - RNA, 21 nt, Artificial Sequence
  Synthetic
gggagagggggggggggcggg

SEQ ID NO: 58488 - RNA, 22 nt, Artificial Sequence
  Synthetic
cgggagagggggggggggcggg

SEQ ID NO: 58489 - RNA, 23 nt, Artificial Sequence
  Synthetic
gcgggagagggggggggggcggg

SEQ ID NO: 58490 - RNA, 24 nt, Artificial Sequence
  Synthetic
ggcgggagagggggggggggcggg

SEQ ID NO: 58491 - RNA, 18 nt, Artificial Sequence
  Synthetic
gagagaagagagcagggg

SEQ ID NO: 58492 - RNA, 19 nt, Artificial Sequence
  Synthetic
agagagaagagagcagggg

SEQ ID NO: 58493 - RNA, 20 nt, Artificial Sequence
  Synthetic
aagagagaagagagcagggg

SEQ ID NO: 58494 - RNA, 21 nt, Artificial Sequence
  Synthetic
gaagagagaagagagcagggg

SEQ ID NO: 58495 - RNA, 22 nt, Artificial Sequence
  Synthetic
ggaagagagaagagagcagggg

SEQ ID NO: 58496 - RNA, 23 nt, Artificial Sequence
  Synthetic
cggaagagagaagagagcagggg

SEQ ID NO: 58497 - RNA, 24 nt, Artificial Sequence
  Synthetic
gcggaagagagaagagagcagggg

SEQ ID NO: 58498 - RNA, 18 nt, Artificial Sequence
  Synthetic
gaggcggcgggagagggg

SEQ ID NO: 58499 - RNA, 19 nt, Artificial Sequence
  Synthetic
ugaggcggcgggagagggg

SEQ ID NO: 58500 - RNA, 20 nt, Artificial Sequence
  Synthetic
cugaggcggcgggagagggg

SEQ ID NO: 58501 - RNA, 21 nt, Artificial Sequence
  Synthetic
gcugaggcggcgggagagggg

SEQ ID NO: 58502 - RNA, 22 nt, Artificial Sequence
  Synthetic
ugcugaggcggcgggagagggg

SEQ ID NO: 58503 - RNA, 23 nt, Artificial Sequence
  Synthetic
cugcugaggcggcgggagagggg

SEQ ID NO: 58504 - RNA, 24 nt, Artificial Sequence
  Synthetic
ucugcugaggcggcgggagagggg

SEQ ID NO: 58505 - RNA, 18 nt, Artificial Sequence
  Synthetic
gauggggggaacacgggg

SEQ ID NO: 58506 - RNA, 19 nt, Artificial Sequence
  Synthetic
cgauggggggaacacgggg

SEQ ID NO: 58507 - RNA, 20 nt, Artificial Sequence
  Synthetic
acgauggggggaacacgggg

SEQ ID NO: 58508 - RNA, 21 nt, Artificial Sequence
  Synthetic
aacgauggggggaacacgggg

SEQ ID NO: 58509 - RNA, 22 nt, Artificial Sequence
  Synthetic
gaacgauggggggaacacgggg

SEQ ID NO: 58510 - RNA, 23 nt, Artificial Sequence
  Synthetic
ugaacgauggggggaacacgggg

SEQ ID NO: 58511 - RNA, 24 nt, Artificial Sequence
  Synthetic
gugaacgauggggggaacacgggg

SEQ ID NO: 58512 - RNA, 18 nt, Artificial Sequence
  Synthetic
gggacccaggcuccgggg

SEQ ID NO: 58513 - RNA, 19 nt, Artificial Sequence
  Synthetic
ggggacccaggcuccgggg

SEQ ID NO: 58514 - RNA, 20 nt, Artificial Sequence
  Synthetic
gggggacccaggcuccgggg

SEQ ID NO: 58515 - RNA, 21 nt, Artificial Sequence
  Synthetic
cgggggacccaggcuccgggg

SEQ ID NO: 58516 - RNA, 22 nt, Artificial Sequence
  Synthetic
ccgggggacccaggcuccgggg

SEQ ID NO: 58517 - RNA, 23 nt, Artificial Sequence
  Synthetic
gccgggggacccaggcuccgggg

SEQ ID NO: 58518 - RNA, 24 nt, Artificial Sequence
  Synthetic
cgccgggggacccaggcuccgggg

SEQ ID NO: 58519 - RNA, 18 nt, Artificial Sequence
  Synthetic
gcgcggcggcggucgggg

SEQ ID NO: 58520 - RNA, 19 nt, Artificial Sequence
  Synthetic
ggcgcggcggcggucgggg

SEQ ID NO: 58521 - RNA, 20 nt, Artificial Sequence
  Synthetic
gggcgcggcggcggucgggg

SEQ ID NO: 58522 - RNA, 18 nt, Artificial Sequence
  Synthetic
aggcggcgggagaggggg

SEQ ID NO: 58523 - RNA, 19 nt, Artificial Sequence
  Synthetic
gaggcggcgggagaggggg

SEQ ID NO: 58524 - RNA, 20 nt, Artificial Sequence
  Synthetic
ugaggcggcgggagaggggg

SEQ ID NO: 58525 - RNA, 21 nt, Artificial Sequence
  Synthetic
cugaggcggcgggagaggggg

SEQ ID NO: 58526 - RNA, 22 nt, Artificial Sequence
  Synthetic
gcugaggcggcgggagaggggg

SEQ ID NO: 58527 - RNA, 23 nt, Artificial Sequence
  Synthetic
ugcugaggcggcgggagaggggg

SEQ ID NO: 58528 - RNA, 24 nt, Artificial Sequence
  Synthetic
cugcugaggcggcgggagaggggg

SEQ ID NO: 58529 - RNA, 18 nt, Artificial Sequence
  Synthetic
ggacccaggcuccggggg

SEQ ID NO: 58530 - RNA, 19 nt, Artificial Sequence
  Synthetic
gggacccaggcuccggggg

SEQ ID NO: 58531 - RNA, 20 nt, Artificial Sequence
  Synthetic
ggggacccaggcuccggggg

SEQ ID NO: 58532 - RNA, 21 nt, Artificial Sequence
  Synthetic
gggggacccaggcuccggggg

SEQ ID NO: 58533 - RNA, 22 nt, Artificial Sequence
  Synthetic
cgggggacccaggcuccggggg

SEQ ID NO: 58534 - RNA, 23 nt, Artificial Sequence
  Synthetic
ccgggggacccaggcuccggggg

SEQ ID NO: 58535 - RNA, 24 nt, Artificial Sequence
  Synthetic
gccgggggacccaggcuccggggg

SEQ ID NO: 58536 - RNA, 18 nt, Artificial Sequence
  Synthetic
ggcggcgggagagggggg

SEQ ID NO: 58537 - RNA, 19 nt, Artificial Sequence
  Synthetic
aggcggcgggagagggggg

SEQ ID NO: 58538 - RNA, 20 nt, Artificial Sequence
  Synthetic
gaggcggcgggagagggggg

SEQ ID NO: 58539 - RNA, 21 nt, Artificial Sequence
  Synthetic
ugaggcggcgggagagggggg

SEQ ID NO: 58540 - RNA, 22 nt, Artificial Sequence
  Synthetic
cugaggcggcgggagagggggg

SEQ ID NO: 58541 - RNA, 23 nt, Artificial Sequence
  Synthetic
gcugaggcggcgggagagggggg

SEQ ID NO: 58542 - RNA, 24 nt, Artificial Sequence
  Synthetic
ugcugaggcggcgggagagggggg

SEQ ID NO: 58543 - RNA, 18 nt, Artificial Sequence
  Synthetic
uggggggaacacgggggg

SEQ ID NO: 58544 - RNA, 19 nt, Artificial Sequence
  Synthetic
auggggggaacacgggggg

SEQ ID NO: 58545 - RNA, 20 nt, Artificial Sequence
  Synthetic
gauggggggaacacgggggg

SEQ ID NO: 58546 - RNA, 21 nt, Artificial Sequence
  Synthetic
cgauggggggaacacgggggg

SEQ ID NO: 58547 - RNA, 22 nt, Artificial Sequence
  Synthetic
acgauggggggaacacgggggg

SEQ ID NO: 58548 - RNA, 23 nt, Artificial Sequence
  Synthetic
aacgauggggggaacacgggggg

SEQ ID NO: 58549 - RNA, 24 nt, Artificial Sequence
  Synthetic
gaacgauggggggaacacgggggg

SEQ ID NO: 58550 - RNA, 18 nt, Artificial Sequence
  Synthetic
gacccaggcuccgggggg

SEQ ID NO: 58551 - RNA, 19 nt, Artificial Sequence
  Synthetic
ggacccaggcuccgggggg

SEQ ID NO: 58552 - RNA, 20 nt, Artificial Sequence
  Synthetic
gggacccaggcuccgggggg

SEQ ID NO: 58553 - RNA, 21 nt, Artificial Sequence
  Synthetic
ggggacccaggcuccgggggg

SEQ ID NO: 58554 - RNA, 22 nt, Artificial Sequence
  Synthetic
gggggacccaggcuccgggggg

SEQ ID NO: 58555 - RNA, 23 nt, Artificial Sequence
  Synthetic
cgggggacccaggcuccgggggg

SEQ ID NO: 58556 - RNA, 24 nt, Artificial Sequence
  Synthetic
ccgggggacccaggcuccgggggg

SEQ ID NO: 58557 - RNA, 18 nt, Artificial Sequence
  Synthetic
acccaggcuccggggggg

SEQ ID NO: 58558 - RNA, 19 nt, Artificial Sequence
  Synthetic
gacccaggcuccggggggg

SEQ ID NO: 58559 - RNA, 20 nt, Artificial Sequence
  Synthetic
ggacccaggcuccggggggg

SEQ ID NO: 58560 - RNA, 21 nt, Artificial Sequence
  Synthetic
gggacccaggcuccggggggg

SEQ ID NO: 58561 - RNA, 22 nt, Artificial Sequence
  Synthetic
ggggacccaggcuccggggggg

SEQ ID NO: 58562 - RNA, 23 nt, Artificial Sequence
  Synthetic
gggggacccaggcuccggggggg

SEQ ID NO: 58563 - RNA, 24 nt, Artificial Sequence
  Synthetic
cgggggacccaggcuccggggggg

SEQ ID NO: 58564 - RNA, 18 nt, Artificial Sequence
  Synthetic
gcgggagagggggggggg

SEQ ID NO: 58565 - RNA, 19 nt, Artificial Sequence
  Synthetic
ggcgggagagggggggggg

SEQ ID NO: 58566 - RNA, 20 nt, Artificial Sequence
  Synthetic
cggcgggagagggggggggg

SEQ ID NO: 58567 - RNA, 21 nt, Artificial Sequence
  Synthetic
gcggcgggagagggggggggg

SEQ ID NO: 58568 - RNA, 22 nt, Artificial Sequence
  Synthetic
ggcggcgggagagggggggggg

SEQ ID NO: 58569 - RNA, 23 nt, Artificial Sequence
  Synthetic
aggcggcgggagagggggggggg

SEQ ID NO: 58570 - RNA, 24 nt, Artificial Sequence
  Synthetic
gaggcggcgggagagggggggggg

SEQ ID NO: 58571 - RNA, 18 nt, Artificial Sequence
  Synthetic
agagagcagggguugggg

SEQ ID NO: 58572 - RNA, 19 nt, Artificial Sequence
  Synthetic
aagagagcagggguugggg

SEQ ID NO: 58573 - RNA, 20 nt, Artificial Sequence
  Synthetic
gaagagagcagggguugggg

SEQ ID NO: 58574 - RNA, 21 nt, Artificial Sequence
  Synthetic
agaagagagcagggguugggg

SEQ ID NO: 58575 - RNA, 22 nt, Artificial Sequence
  Synthetic
gagaagagagcagggguugggg

SEQ ID NO: 58576 - RNA, 23 nt, Artificial Sequence
  Synthetic
agagaagagagcagggguugggg

SEQ ID NO: 58577 - RNA, 24 nt, Artificial Sequence
  Synthetic
gagagaagagagcagggguugggg

SEQ ID NO: 58578 - RNA, 18 nt, Artificial Sequence
  Synthetic
gugguggugaacgauggg

SEQ ID NO: 58579 - RNA, 19 nt, Artificial Sequence
  Synthetic
cgugguggugaacgauggg

SEQ ID NO: 58580 - RNA, 20 nt, Artificial Sequence
  Synthetic
gcgugguggugaacgauggg

SEQ ID NO: 58581 - RNA, 21 nt, Artificial Sequence
  Synthetic
ggcgugguggugaacgauggg

SEQ ID NO: 58582 - RNA, 22 nt, Artificial Sequence
  Synthetic
gggcgugguggugaacgauggg

SEQ ID NO: 58583 - RNA, 23 nt, Artificial Sequence
  Synthetic
ggggcgugguggugaacgauggg

SEQ ID NO: 58584 - RNA, 24 nt, Artificial Sequence
  Synthetic
gggggcgugguggugaacgauggg

SEQ ID NO: 58585 - RNA, 18 nt, Artificial Sequence
  Synthetic
cgugguggugaacgaugg

SEQ ID NO: 58586 - RNA, 19 nt, Artificial Sequence
  Synthetic
gcgugguggugaacgaugg

SEQ ID NO: 58587 - RNA, 20 nt, Artificial Sequence
  Synthetic
ggcgugguggugaacgaugg

SEQ ID NO: 58588 - RNA, 21 nt, Artificial Sequence
  Synthetic
gggcgugguggugaacgaugg

SEQ ID NO: 58589 - RNA, 22 nt, Artificial Sequence
  Synthetic
ggggcgugguggugaacgaugg

SEQ ID NO: 58590 - RNA, 23 nt, Artificial Sequence
  Synthetic
gggggcgugguggugaacgaugg

SEQ ID NO: 58591 - RNA, 24 nt, Artificial Sequence
  Synthetic
ggggggcgugguggugaacgaugg

SEQ ID NO: 58592 - RNA, 18 nt, Artificial Sequence
  Synthetic
cggaaaaacggaggaugg

SEQ ID NO: 58593 - RNA, 19 nt, Artificial Sequence
  Synthetic
gcggaaaaacggaggaugg

SEQ ID NO: 58594 - RNA, 20 nt, Artificial Sequence
  Synthetic
agcggaaaaacggaggaugg

SEQ ID NO: 58595 - RNA, 21 nt, Artificial Sequence
  Synthetic
aagcggaaaaacggaggaugg

SEQ ID NO: 58596 - RNA, 22 nt, Artificial Sequence
  Synthetic
aaagcggaaaaacggaggaugg

SEQ ID NO: 58597 - RNA, 23 nt, Artificial Sequence
  Synthetic
gaaagcggaaaaacggaggaugg

SEQ ID NO: 58598 - RNA, 24 nt, Artificial Sequence
  Synthetic
ggaaagcggaaaaacggaggaugg

SEQ ID NO: 58599 - RNA, 18 nt, Artificial Sequence
  Synthetic
ucggggugggaguggugg

SEQ ID NO: 58600 - RNA, 19 nt, Artificial Sequence
  Synthetic
gucggggugggaguggugg

SEQ ID NO: 58601 - RNA, 20 nt, Artificial Sequence
  Synthetic
ggucggggugggaguggugg

SEQ ID NO: 58602 - RNA, 21 nt, Artificial Sequence
  Synthetic
cggucggggugggaguggugg

SEQ ID NO: 58603 - RNA, 22 nt, Artificial Sequence
  Synthetic
gcggucggggugggaguggugg

SEQ ID NO: 58604 - RNA, 23 nt, Artificial Sequence
  Synthetic
ggcggucggggugggaguggugg

SEQ ID NO: 58605 - RNA, 24 nt, Artificial Sequence
  Synthetic
cggcggucggggugggaguggugg

SEQ ID NO: 58606 - RNA, 18 nt, Artificial Sequence
  Synthetic
gaagagagcagggguugg

SEQ ID NO: 58607 - RNA, 19 nt, Artificial Sequence
  Synthetic
agaagagagcagggguugg

SEQ ID NO: 58608 - RNA, 20 nt, Artificial Sequence
  Synthetic
gagaagagagcagggguugg

SEQ ID NO: 58609 - RNA, 21 nt, Artificial Sequence
  Synthetic
agagaagagagcagggguugg

SEQ ID NO: 58610 - RNA, 22 nt, Artificial Sequence
  Synthetic
gagagaagagagcagggguugg

SEQ ID NO: 58611 - RNA, 23 nt, Artificial Sequence
  Synthetic
agagagaagagagcagggguugg

SEQ ID NO: 58612 - RNA, 24 nt, Artificial Sequence
  Synthetic
aagagagaagagagcagggguugg

SEQ ID NO: 58613 - RNA, 18 nt, Artificial Sequence
  Synthetic
gcgugguggugaacgaug

SEQ ID NO: 58614 - RNA, 19 nt, Artificial Sequence
  Synthetic
ggcgugguggugaacgaug

SEQ ID NO: 58615 - RNA, 20 nt, Artificial Sequence
  Synthetic
gggcgugguggugaacgaug

SEQ ID NO: 58616 - RNA, 21 nt, Artificial Sequence
  Synthetic
ggggcgugguggugaacgaug

SEQ ID NO: 58617 - RNA, 22 nt, Artificial Sequence
  Synthetic
gggggcgugguggugaacgaug

SEQ ID NO: 58618 - RNA, 23 nt, Artificial Sequence
  Synthetic
ggggggcgugguggugaacgaug

SEQ ID NO: 58619 - RNA, 24 nt, Artificial Sequence
  Synthetic
uggggggcgugguggugaacgaug

SEQ ID NO: 58620 - RNA, 18 nt, Artificial Sequence
  Synthetic
cguacaggugagcuucug

SEQ ID NO: 58621 - RNA, 19 nt, Artificial Sequence
  Synthetic
ucguacaggugagcuucug

SEQ ID NO: 58622 - RNA, 20 nt, Artificial Sequence
  Synthetic
gucguacaggugagcuucug

SEQ ID NO: 58623 - RNA, 21 nt, Artificial Sequence
  Synthetic
ggucguacaggugagcuucug

SEQ ID NO: 58624 - RNA, 22 nt, Artificial Sequence
  Synthetic
gggucguacaggugagcuucug

SEQ ID NO: 58625 - RNA, 23 nt, Artificial Sequence
  Synthetic
agggucguacaggugagcuucug

SEQ ID NO: 58626 - RNA, 24 nt, Artificial Sequence
  Synthetic
uagggucguacaggugagcuucug

SEQ ID NO: 58627 - RNA, 18 nt, Artificial Sequence
  Synthetic
aacagccaaggcgcggug

SEQ ID NO: 58628 - RNA, 19 nt, Artificial Sequence
  Synthetic
aaacagccaaggcgcggug

SEQ ID NO: 58629 - RNA, 20 nt, Artificial Sequence
  Synthetic
caaacagccaaggcgcggug

SEQ ID NO: 58630 - RNA, 21 nt, Artificial Sequence
  Synthetic
ccaaacagccaaggcgcggug

SEQ ID NO: 58631 - RNA, 22 nt, Artificial Sequence
  Synthetic
cccaaacagccaaggcgcggug

SEQ ID NO: 58632 - RNA, 23 nt, Artificial Sequence
  Synthetic
ccccaaacagccaaggcgcggug

SEQ ID NO: 58633 - RNA, 24 nt, Artificial Sequence
  Synthetic
cccccaaacagccaaggcgcggug

SEQ ID NO: 58634 - RNA, 18 nt, Artificial Sequence
  Synthetic
gucggggugggaguggug

SEQ ID NO: 58635 - RNA, 19 nt, Artificial Sequence
  Synthetic
ggucggggugggaguggug

SEQ ID NO: 58636 - RNA, 20 nt, Artificial Sequence
  Synthetic
cggucggggugggaguggug

SEQ ID NO: 58637 - RNA, 21 nt, Artificial Sequence
  Synthetic
gcggucggggugggaguggug

SEQ ID NO: 58638 - RNA, 22 nt, Artificial Sequence
  Synthetic
ggcggucggggugggaguggug

SEQ ID NO: 58639 - RNA, 23 nt, Artificial Sequence
  Synthetic
cggcggucggggugggaguggug

SEQ ID NO: 58640 - RNA, 24 nt, Artificial Sequence
  Synthetic
gcggcggucggggugggaguggug

SEQ ID NO: 58641 - RNA, 18 nt, Artificial Sequence
  Synthetic
gcgguggggggcguggug

SEQ ID NO: 58642 - RNA, 19 nt, Artificial Sequence
  Synthetic
cgcgguggggggcguggug

SEQ ID NO: 58643 - RNA, 20 nt, Artificial Sequence
  Synthetic
gcgcgguggggggcguggug

SEQ ID NO: 58644 - RNA, 21 nt, Artificial Sequence
  Synthetic
ggcgcgguggggggcguggug

SEQ ID NO: 58645 - RNA, 22 nt, Artificial Sequence
  Synthetic
aggcgcgguggggggcguggug

SEQ ID NO: 58646 - RNA, 23 nt, Artificial Sequence
  Synthetic
aaggcgcgguggggggcguggug

SEQ ID NO: 58647 - RNA, 24 nt, Artificial Sequence
  Synthetic
caaggcgcgguggggggcguggug

SEQ ID NO: 58648 - RNA, 18 nt, Artificial Sequence
  Synthetic
ggggugggagugguggug

SEQ ID NO: 58649 - RNA, 19 nt, Artificial Sequence
  Synthetic
cggggugggagugguggug

SEQ ID NO: 58650 - RNA, 20 nt, Artificial Sequence
  Synthetic
ucggggugggagugguggug

SEQ ID NO: 58651 - RNA, 21 nt, Artificial Sequence
  Synthetic
gucggggugggagugguggug

SEQ ID NO: 58652 - RNA, 22 nt, Artificial Sequence
  Synthetic
ggucggggugggagugguggug

SEQ ID NO: 58653 - RNA, 23 nt, Artificial Sequence
  Synthetic
cggucggggugggagugguggug

SEQ ID NO: 58654 - RNA, 24 nt, Artificial Sequence
  Synthetic
gcggucggggugggagugguggug

SEQ ID NO: 58655 - RNA, 18 nt, Artificial Sequence
  Synthetic
agaagagagcagggguug

SEQ ID NO: 58656 - RNA, 19 nt, Artificial Sequence
  Synthetic
gagaagagagcagggguug

SEQ ID NO: 58657 - RNA, 20 nt, Artificial Sequence
  Synthetic
agagaagagagcagggguug

SEQ ID NO: 58658 - RNA, 21 nt, Artificial Sequence
  Synthetic
gagagaagagagcagggguug

SEQ ID NO: 58659 - RNA, 22 nt, Artificial Sequence
  Synthetic
agagagaagagagcagggguug

SEQ ID NO: 58660 - RNA, 23 nt, Artificial Sequence
  Synthetic
aagagagaagagagcagggguug

SEQ ID NO: 58661 - RNA, 24 nt, Artificial Sequence
  Synthetic
gaagagagaagagagcagggguug

SEQ ID NO: 58662 - RNA, 18 nt, Artificial Sequence
  Synthetic
gauggaagggcagaagau

SEQ ID NO: 58663 - RNA, 19 nt, Artificial Sequence
  Synthetic
ggauggaagggcagaagau

SEQ ID NO: 58664 - RNA, 20 nt, Artificial Sequence
  Synthetic
aggauggaagggcagaagau

SEQ ID NO: 58665 - RNA, 21 nt, Artificial Sequence
  Synthetic
gaggauggaagggcagaagau

SEQ ID NO: 58666 - RNA, 22 nt, Artificial Sequence
  Synthetic
ggaggauggaagggcagaagau

SEQ ID NO: 58667 - RNA, 23 nt, Artificial Sequence
  Synthetic
cggaggauggaagggcagaagau

SEQ ID NO: 58668 - RNA, 24 nt, Artificial Sequence
  Synthetic
acggaggauggaagggcagaagau

SEQ ID NO: 58669 - RNA, 18 nt, Artificial Sequence
  Synthetic
ggcgugguggugaacgau

SEQ ID NO: 58670 - RNA, 19 nt, Artificial Sequence
  Synthetic
gggcgugguggugaacgau

SEQ ID NO: 58671 - RNA, 20 nt, Artificial Sequence
  Synthetic
ggggcgugguggugaacgau

SEQ ID NO: 58672 - RNA, 21 nt, Artificial Sequence
  Synthetic
gggggcgugguggugaacgau

SEQ ID NO: 58673 - RNA, 22 nt, Artificial Sequence
  Synthetic
ggggggcgugguggugaacgau

SEQ ID NO: 58674 - RNA, 23 nt, Artificial Sequence
  Synthetic
uggggggcgugguggugaacgau

SEQ ID NO: 58675 - RNA, 24 nt, Artificial Sequence
  Synthetic
guggggggcgugguggugaacgau

SEQ ID NO: 58676 - RNA, 18 nt, Artificial Sequence
  Synthetic
cgccgggggacccaggcu

SEQ ID NO: 58677 - RNA, 19 nt, Artificial Sequence
  Synthetic
ccgccgggggacccaggcu

SEQ ID NO: 58678 - RNA, 20 nt, Artificial Sequence
  Synthetic
uccgccgggggacccaggcu

SEQ ID NO: 58679 - RNA, 21 nt, Artificial Sequence
  Synthetic
guccgccgggggacccaggcu

SEQ ID NO: 58680 - RNA, 22 nt, Artificial Sequence
  Synthetic
cguccgccgggggacccaggcu

SEQ ID NO: 58681 - RNA, 23 nt, Artificial Sequence
  Synthetic
ccguccgccgggggacccaggcu

SEQ ID NO: 58682 - RNA, 24 nt, Artificial Sequence
  Synthetic
gccguccgccgggggacccaggcu

SEQ ID NO: 58683 - RNA, 18 nt, Artificial Sequence
  Synthetic
cgccugcgugugucucgu

SEQ ID NO: 58684 - RNA, 19 nt, Artificial Sequence
  Synthetic
gcgccugcgugugucucgu

SEQ ID NO: 58685 - RNA, 20 nt, Artificial Sequence
  Synthetic
ggcgccugcgugugucucgu

SEQ ID NO: 58686 - RNA, 21 nt, Artificial Sequence
  Synthetic
gggcgccugcgugugucucgu

SEQ ID NO: 58687 - RNA, 22 nt, Artificial Sequence
  Synthetic
ggggcgccugcgugugucucgu

SEQ ID NO: 58688 - RNA, 23 nt, Artificial Sequence
  Synthetic
gggggcgccugcgugugucucgu

SEQ ID NO: 58689 - RNA, 24 nt, Artificial Sequence
  Synthetic
ggggggcgccugcgugugucucgu

SEQ ID NO: 58690 - RNA, 18 nt, Artificial Sequence
  Synthetic
aaacagccaaggcgcggu

SEQ ID NO: 58691 - RNA, 19 nt, Artificial Sequence
  Synthetic
caaacagccaaggcgcggu

SEQ ID NO: 58692 - RNA, 20 nt, Artificial Sequence
  Synthetic
ccaaacagccaaggcgcggu

SEQ ID NO: 58693 - RNA, 21 nt, Artificial Sequence
  Synthetic
cccaaacagccaaggcgcggu

SEQ ID NO: 58694 - RNA, 22 nt, Artificial Sequence
  Synthetic
ccccaaacagccaaggcgcggu

SEQ ID NO: 58695 - RNA, 23 nt, Artificial Sequence
  Synthetic
cccccaaacagccaaggcgcggu

SEQ ID NO: 58696 - RNA, 24 nt, Artificial Sequence
  Synthetic
ccccccaaacagccaaggcgcggu

SEQ ID NO: 58697 - RNA, 18 nt, Artificial Sequence
  Synthetic
agagaagagagcaggggu

SEQ ID NO: 58698 - RNA, 19 nt, Artificial Sequence
  Synthetic
gagagaagagagcaggggu

SEQ ID NO: 58699 - RNA, 20 nt, Artificial Sequence
  Synthetic
agagagaagagagcaggggu

SEQ ID NO: 58700 - RNA, 21 nt, Artificial Sequence
  Synthetic
aagagagaagagagcaggggu

SEQ ID NO: 58701 - RNA, 22 nt, Artificial Sequence
  Synthetic
gaagagagaagagagcaggggu

SEQ ID NO: 58702 - RNA, 23 nt, Artificial Sequence
  Synthetic
ggaagagagaagagagcaggggu

SEQ ID NO: 58703 - RNA, 24 nt, Artificial Sequence
  Synthetic
cggaagagagaagagagcaggggu

SEQ ID NO: 58704 - RNA, 18 nt, Artificial Sequence
  Synthetic
aacacgggggggaggggu

SEQ ID NO: 58705 - RNA, 19 nt, Artificial Sequence
  Synthetic
gaacacgggggggaggggu

SEQ ID NO: 58706 - RNA, 20 nt, Artificial Sequence
  Synthetic
ggaacacgggggggaggggu

SEQ ID NO: 58707 - RNA, 21 nt, Artificial Sequence
  Synthetic
gggaacacgggggggaggggu

SEQ ID NO: 58708 - RNA, 22 nt, Artificial Sequence
  Synthetic
ggggaacacgggggggaggggu

SEQ ID NO: 58709 - RNA, 23 nt, Artificial Sequence
  Synthetic
gggggaacacgggggggaggggu

SEQ ID NO: 58710 - RNA, 24 nt, Artificial Sequence
  Synthetic
ggggggaacacgggggggaggggu

SEQ ID NO: 58711 - RNA, 18 nt, Artificial Sequence
  Synthetic
cggggugggagugguggu

SEQ ID NO: 58712 - RNA, 19 nt, Artificial Sequence
  Synthetic
ucggggugggagugguggu

SEQ ID NO: 58713 - RNA, 20 nt, Artificial Sequence
  Synthetic
gucggggugggagugguggu

SEQ ID NO: 58714 - RNA, 21 nt, Artificial Sequence
  Synthetic
ggucggggugggagugguggu

SEQ ID NO: 58715 - RNA, 22 nt, Artificial Sequence
  Synthetic
cggucggggugggagugguggu

SEQ ID NO: 58716 - RNA, 23 nt, Artificial Sequence
  Synthetic
gcggucggggugggagugguggu

SEQ ID NO: 58717 - RNA, 24 nt, Artificial Sequence
  Synthetic
ggcggucggggugggagugguggu

SEQ ID NO: 58718 - RNA, 18 nt, Artificial Sequence
  Synthetic
ccugcgugugucucgugu

SEQ ID NO: 58719 - RNA, 19 nt, Artificial Sequence
  Synthetic
gccugcgugugucucgugu

SEQ ID NO: 58720 - RNA, 20 nt, Artificial Sequence
  Synthetic
cgccugcgugugucucgugu

SEQ ID NO: 58721 - RNA, 21 nt, Artificial Sequence
  Synthetic
gcgccugcgugugucucgugu

SEQ ID NO: 58722 - RNA, 22 nt, Artificial Sequence
  Synthetic
ggcgccugcgugugucucgugu

SEQ ID NO: 58723 - RNA, 23 nt, Artificial Sequence
  Synthetic
gggcgccugcgugugucucgugu

SEQ ID NO: 58724 - RNA, 24 nt, Artificial Sequence
  Synthetic
ggggcgccugcgugugucucgugu

SEQ ID NO: 58725 - RNA, 18 nt, Artificial Sequence
  Synthetic
gagaagagagcagggguu

SEQ ID NO: 58726 - RNA, 19 nt, Artificial Sequence
  Synthetic
agagaagagagcagggguu

SEQ ID NO: 58727 - RNA, 20 nt, Artificial Sequence
  Synthetic
gagagaagagagcagggguu

SEQ ID NO: 58728 - RNA, 21 nt, Artificial Sequence
  Synthetic
agagagaagagagcagggguu

SEQ ID NO: 58729 - RNA, 22 nt, Artificial Sequence
  Synthetic
aagagagaagagagcagggguu

SEQ ID NO: 58730 - RNA, 23 nt, Artificial Sequence
  Synthetic
gaagagagaagagagcagggguu

SEQ ID NO: 58731 - RNA, 24 nt, Artificial Sequence
  Synthetic
ggaagagagaagagagcagggguu

SEQ ID NO: 58732 - RNA, 17 nt, Artificial Sequence
  Synthetic
gcgcgaaaggggccccc

SEQ ID NO: 58733 - RNA, 17 nt, Artificial Sequence
  Synthetic
gggacccccgggcgggc

SEQ ID NO: 58734 - RNA, 17 nt, Artificial Sequence
  Synthetic
gggcccccggaggcuuu

SEQ ID NO: 58735 - RNA, 20 nt, Artificial Sequence
  Synthetic
gggcggggcucgggcucucc

SEQ ID NO: 58736 - RNA, 20 nt, Artificial Sequence
  Synthetic
gcucgccccguccccccucu

SEQ ID NO: 58737 - RNA, 17 nt, Artificial Sequence
  Synthetic
cggggcucgggcucucc

SEQ ID NO: 58738 - RNA, 17 nt, Artificial Sequence
  Synthetic
cgcgcgccucucuuucc

SEQ ID NO: 58739 - RNA, 17 nt, Artificial Sequence
  Synthetic
cgccccguccccccucu

SEQ ID NO: 58740 - RNA, 20 nt, Artificial Sequence
  Synthetic
aaggcgcgaaaggggccccc

SEQ ID NO: 58741 - RNA, 20 nt, Artificial Sequence
  Synthetic
uuccgcgcgccucucuuucc

SEQ ID NO: 58742 - RNA, 20 nt, Artificial Sequence
  Synthetic
ucggggacccccgggcgggc

SEQ ID NO: 58743 - RNA, 20 nt, Artificial Sequence
  Synthetic
aaggggcccccggaggcuuu

SEQ ID NO: 58744 - RNA, 17 nt, Artificial Sequence
  Synthetic
gguuuagggucguacag

SEQ ID NO: 58745 - RNA, 17 nt, Artificial Sequence
  Synthetic
cucggccucuccggcug

SEQ ID NO: 58746 - RNA, 17 nt, Artificial Sequence
  Synthetic
ccuuccauccuccguuu

SEQ ID NO: 58747 - RNA, 20 nt, Artificial Sequence
  Synthetic
guagguuuagggucguacag

SEQ ID NO: 58748 - RNA, 20 nt, Artificial Sequence
  Synthetic
ccgcucggccucuccggcug

SEQ ID NO: 58749 - RNA, 20 nt, Artificial Sequence
  Synthetic
ugcccuuccauccuccguuu
